US009340577B2

(12) United States Patent
Grey et al.

(10) Patent No.: US 9,340,577 B2
(45) Date of Patent: May 17, 2016

(54) HLA BINDING MOTIFS AND PEPTIDES AND THEIR USES

(75) Inventors: Howard M. Grey, La Jolla, CA (US); Alessandro Sette, La Jolla, CA (US); John Sidney, La Jolla, CA (US); Scott Southwood, Santee, CA (US); Ralph T. Kubo, Carlsbad, CA (US); Esteban Celis, Rochester, MN (US); Robert Chesnut, Cardiff-by-the-Sea, CA (US); W. Martin Kast, La Cañada, CA (US)

(73) Assignee: Epimmune Inc., San Diego, CA (US)

( * ) Notice: Subject to any disclaimer, the term of this patent is extended or adjusted under 35 U.S.C. 154(b) by 1805 days.

(21) Appl. No.: 10/817,970

(22) Filed: Apr. 6, 2004

(65) Prior Publication Data

US 2007/0055049 A1 Mar. 8, 2007

Related U.S. Application Data

(63) Continuation-in-part of application No. 08/821,739, filed on Mar. 20, 1997, now abandoned, which is a continuation-in-part of application No. 08/859,107, filed on Jan. 23, 1996, now abandoned, and a continuation-in-part of application No. 08/451,913, filed on May 26, 1995, now abandoned, and a continuation-in-part of application No. 08/186,266, filed on Jan. 25, 1994, now Pat. No. 5,662,907, which is a continuation-in-part of application No. 08/159,339, filed on Nov. 29, 1993, now Pat. No. 6,037,135, which is a continuation-in-part of application No. 08/103,396, filed on Aug. 6, 1993, now (Continued)

(51) Int. Cl.

| | |
|---|---|
| ***A61K 38/10*** | (2006.01) |
| ***A61K 39/145*** | (2006.01) |
| ***C07K 7/08*** | (2006.01) |
| ***C07K 7/06*** | (2006.01) |
| ***A61K 39/02*** | (2006.01) |
| ***A61K 39/12*** | (2006.01) |
| ***C07K 14/74*** | (2006.01) |
| *A61K 38/00* | (2006.01) |
| *A61K 39/00* | (2006.01) |

(52) U.S. Cl.

CPC . *C07K 7/06* (2013.01); *A61K 38/10* (2013.01); *A61K 39/02* (2013.01); *A61K 39/12* (2013.01); *A61K 39/145* (2013.01); *C07K 14/70539* (2013.01); *A61K 38/00* (2013.01); *A61K 39/00* (2013.01); *C07K 2319/01* (2013.01); *C07K 2319/33* (2013.01); *C07K 2319/40* (2013.01); *C12N 2710/00088* (2013.01)

(58) Field of Classification Search

None

See application file for complete search history.

(56) References Cited

U.S. PATENT DOCUMENTS

| | | | |
|---|---|---|---|
| 5,200,320 | A | 4/1993 | Sette et al. |
| 5,503,829 | A | 4/1996 | Ladant et al. |
| 5,662,907 | A | 9/1997 | Kubo et al. |
| 5,846,827 | A | 12/1998 | Celis et al. |
| 6,034,214 | A | 3/2000 | Boon et al. |
| 6,413,517 | B1 | 7/2002 | Sette et al. |
| 6,534,482 | B1 | 3/2003 | Fikes et al. |
| 2002/0098197 | A1 | 7/2002 | Sette et al. |
| 2002/0160019 | A1 | 10/2002 | Sette et al. |
| 2002/0177694 | A1 | 11/2002 | Sette et al. |
| 2003/0099634 | A1 | 5/2003 | Vitiello et al. |
| 2003/0152580 | A1 | 8/2003 | Sette et al. |
| 2003/0185822 | A1 | 10/2003 | Grey et al. |
| 2003/0203869 | A1 | 10/2003 | Fikes et al. |
| 2003/0220285 | A1 | 11/2003 | Fikes et al. |

FOREIGN PATENT DOCUMENTS

| | | | |
|---|---|---|---|
| EP | 0 044 710 | A1 | 1/1982 |
| EP | 0 226 513 | A1 | 6/1987 |
| WO | WO 92/02543 | A1 | 2/1992 |
| WO | WO 92/12996 | A2 | 8/1992 |
| WO | WO 92/21033 | A1 | 11/1992 |
| WO | WO 93/03764 | A1 | 3/1993 |
| WO | WO 94/03205 | A1 | 2/1994 |
| WO | WO 94/11738 | A1 | 5/1994 |
| WO | WO 94/20127 | A1 | 9/1994 |
| WO | WO 95/04817 | A1 | 2/1995 |
| WO | WO 95/22317 | A1 | 8/1995 |
| WO | WO 96/03140 | A1 | 2/1996 |
| WO | WO 96/18409 | * | 6/1996 |
| WO | WO 97/33602 | A1 | 9/1997 |
| WO | WO 97/34621 | A1 | 9/1997 |
| WO | WO 98/32456 | A1 | 7/1998 |
| WO | WO 99/45954 | A1 | 9/1999 |
| WO | WO 99/58658 | A2 | 11/1999 |
| WO | WO 99/61916 | A1 | 12/1999 |
| WO | WO 99/65522 | A1 | 12/1999 |
| WO | WO 02/20616 | A1 | 3/2002 |
| WO | WO 02/061435 | A2 | 8/2002 |

OTHER PUBLICATIONS

Yamashita et al., Virol., 171:458-466, 1989.*
Dibrino et al., PNAS USA, 90:1508-12, 1993.*

(Continued)

*Primary Examiner* — Ronald Schwadron

(74) *Attorney, Agent, or Firm* — Sterne, Kessler, Goldstein & Fox P.L.L.C.

(57) ABSTRACT

The present invention provides the means and methods for selecting immunogenic peptides and the immunogenic peptide compositions capable of specifically binding glycoproteins encoded by HLA alleles and inducing T cell activation in T cells restricted by the allele. One such peptide, NMLSTVLGV (SEQ ID NO: 183) is useful to elicit an immune response against influenza. The present invention also provides a heteropolymer of an isolated immunogenic peptide less than 15 amino acids in length comprising the oligopeptide NMLSTVLGV (SEQ ID NO: 183) and at least one different peptide.

6 Claims, 57 Drawing Sheets

Related U.S. Application Data abandoned, which is a continuation-in-part of application No. 08/027,746, filed on Mar. 5, 1993, now abandoned, which is a continuation-in-part of application No. 07/926,666, filed on Aug. 7, 1992, now abandoned, said application No. 08/821,739 is a continuation-in-part of application No. 08/347,610, filed on Dec. 1, 1994, now abandoned, which is a continuation-in-part of application No. 08/159,339, which is a continuation-in-part of application No. 08/103,396, which is a continuation-in-part ofapplication No. 08/027,746, which is a continuation-in-part of application No. 07/926,666, application No. 10/817,970, which is a continuation-in-part of application No. 09/665,510, filed on Sep. 19, 2000, now abandoned, which is a continuation-in-part of application No. 08/347,610, which is a continuation-in-part of application No. 08/159,339, which is a continuation-in-part of application No. 08/103,396, which is a continuation-in-part of application No. 08/027,746, which is a continuation-in-part of application No. 07/926,666, application No. 10/817,970, which is a continuation-in-part of application No. 09/017,524, filed on Feb. 3, 1998, now abandoned, which is a continuation-in-part of application No. 08/589,107, and a continuation-in-part of application No. 08/758,409, filed on Nov. 27, 1996, now abandoned, and a continuation-in-part of application No. 08/821,739, which is a continuation-in-part of application No. 08/589,107, and a continuation-in-part of application No. 08/451,913, and a continuation-in-part of application No. 08/347,610, which is a continuation-in-part of application No. 08/159,339, which is a continuation-in-part of application No. 08/103,396, which is a continuation-in-part of application No. 08/027,746, which is a continuation-in-part of application No. 07/926,666, said application No. 08/821,739 is a continuation-in-part of application No. 08/186,266, which is a continuation-in-part of application No. 08/159,339, which is a continuation-in-part of application No. 08/103,396, which is a continuation-in-part of application No. 08/027,746, which is a continuation-in-part of application No. 07/926,666, application No. 10/817,970, which is a continuation-in-part of application No. 09/017,735, filed on Feb. 3, 1998, now abandoned, which is a continuation-in-part of application No. 08/205,713, filed on Mar. 4, 1994, now abandoned, which is a continuation-in-part of application No. 08/159,184, filed on Nov. 29, 1993, now abandoned, which is a continuation-in-part of application No. 08/073,205, filed on Jun. 4, 1993, now abandoned, which is a continuation-in-part of application No. 08/027,146, filed on Mar. 5, 1993, now abandoned, said application No. 09/017,735 is a continuation-in-part of application No. 08/589,108, and a continuation-in-part of application No. 08/454,033, filed on May 26, 1995, now abandoned, and a continuation-in-part of application No. 08/349,177, filed on Dec. 2, 1994, now abandoned, which is a continuation-in-part of application No. 08/159,184, which is a continuation-in-part of application No. 08/073,205, which is a continuation-in-part of application No. 08/027,146, said application No. 09/017,735 is a continuation-in-part of application No. 08/822,382, filed on Mar. 20, 1997, now abandoned, said application No. 09/017,735 is a continuation-in-part of application No. 08/753,622, filed on Nov. 27, 1996, now abandoned, and a continuation-in-part of application No. 08/205,713, which is a continuation-in-part of application No. 08/159,184, which is a continuation-in-part of application No. 08/073,205, which is a continuation-in-part of application No. 08/027,146, application No. 10/817,970, which is a continuation-in-part of application No. 08/454,033, which is a continuation-in-part of application No. 08/349,177, which is a continuation-in-part of application No. 08/159,184, which is a continuation-in-part of application No. 08/073,205, which is a continuation-in-part of application No. 08/027,146, application No. 10/817,970, which is a continuation-in-part of application No. 09/017,743, filed on Feb. 3, 1998, now abandoned, which is a continuation-in-part of application No. 08/753,615, filed on Nov. 27, 1996, now abandoned, which is a continuation-in-part of application No. 08/590,298, filed on Jan. 23, 1996, now abandoned, which is a continuation-in-part of application No. 08/452,843, filed on May 30, 1995, now abandoned, which is a continuation-in-part of application No. 08/344,824, filed on Nov. 23, 1994, now abandoned, which is a continuation-in-part of application No. 08/278,634, filed on Jul. 21, 1994, now abandoned, application No. 10/817,970, which is a continuation-in-part of application No. 08/452,843, which is a continuation-in-part of application No. 08/344,824, which is a continuation-in-part of application No. 08/278,634, application No. 10/817,970, which is a continuation-in-part of application No. 08/344,824, which is a continuation-in-part of application No. 08/278,634, application No. 10/817,970, which is a continuation-in-part of application No. 09/226,775, which is a continuation-in-part of application No. 08/815,396, said application No. 09/226,775 is a continuation-in-part of application No. 08/485,218, filed on Jun. 7, 1995, now abandoned, which is a continuation-in-part of application No. 08/305,871, filed on Sep. 14, 1994, now Pat. No. 5,736,142, which is a continuation-in-part of application No. 08/121,101, filed on Sep. 14, 1993, now abandoned, application No. 10/817,970, which is a continuation-in-part of application No. 10/030,014, filed as application No. PCT/US00/17842 on Jun. 28, 2000, now abandoned, application No. 10/817,970, which is a continuation-in-part of application No. 10/121,415, filed on Apr. 11, 2002, now abandoned, which is a continuation-in-part of application No. 09/189,702, filed on Nov. 10, 1998, now Pat. No. 7,252,829, which is a continuation-in-part of application No. 09/098,584, filed on Jun. 17, 1998, now abandoned, application No. 10/817,970, which is a continuation-in-part of application No. PCT/US03/31308, filed on Oct. 3, 2003, application No. 10/817,970, which is a continuation-in-part of application No. 09/260,714, filed on Mar. 1, 1999, now abandoned, and a continuation-in-part of application No. 10/470,364, filed as application No. PCT/US02/02708 on Jan. 29, 2002, now abandoned, which is a continuation-in-part of application No. 09/935,476, filed on Aug. 22, 2001, now abandoned, which is a continuation-in-part of application No. 09/346,105, filed on Jun. 30, 1999, now abandoned, application No. 10/817,970, which is a continuation-in-part of application No. 10/469,201, filed as application No. PCT/US01/51650 on Oct. 18, 2001, now abandoned.

(60) Provisional application No. 60/013,833, filed on Mar. 21, 1996, provisional application No. 60/013,980,

Related U.S. Application Data filed on Mar. 21, 1996, provisional application No. 60/013,113, filed on Mar. 11, 1996, provisional application No. 60/141,422, filed on Jun. 29, 1999, provisional application No. 60/416,207, filed on Oct. 3, 2002, provisional application No. 60/417,269, filed on Oct. 8, 2002, provisional application No. 60/264,969, filed on Jan. 29, 2001, provisional application No. 60/285,264, filed on Apr. 20, 2001, provisional application No. 60/242,350, filed on Oct. 19, 2000.

(56) References Cited

OTHER PUBLICATIONS

Rammense et al., Immunogenetics, 41:178-228, 1995.*
Aichele, P., et al., "Antiviral cytotoxic T cell response induced by in vivo priming with a free synthetic peptide," *J. Exp. Med. 171*:1815-1820, Rockefeller University Press, United States (1990).
Alexander, J., et al., "Derivation of HLA-A11/$K^b$ Transgenic Mice. Functional CTL Repertoire and Recognition of Human A11-Restricted CTL Epitopes," *J. Immunol. 159*:4753-4761, The American Association of Immunologists, United States (Nov. 1997).
Bergmann, C., et al., "Differential Effects of Flanking Residues on Presentation of Epitopes from Chimeric Peptides," *J. Virol. 68*:5306-5310, American Society for Microbiology, United States (Aug. 1994).
Bertoni, R., et al., "Human Histocompatibility Leukocyte Antigen-binding Supermotifs Predict Broadly Cross-reactive Cytotoxic T Lymphocyte Responses in Patients with Acute Hepatitis," *J. Clin. Invest. 100*:503-513, The American Society for Clinical Investigation, Inc., United States (Aug. 1997).
Bertoni, R., et al., "Human Class I Supertypes and CTL Repertoires Extend to Chimpanzees," *J. Immunol. 161*:4447-4455, American Association of Immunologists, United States (Oct. 1998).
Bjorkman, P., et al., "The foreign antigen binding site and T cell recognition regions of class I histocompatibility antigens," *Nature 329*:512-518, Macmillan Publishers, Ltd., United States, (1987).
Buus, S., et al. , "Autologous Peptides Constitutively Occupy the Antigen Binding Site on Ia," *Science 242*:1045-1047, American Association for the Advancement of Science, United States (1988).
Carreno, B., et al., "HLA-B37 and HLA-A2.1 molecules bind largely nonoverlapping sets of peptides," *Proc. Natl. Acad. Sci. USA 87*:3420-3424, National Academy Press, United States (1990).
Corr, M., et al., "Endogenous Peptides of a Soluble Major Histocompatibility Complex Class I Molecule, H-$2L^d_s$: Sequence Motif, Quantitative Binding, and Molecular Modeling of the Complex," *J. Exp. Med. 176*:1681-1692, Rockefeller University Press, United States (Dec. 1992).
Del Val, M., et al., "Efficient Processing of an Antigenic Sequence for Presentation by MHC Class I Molecules Depends on Its Neighboring Residues in the Protein," *Cell 66*:1145-1153, Cell Press, United States (1991).
Deres, K., et al. , "In vivo priming of virus-specific cytotoxic T lymphocytes with synthetic lipopeptide vaccine," *Nature 342*:561-564, Macmillan Publishers, Ltd., United States (1989).
DiBrino, M., et al., "HLA-A1 and HLA-A3 T Cell Epitopes Derived from Influenza Virus Proteins Predicted from Peptide Binding Motifs," *J. Immunol. 151*:5930-5935, The Association of Immunologists, United States (Dec. 1993).
DiBrino, M., et al., "Endogenous peptides bound to HLA-A3 possess a specific combination of anchor residues that permit identification of potential antigenic peptides," *Proc. Natl. Acad. Sci. USA 90*:1508-1512, National Academy Press, United States (Feb. 1993).
Ding, Y-H., et al., "Two Human T Cell Receptors Bind in a Similar Diagonal Mode to the HLA-A2/Tax Peptide Complex Using Different TCR Amino Acids," *Immunity 8*:403-11, Cell Press, United States (Apr. 1998).
Eisenlohr, L., et al., "Flanking Sequences Influence the Presentation of an Endogenously Synthesized Peptide to Cytotoxic T Lymphocytes," *J. Exp. Med. 175*:481-487, The Rockefeller University Press, United States (Feb. 1992).
Engelhard, V., "Structure of peptides associated with MHC Class I molecules," *Curr. Opin. Immunol. 6*:13-23, Current Biology, Ltd., United States (Feb. 1994).
Falk, K., et al. , "Allele-specific motifs revealed by sequencing of self-peptides eluted from MHC molecules," *Nature 351*:290-296, Macmillan Publishers, Ltd., United States (1991).
Falk, K., et al. , "*MHC peptide motif register*. Peptide motifs of HLA-B35 and -B37 molecules," *Immunogenetics 38*:161-162, Springer-Verlag, Germany (Apr. 1993).
Falk, K., et al. , "Allele-specific peptide ligand motifs of HLA-C molecules," *Proc. Natl. Acad. Sci. USA 90*:12005-12009, National Academy Press, United States (Dec. 1993).
Falk, K., et al. , "Pool sequencing of natural HLA-DR, DQ, and DP ligands reveals detailed peptide motifs, constraints of processing, and general rules," *Immunogenetics 39*:230-242, Springer-Verlag, Germany (Feb. 1994).
Falk, K., et al. , "Peptide motifs of HLA-A1, -A11, -A31, and -A33 molecules," *Immunogenetics 40*:238-241, Springer-Verlag, Germany (Jul. 1994).
Foon, K., "Biological Response Modifiers: The New Immunotherapy" *Cancer Res. 49*:1621-1639, American Association for Cancer Research (1989).
Geysen, H., et al., "Cognitive Features of Continuous Antigenic Determinants," *J. Mol. Recognit. 1*:32-41, Heyden & Sons, Ltd., United Kingdom (1988).
Guo, H-C., et al., "Different length peptides bind to HLA-Aw68 similarly at their ends but bulge out in the middle," *Nature 360*:364-366, Macmillan Publishers, Ltd., United States (Nov. 1992).
Henderson, R., et al., "HLA-A2.1-Associated Peptides from a Mutant Cell Line: A Second Pathway of Antigen Presentation," *Science 255*:1264-1266, American Association for the Advancement of Science, United States (Mar. 1992).
Hill, A., et al. , "Characterization of two Epstein-Barr virus epitopes restricted by HLA-B7," *Eur. J. Immunol. 25*:18-24, VCH Verlagsgesellschaft mbH, Germany (Jan. 1995).
Hunt, D., et al. , "Characterization of Peptides Bound to the Class I MHC Molecule HLA-A2.1 by Mass Spectrometry," *Science 255*:1261-1263, American Association for the Advancement of Science, United States (Mar. 1992).
Ishioka, G., et al., "Utilization of MHC Class I Transgenic Mice for Development of Minigene DNA Vaccines Encoding Multiple HLA-Restricted CTL Epitopes," *J. Immunol. 162*:3915-3925, The American Association of Immunologists, United States (Apr. 1999).
Jardetzky, T., et al., "Identification of self peptides bound to purified HLA-B27," *Nature 353*:326-329, Macmillan Publishers, Ltd., United Kingdom (1991).
Kannagi, M., et al., "Target Epitope in the Tax Protein of Human T-Cell Leukemia Virus Type I Recognized by Class I Major Histocompatibility Complex-Restricted Cells," *J. Virol. 66*:2928-2933, American Society for Microbiology, United States (May 1992).
Kast, W., et al., "Protection against lethal Sendai virus infection by in vivo priming of virus-specific cytotoxic T lymphocytes with a free synthetic peptide," *Proc. Natl. Acad. Sci. USA 88*:2283-2287, National Academy Press, United States (1991).
Kast, W., et al. , "Strict peptide length is not required for the induction of cytotoxic T lymphocyte-mediated antiviral protection by peptide vaccination," *Eur. J. Immunol. 23*:1189-1192, VCH Verlagsgesellschaft mbH, Germany (May 1993).
Krieger, J., et al., "Single amino acid changes in DF and antigen define residues critical for peptide-MHC binding, and T cell recognition," *J. Immunol. 146*:2331-2340, American Association of Immunologists, United States (1991).
Lipford, G., et al., "Primary in Vivo Responses to Ovalbumin. Probing the Predictive Value of the $K^b$ Binding Motif," *J. Immunol. 150*:1212-1222, The American Association of Immunologists, United States (Feb. 1993).

(56) References Cited

OTHER PUBLICATIONS

Maryanski, J., et al., "Synthetic peptides as antigens and competitors in recognition by H-2-restricted cytolytic T cells specific for HLA," *J. Exp. Med. 167*:1391-1405, Rockefeller University Press, United States, (1988).
Maryanski, J., et al., "Competitor Analogs for Defined T Cell Antigens: Peptides Incorporating a Putative Binding Motif and Polyproline or Polyglycine Spacers," *Cell 60*:63-72, Cell Press, United States (1990).
Morrison, J., et al., "Identification of the nonamer peptide from influenza A matrix protein and the role of pockets of HLA-A2 in its recognition by cytotoxic T lymphocytes," *Eur. J. Immunol. 22*:903-907, VCH Verlagsgesellschaft mbH, Germany (Apr. 1992).
Niedermann, G., et al., "The proteolytic fragments generated by vertebrate proteosomes: Structural relationships to major histocompatibility complex class I binding peptides," *Proc. Natl. Acad, Sci. USA 93*:8572-8577, National Academy Press, United States (Aug. 1996).
Ochoa-Garay, J., et al., "The ability of peptides to induce cytotoxic T cells in vitro does not strongly correlate with their affinity for the H-2$L^d$ molecule implications for vaccine design and immunotherapy," *Mol. Immunol. 34*:273-281, Elsevier Science, Ltd., United Kingdom (Feb. 1997).
Pamer, E., et al., "Precise prediction of a dominant class I MHC-restricted epitome of *Listeria monocytogenes," Nature 353*:852-855,Macmillan Publishers, Ltd., United Kingdom (1991).
Parham, P., et al. , "The Origins of HLA-A,B,C Polymorphism," *Immunol. Rev. 143*:141-180, Munksgaard, Denmark (Feb. 1995).
Parker, K., et al., "Peptide Binding to HLA-A2 and HLA-B27 Isolated from *Escherichia coli," J. Biol. Chem. 267*:5451-5459, American Society for Biochemistry and Molecular Biology, Inc., United States (Mar. 1992).
Parker, K., et al., "Sequence motifs important for peptide binding to the human MHC class I molecule, HLA-A2," *J. Immunol. 149*:3580-3587, American Association of Immunologists, United States (Dec. 1992).
Parker, K., et al., "Scheme for Ranking Potential HLA-A2 Binding Peptides Based on Independent Binding of Individual Peptide Side-Chains," *J. Immunol. 152*:163-175, The American Association of Immunologists, United States (Jan. 1994).
Rammensee, H., et al., "Peptides Naturally Presented by MHC Class I Molecules," *Annu. Rev. Immunol. 11*:213-244, Annual Reviews, Inc., United States (Jan. 1993).
Rammensee, H., et al., "MHC ligands and peptide motifs: first listing," *Immunogenetics 41*:178-228, Springer-Verlag, Germany (Feb. 1995).
Reddehase, M., et al., "A pentapeptide as minimal antigenic determinant for MHC class I-restricted T lymphocytes," *Nature 337* :651-653, Macmillan Publishers, Ltd., United Kingdom (1989).
Romero, P., et al. , "H-2$K^d$-restricted Antigenic Peptides Share a Simple Binding Motif," *J. Exp. Med. 174*:603-612, Rockefeller University Press, United States (1991).
Rothbard, J., "Major histocompatibility complex-peptide interactions," *Curr. Opin. Immunol. 2*:99-105, Current Biology, Ltd., United Kingdom (1989).
Rötzschke, O., et al., "Isolation and analysis of naturally processed viral peptides as recognized by cytotoxic T cells," *Nature 348*:252-254, Macmillan Publishers, Ltd., United Kingdom (1990).
Rötzschke, O., et al., "Characterization of Naturally Occurring Minor Histocompatibility Peptides Including H-4 and H-Y," *Science 249*:283-287, American Association for the Advancement of Science, United States (1990).
Rötzschke, O., et al., "Peptide motifs of closely related HLA class I molecules encompass substantial differences," *Eur. J. Immunol. 22*:2453-2456, VCH Verlagsgesellschaft mbH, Germany (Sep. 1992).
Rötzschke, O. and Falk, K., "Naturally-occurring peptide antigens derived from the MHC class-I-restricted processing pathway," *Immunol. Today 12*:447-455, Elsevier Science Publishers, Ltd., United States (1991).
Rötzschke, O., and Falk, K., "Origin, structure and motifs of naturally processed MHC class II ligands," *Curr. Opin. Immunol. 6*:45-51, Current Biology, Ltd., United Kingdom (Feb. 1994).
Rudinger, J., "Characteristics of the amino acids as components of a peptide hormone sequence," in *Peptide Hormones*, Parson, J.A., ed., University Park Press, Baltimore, MD, pp. 1-7 (1976).
Ruppert, J., et al., "Prominent Role of Secondary Anchor Residues in Peptide Binding to HLA-A2.1 Molecules," *Cell 74*:929-937, Cell Press, United States (Sep. 1993).
Schulz, M., et al., "Major histocompatibility complex binding and T cell recognition of a viral nonapeptide containing a minimal tetrapeptide," *Eur. J. Immunol. 21*:1181-1185, VCH Verlagsgesellschaft mbH, Germany (1991).
Sette, A., et al., "Prediction of major histocompatibility complex binding regions of protein antigens by sequence pattern analysis," *Proc. Natl. Acad. Sci. USA 86*:3296-3300, National Academy Press, United States (1989).
Sette, A., et al., "Random association between the peptide repertoire of A2.1 class I and several different DR class II molecules," *J. Immunol. 147*:3893-3900, The American Association of Immunologists, United States (1991).
Sette, A., et al., "The Relationship Between Class I Binding Affinity and Immunogenicity of Potential Cytotoxic T Cell Epitopes," *J. Immunol. 153*:5586-5592, The American Association of Immunologists, United States (Dec. 1994).
Shastri, N., et al., "Presentation of Endogenous Peptide/MHC Class I Complexes is Profoundly Influenced by Specific C-Terminal Flanking Residues," *J. Immunol. 155*: 4339-4346, The American Association of Immunologists, United States (Nov. 1995).
Sherman, L.A., et al., "Extracellular Processing of Peptide Antigens That Bind Class I Major Histocompatibility Molecules," *J. Exp. Med. 175*:1221-1226, The Rockefeller University Press, United States (May 1992).
Shimojo, N., et al. "Specificity of peptide binding by the HLA-A2.1 molecule," *J. Immunol. 143*:2939-2947, The American Association of Immunologists, United States (1989).
Sidney, J., et al. , "Several HLA Alleles Share Overlapping Peptide Specificities," *J. Immunol. 154*:247-259, The American Association of Immunologists, United States (Jan. 1995).
Threlkeld, S., et al., "Degenerate and Promiscuous Recognition by CTL of Peptides Presented by the MHC Class I A3-like Superfamily. Implications for Vaccine Development," *J. Immunol.* 159:1648-1657, The American Association of Immunologists, United States (Aug. 1997).
Wentworth, P., et al., "Differences and similarities in the A2.1-restricted cytotoxic T cell repertoire in humans and human leukocyte antigen-transgenic mice," *Eur. J. Immunol. 26*:97-101, VCH Verlagsgesellschaft mbH, Germany (Jan. 1996).
Whitton, J., et al., "Molecular Analyses of a Five-Amino-Acid Cytotoxic T-Lymphocyte (CTL) Epitope: an Immunodominant Region Which Induces Nonreciprocal CTL Cross-Reactivity," *J. Virol. 63*:4303-4310, American Society for Microbiology, United States (1989).
Yewdell, J. and Bennink, J., "Cell Biology of Antigen Processing and Presentation to Major Histocompatibility Complex Class I Molecule-Restricted T Lymphocytes," *Adv. Immunol. 52*:1-123, Academic Press, United States (Jul. 1992).
York, I. and Rock, K., "Antigen processing and presentation by the class I major histocompatibility complex," *Annu. Rev. Immunol. 14*:369-396, Annual Reviews, Inc., United States (Apr. 1996).
Zhang, Q., et al., "An HLA-A11-specific motif in nonamer peptide derived from viral and cellular proteins," *Proc. Natl. Acad. Sci. USA 90*:2217-2221, National Academy Press, United States (Mar. 1993).

* cited by examiner

Sacred Motif Tables

FIGURE 1

| Allele | Anchor residues of prototype allele | | | | | | Anchor residues of designated supertype | | | | | |
|---|---|---|---|---|---|---|---|---|---|---|---|---|
| | Canonical | | | Extended | | | Canonical | | | Extended | | |
| | p2 | p3 | C | p2 | p3 | C | p2 | p3 | C | p2 | p3 | C |
| **A1** (a) | TS | -- | Y | TSM | -- | Y | TI | -- | YWF | TILMVS | -- | YWF |
| A1 (b) | -- | DE | Y | -- | DEAS | Y | | | | | | |
| **A2** | LM | -- | VIL | LMIVATQ | -- | LMIVAT | LMIVATQ | -- | VILA | LMIVATQ | -- | LMIVAT |
| **A3** | LMV | -- | K | LMVISATFG | -- | KRYHFA | TVM | -- | KR | LMIVAST | -- | KR |
| A11 | VT | -- | K | LMVISATFG | -- | KRYH | | | | | | |
| **A24** | Y | -- | F | YFWM | -- | FLIW | YF | -- | FI | YFWIVLMT | -- | FIYWLM |
| **B7** | P | -- | MFLIV | P | -- | LIMVFWYA | P | -- | I | P | -- | LIMVFWYA |
| **B44** | E | -- | YF | ED | -- | LIMVFWYA | E | -- | YFLIM | ED | -- | YFLIMTAVW |

Bolded alleles denote nomenclature of specified supertype.

FIGURE 2

| HLA-supertype | Allele-specific HLA-supertype members | |
|---|---|---|
| | Verified[a] | Predicted[b] |
| A1 | A*0101, A*2501, A*2601, A*2602, A*2902, A*3002 | A*0102, A*2604, A*2901, A*3003, A*3601, A*4301, A*8001 |
| A2 | A*0201, A*0202, A*0203, A*0204, A*0205, A*0206, A*0207, A*0209, A*0214, A*6802, A*6901 | A*0208, A*0210, A*0211, A*0212, A*0213 |
| A3 | A*0301, A*1101, A*3101, A*3301, A*6801 | A*0302, A*1102, A*2603, A*3302, A*3303, A*3401, A*3402, A*6601, A*6602, A*7401 |
| A24 | A*2301, A*2402 (A*2902, A*3002) | A*2403, A*2404 |
| B7 | B*0702, B*0703, B*0704, B*0705, B*1508, B*3501, B*3502, B*3503, B*3504, B*3505, B*3506, B*3507, B*3508, B*4201, B*5101, B*5102, B*5103, B*5104, B*5105, B*5301, B*5401, B*5501, B*5502, B*5601, B*5602, B*6701, B*7801 | B*1511, B*5901 |
| B27 | B*1401, B*1402, B*1509, B*2702, B*2703, B*2704, B*2705, B*2706, B*3801, B*3901, B*3902, B*7301 | B*2701, B*2707, B*2708, B*3802, B*3903, B*3904, B*3905, B*4801, B*4802, B*1510, B*1518, B*1503 |
| B44 | B*1801, B*1802, B*3701, B*4402, B*4403, B*4404, B*4001, B*4002, B*4006, B*4501 | B*4101, B*4701, B*4901, B*5001 |
| B58 | B*5701, B*5702, B*5801, B*5802, B*1516, B*1517 | |
| B62 | B*1501, B*1502, B*1513, B*5201 | B*1301, B*1302, B*1504, B*1505, B*1506, B*1507, B*1515, B*1520, B*1521, B*1512, B*1514, B*1519 |
| Unclassified | A*3001, A*3201 | |

a. Verified alleles includes alleles whose specificity has been determined by pool sequencing analysis, peptide binding assays, or by analysis of the sequences of CTL epitopes.

b. Predicted alleles are alleles whose specificity is predicted on the basis of B and F pocket structure to overlap with the supertype specificity.

c. Alleles in parentheses are assigned to a different supertype, but have been noted to cross-react with appreciable frequency with the indicated supertype.

B7-like cross-reactive motif

| | 1 | 2 | 3 | 4 | 5 | 6 | 7 | 8 | 9 |
|---|---|---|---|---|---|---|---|---|---|
| + | YFW | | | STC | | | YFW | A<br>P | |
| − | A<br>DE<br>G<br>P | | | QN | | DE<br>G | QN<br>A<br>G | DE | |

Motif is comprised of all residues which are "+" or "-" for two or more alleles.

| | | | | | | | | | |
|---|---|---|---|---|---|---|---|---|---|
| ++ | RHK, YFW | | RHK | G | RHK | QN | STC | P, A | L, M |
| + | | | | | | | | | |
| | 1 | 2 | 3 | 4 | 5 | 6 | 7 | 8 | 9 |
| . | | | P | | A | P, DE | | | A |
| -- | DE, P | | DE | DE | DE, QN | G | QN | DE | Y, W |

B*3501

| | | | | | | | | | |
|---|---|---|---|---|---|---|---|---|---|
| ++ | YFW | | | | QN | | YFW | A | Y, F |
| + | | | | STC | | | | P | |
| | 1 | 2 | 3 | 4 | 5 | 6 | 7 | 8 | 9 |
| . | | | | | | | | | |
| -- | A, G, P | | | QN | | G | A, G, QN | DE | W |

B*5301

| | | | | | | | | | |
|---|---|---|---|---|---|---|---|---|---|
| ++ | YFW | | | STC | G | | YFW | | F, W |
| + | | | | A | | | | | |
| | 1 | 2 | 3 | 4 | 5 | 6 | 7 | 8 | 9 |
| . | | | | | | | | | |
| -- | A, G, QN, P | | | QN | | G | A, QN, P | DE | M |

B*5401

| | | | | | | | | | |
|---|---|---|---|---|---|---|---|---|---|
| ++ | YFW | | YFW, LIVM | | LIVM | STC | LIVM | A, YFW | A |
| + | | | | | | | | | |
| | 1 | 2 | 3 | 4 | 5 | 6 | 7 | 8 | 9 |
| . | | | G | | | | G | RHK | FY, M |
| -- | G, DE, P | | | P | RHK | G, DE | QN | DE | W |

FIGURE 4

| Residue | (n) | %Binding peptides | ARB |
|---|---|---|---|
| M | 319 | 34.5 | 0.73 |
| L | 1719 | 32.6 | 1.00 |
| I | 498 | 15.5 | 0.17 |
| Q | 44 | 13.6 | 0.076 |
| T | 381 | 8.9 | 0.075 |
| V | 622 | 8.4 | 0.084 |
| A | 455 | 5.3 | 0.052 |
| H | 1 | 0.0 | 0.28 |
| F | 8 | 0.0 | 0.12 |
| W | 3 | 0.0 | 0.068 |
| S | 5 | 0.0 | 0.052 |
| C | 6 | 0.0 | 0.044 |
| D | 3 | 0.0 | 0.043 |
| K | 6 | 0.0 | 0.038 |
| G | 2 | 0.0 | 0.030 |
| Y | 19 | 0.0 | 0.030 |
| P | 10 | 0.0 | 0.028 |
| R | 6 | 0.0 | 0.027 |
| E | 4 | 0.0 | 0.022 |
| N | 0 | | |
| Total | 4111 | 21.0 | |

| Residue | (n) | %Binding peptides | ARB |
|---|---|---|---|
| V | 1111 | 31.9 | 1.00 |
| S | 7 | 28.6 | 0.36 |
| L | 1154 | 20.1 | 0.34 |
| A | 597 | 19.6 | 0.28 |
| I | 642 | 18.8 | 0.35 |
| C | 8 | 12.5 | 0.27 |
| M | 142 | 10.6 | 0.13 |
| T | 294 | 7.1 | 0.11 |
| K | 64 | 1.6 | 0.038 |
| G | 8 | 0.0 | 0.072 |
| E | 2 | 0.0 | 0.064 |
| W | 2 | 0.0 | 0.064 |
| D | 4 | 0.0 | 0.054 |
| R | 24 | 0.0 | 0.049 |
| Y | 41 | 0.0 | 0.048 |
| N | 2 | 0.0 | 0.046 |
| F | 1 | 0.0 | 0.032 |
| H | 3 | 0.0 | 0.032 |
| P | 3 | 0.0 | 0.032 |
| Q | 2 | 0.0 | 0.032 |
| Total | 4111 | 21.0 | |

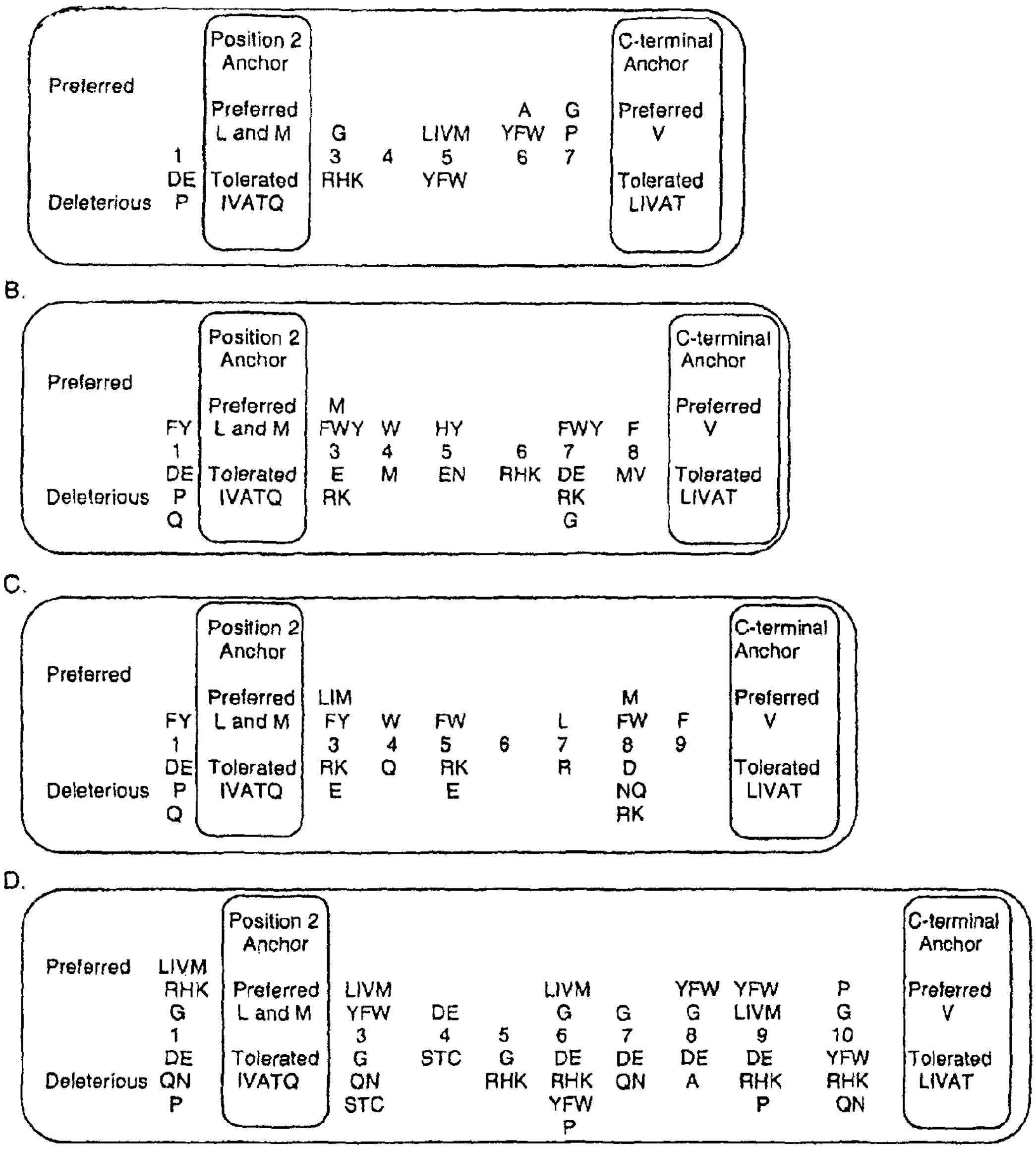
FIGURE 6A-D

**A*0202**

| Residue | (n) | ARB |
|---|---|---|
| Q | 5 | 1.00 |
| V | 28 | 0.29 |
| T | 24 | 0.18 |
| I | 45 | 0.17 |
| A | 15 | 0.16 |
| M | 46 | 0.14 |
| L | 247 | 0.081 |
| Total | 410 | |

**A*0203**

| Residue | (n) | ARB |
|---|---|---|
| L | 252 | 1.00 |
| M | 47 | 0.63 |
| Q | 5 | 0.51 |
| V | 28 | 0.10 |
| A | 15 | 0.077 |
| I | 44 | 0.070 |
| T | 25 | 0.045 |
| Total | 416 | |

A*0206

| Residue | (n) | ARB |
|---|---|---|
| Q | 5 | 1.00 |
| V | 28 | 0.53 |
| A | 15 | 0.52 |
| I | 44 | 0.49 |
| T | 24 | 0.47 |
| M | 46 | 0.18 |
| L | 248 | 0.061 |
| Total | 410 | |

A*6802

| Residue | (n) | ARB |
|---|---|---|
| V | 28 | 1.00 |
| T | 24 | 0.45 |
| A | 15 | 0.13 |
| I | 44 | 0.052 |
| M | 46 | 0.023 |
| L | 248 | 0.0078 |
| Q | 5 | 0.00073 |
| Total | 410 | |

A*0202

| Residue | (n) | ARB |
|---|---|---|
| I | 54 | 1.00 |
| V | 153 | 0.92 |
| L | 122 | 0.76 |
| A | 60 | 0.43 |
| M | 8 | 0.17 |
| T | 13 | 0.15 |
| Total | 410 | |

A*0203

| Residue | (n) | ARB |
|---|---|---|
| V | 156 | 1.00 |
| I | 54 | 0.56 |
| T | 13 | 0.26 |
| A | 61 | 0.17 |
| M | 8 | 0.17 |
| L | 124 | 0.14 |
| Total | 416 | |

**A*0206**

| Residue | (n) | ARB |
|---|---|---|
| V | 153 | 1.00 |
| I | 53 | 0.54 |
| L | 122 | 0.23 |
| A | 61 | 0.16 |
| T | 13 | 0.11 |
| M | 8 | 0.071 |
| Total | 410 | |

A*6802

| Residue | (n) | ARB |
|---|---|---|
| V | 153 | 1.00 |
| I | 53 | 0.80 |
| L | 122 | 0.32 |
| A | 61 | 0.15 |
| M | 8 | 0.093 |
| T | 13 | 0.062 |
| Total | 410 | |

a.
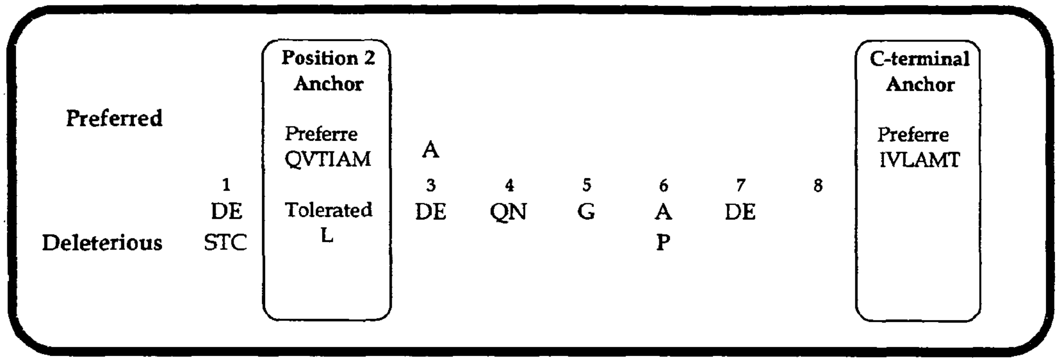
b.
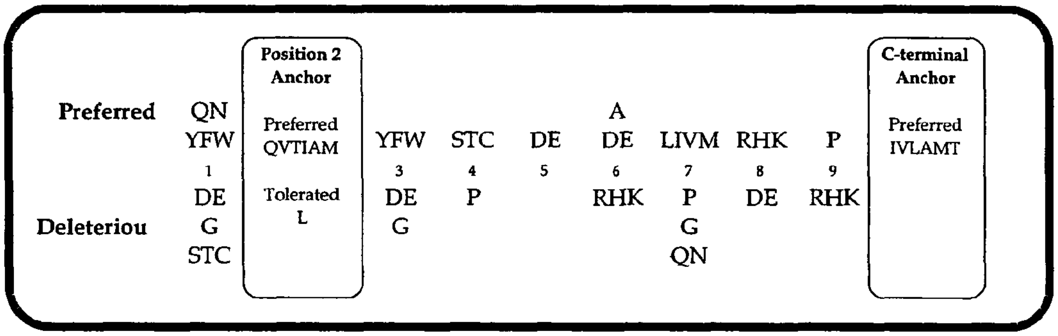
FIGURE 9 a.
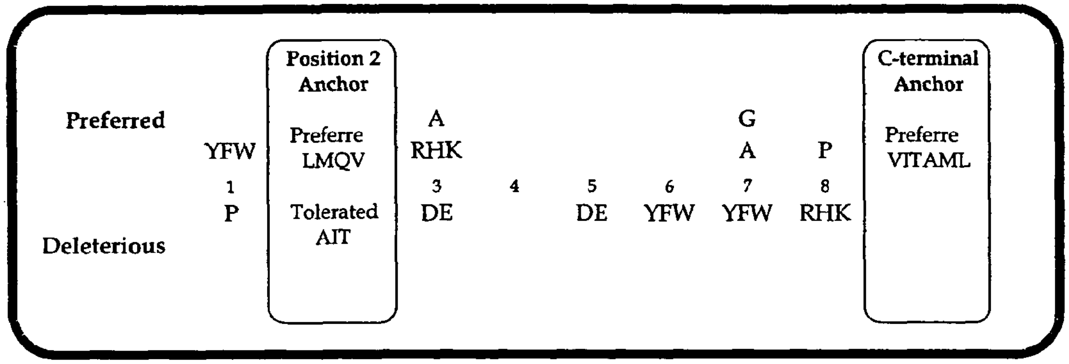
b.
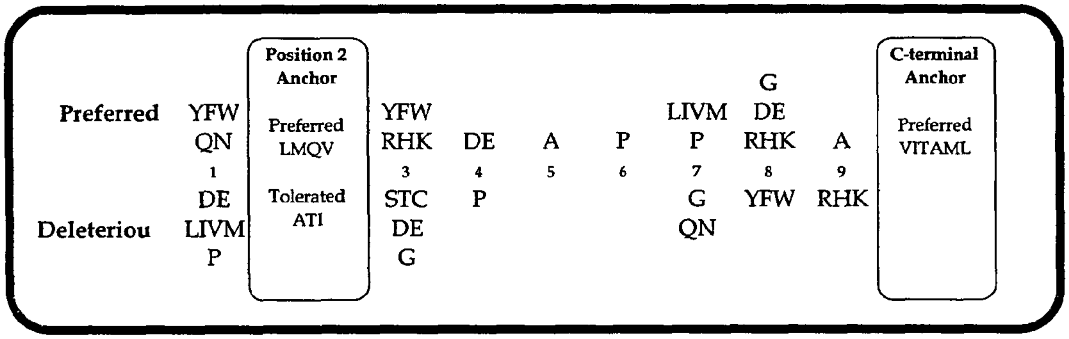
FIGURE 10 a.
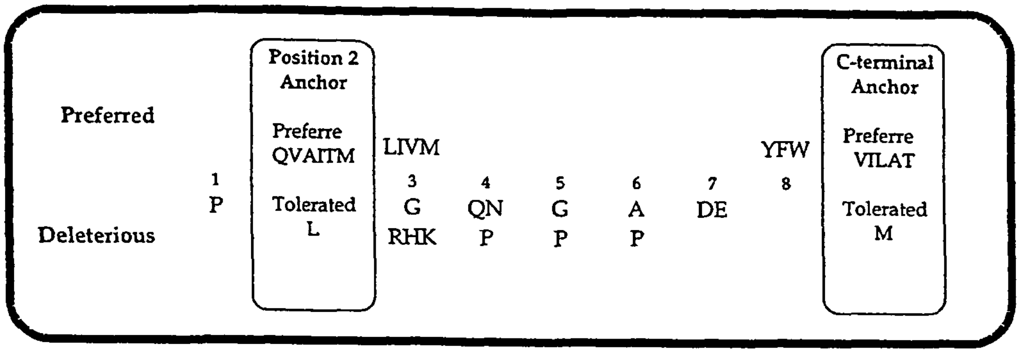
b.
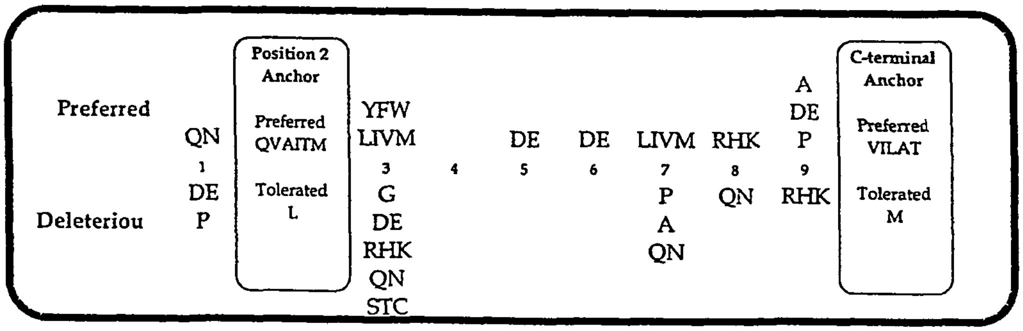
FIGURE 11

Peptides from HLA A3
RP-HPLC separation of HLA-A3 acid eluted peptides

Titer of 944.02 against A1.

A1 inhibition titration.

A24 titration.

A24 Inhibition.

FIGURE 30
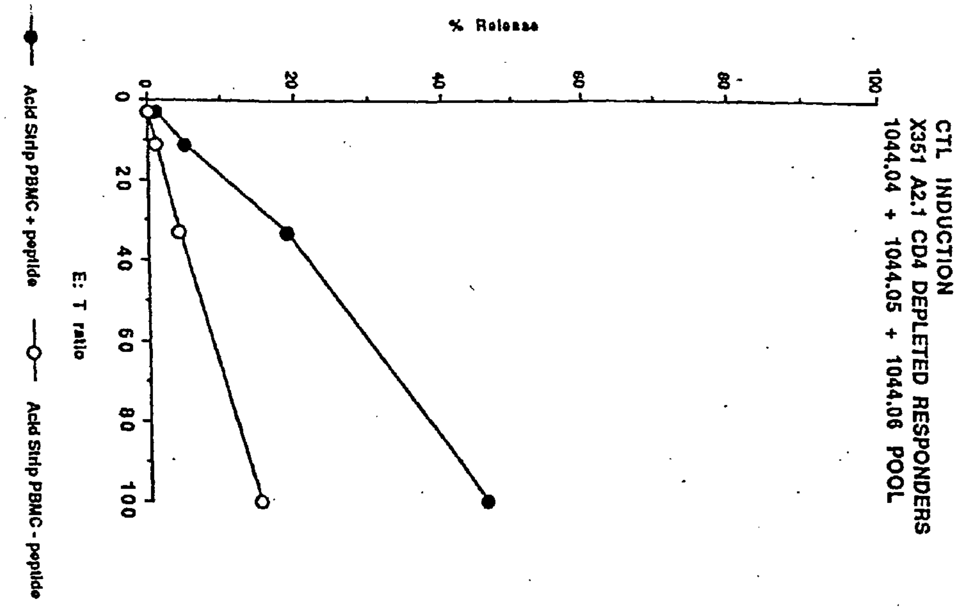
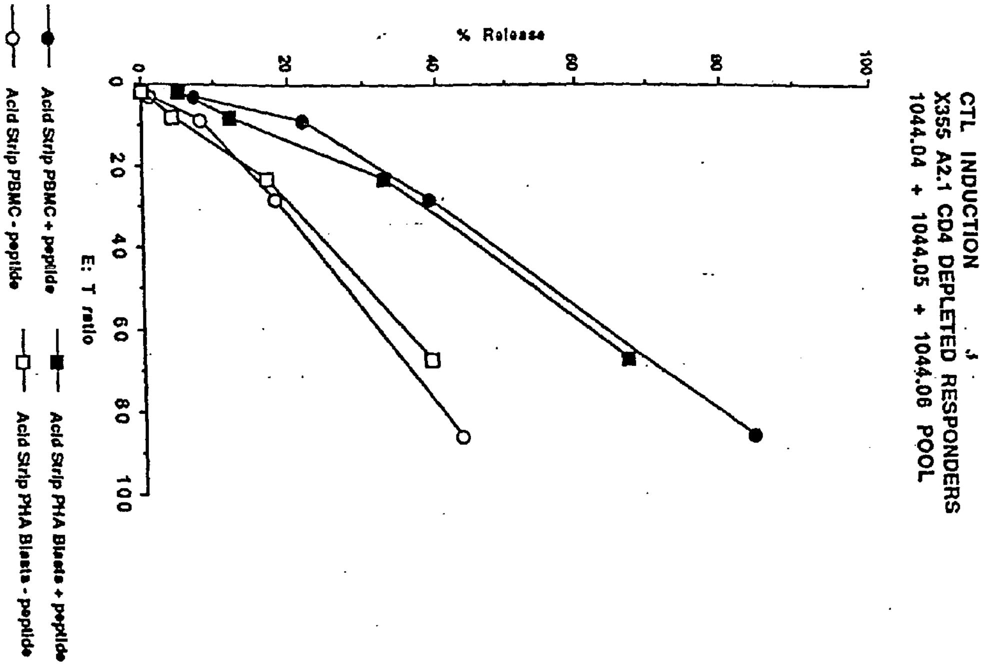

MAGE1 Peptide Specific, HLA-A1-Restricted CTL Can Kill Melanoma Cells Expressing the Endogenous Antigen Cytotoxic Activity of an HLA-A1-Restricted CTL Line Specific for a MAGE3 Peptide (1044.07)

Induction Using Different Methods to Load Peptides onto SAC-I Cells.

FIGURE 35
Peptide Screening:
MAGE/A11
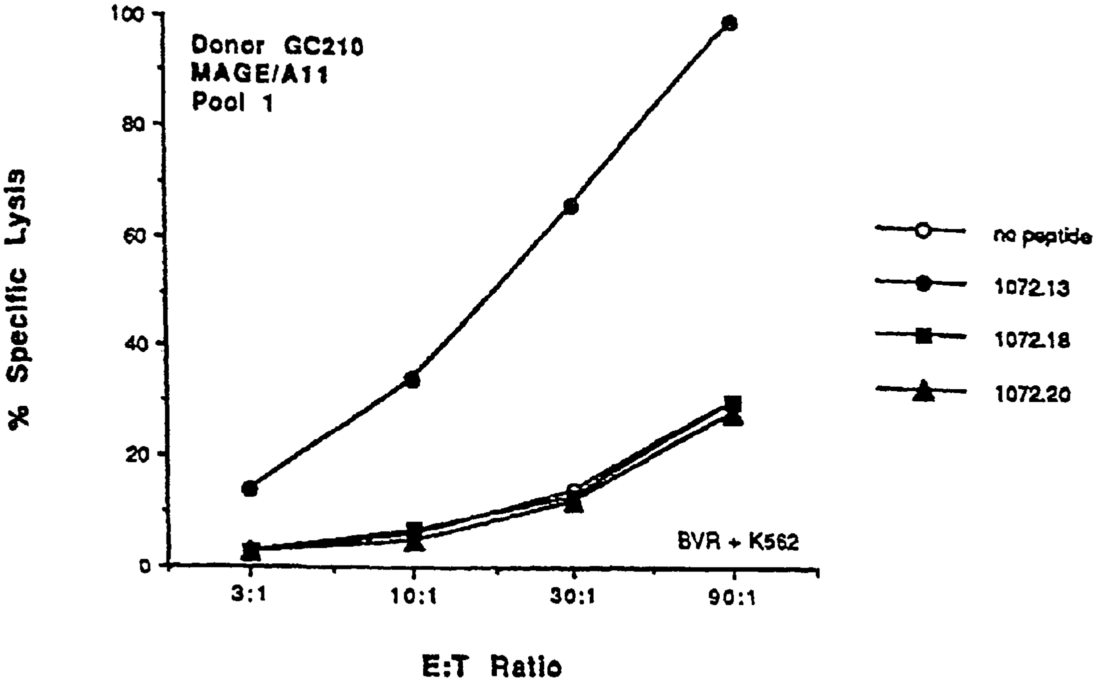
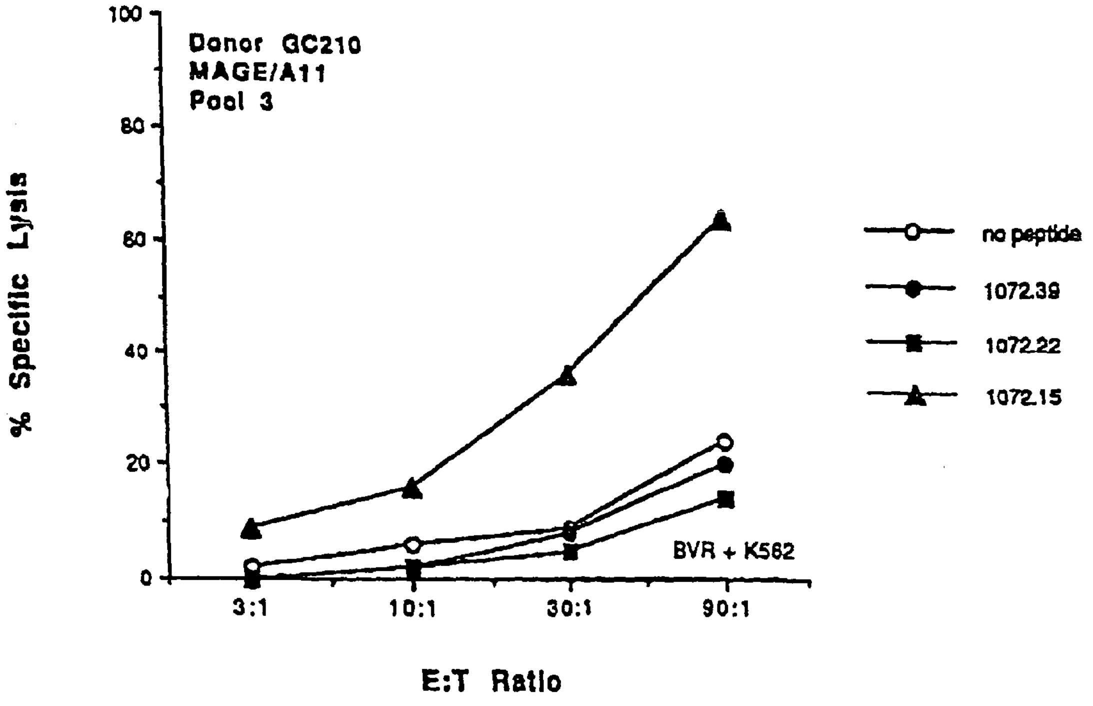

Individual motifs of the A3-like alleles

| | | POSITION 2 ANCHOR | | | | | | | | C-TERMINAL ANCHOR |
|---|---|---|---|---|---|---|---|---|---|---|
| A3 | preferred | RHK | A L I V | | | P RHK YFW | A | YFW | P | R K |
| | | 1 | | 3 | 4 | 5 | 6 | 7 | 8 | |
| | deleterious | DE P | M S T | | DE | | | | | |

| | | POSITION 2 ANCHOR | | | | | | | | C-TERMINAL ANCHOR |
|---|---|---|---|---|---|---|---|---|---|---|
| A11 | preferred | A | A L I V | | YFW | YFW | A | YFW | YFW P | R K |
| | | 1 | | 3 | 4 | 5 | 6 | 7 | 8 | |
| | deleterious | DE P | M S T | | | | | | A G | |

| | | POSITION 2 ANCHOR | | | | | | | | C-TERMINAL ANCHOR |
|---|---|---|---|---|---|---|---|---|---|---|
| A*3101 | preferred | RHK | A L I V | | YFW | P | | YFW | YFW | A P | R K |
| | | 1 | | 3 | 4 | 5 | 6 | 7 | 8 | |
| | deleterious | DE P | M S T | | DE | A DE | | DE | DE | DE | |

| | | POSITION 2 ANCHOR | | | | | | | | C-TERMINAL ANCHOR |
|---|---|---|---|---|---|---|---|---|---|---|
| A*3301 | preferred | | A L I V | | YFW | | | | A YFW | R K |
| | | 1 | | 3 | 4 | 5 | 6 | 7 | 8 | |
| | deleterious | G P | M S T | | DE | | | | | |

| | | POSITION 2 ANCHOR | | | | | | | | C-TERMINAL ANCHOR |
|---|---|---|---|---|---|---|---|---|---|---|
| A*6801 | preferred | YFW STC | A L I V | | | | YFW LIVM | | YFW | P | R K |
| | | 1 | | 3 | 4 | 5 | 6 | 7 | 8 | |
| | deleterious | G P | M S T | | DE G | RHK | | | A | |

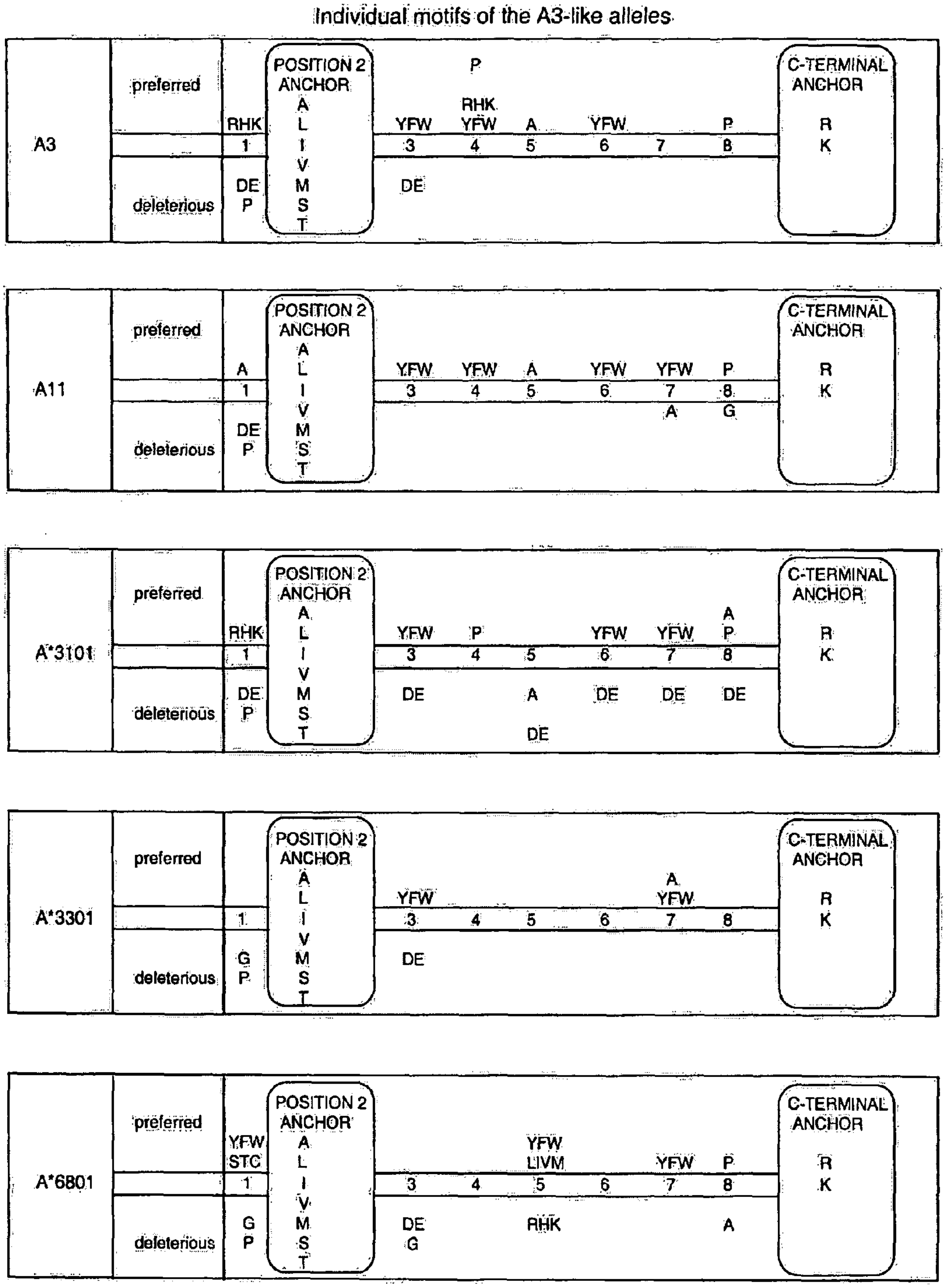

FIGURE 43

| A24 secondary anchor motif: 9-mer peptides | | 1 | 2 | 3 | 4 | 5 | 6 | 7 | 8 | C-terminal |
|---|---|---|---|---|---|---|---|---|---|---|
| | preferred | YFW RHK | POSITION 2 ANCHOR Y F W M | | STC | | | YFW | YFW | C-TERMINAL ANCHOR R K |
| | deleterious | DE G | | DE | G | QN P | DE RHK | G | A QN | |

| A24 secondary anchor motif: 10-mer peptides | | 1 | 2 | 3 | 4 | 5 | 6 | 7 | 8 | 9 | C-terminal |
|---|---|---|---|---|---|---|---|---|---|---|---|
| | preferred | | POSITION 2 ANCHOR Y F W M | | P | YFW P | | P | | | C-TERMINAL ANCHOR R K |
| | deleterious | | | G DE | QN | RHK | DE | A | QN | A DE | |

FIGURE 44

| | | Position | | | | | | | |
|---|---|---|---|---|---|---|---|---|---|
| A3-like Supermotif | | 1 | POSITION 2 ANCHOR<br>A<br>L<br>I<br>V<br>M<br>S<br>T | 3 | 4 | 5 | 6 | 7 | 8 | C-TERMINAL ANCHOR<br>R<br>K |
| preferred | | | | YFW(4) | | | YFW(3) | YFW(4) | P(4) | |
| deleterious | | DE(3)<br>P(5) | | DE(4) | | | | | | |

a)

| B*0702 | preferred | POSITION 2 ANCHOR | | | | | | | C-TERMINAL ANCHOR |
|---|---|---|---|---|---|---|---|---|---|
| | | RHK FWY | | RHK | | RHK | RHK | RHK | P A | A L I V M F W Y |
| | | 1 | P | 3 | 4 | 5 | 6 | 7 | 8 | |
| | deleterious | DE QN P | | DE P | DE | DE | G DE | QN | DE | |

b)

| B*3501 | preferred | POSITION 2 ANCHOR | | | | | | | C-TERMINAL ANCHOR |
|---|---|---|---|---|---|---|---|---|---|
| | | FWY | | FWY | | | | FWY | | A L I V M F W Y |
| | | 1 | P | 3 | 4 | 5 | 6 | 7 | 8 | |
| | deleterious | A G P | | | | G | G | | | |

c)

| B51 | preferred | POSITION 2 ANCHOR | | | | | | | C-TERMINAL ANCHOR |
|---|---|---|---|---|---|---|---|---|---|
| | | LIVM FWY | | FWY | STC | FWY | | G | FWY | A L I V M F W Y |
| | | 1 | P | 3 | 4 | 5 | 6 | 7 | 8 | |
| | deleterious | AGPDE RHK STC | | | | DE | G | DE QN | G DE | |

d)

| B*5301 | preferred | POSITION 2 ANCHOR | | | | | | | C-TERMINAL ANCHOR |
|---|---|---|---|---|---|---|---|---|---|
| | | LIVM FWY | | FWY | STC | FWY | | LIVM FWY | FWY | A L I V M F W Y |
| | | 1 | P | 3 | 4 | 5 | 6 | 7 | 8 | |
| | deleterious | A GP QN | | | | | G | RHK QN | DE | |

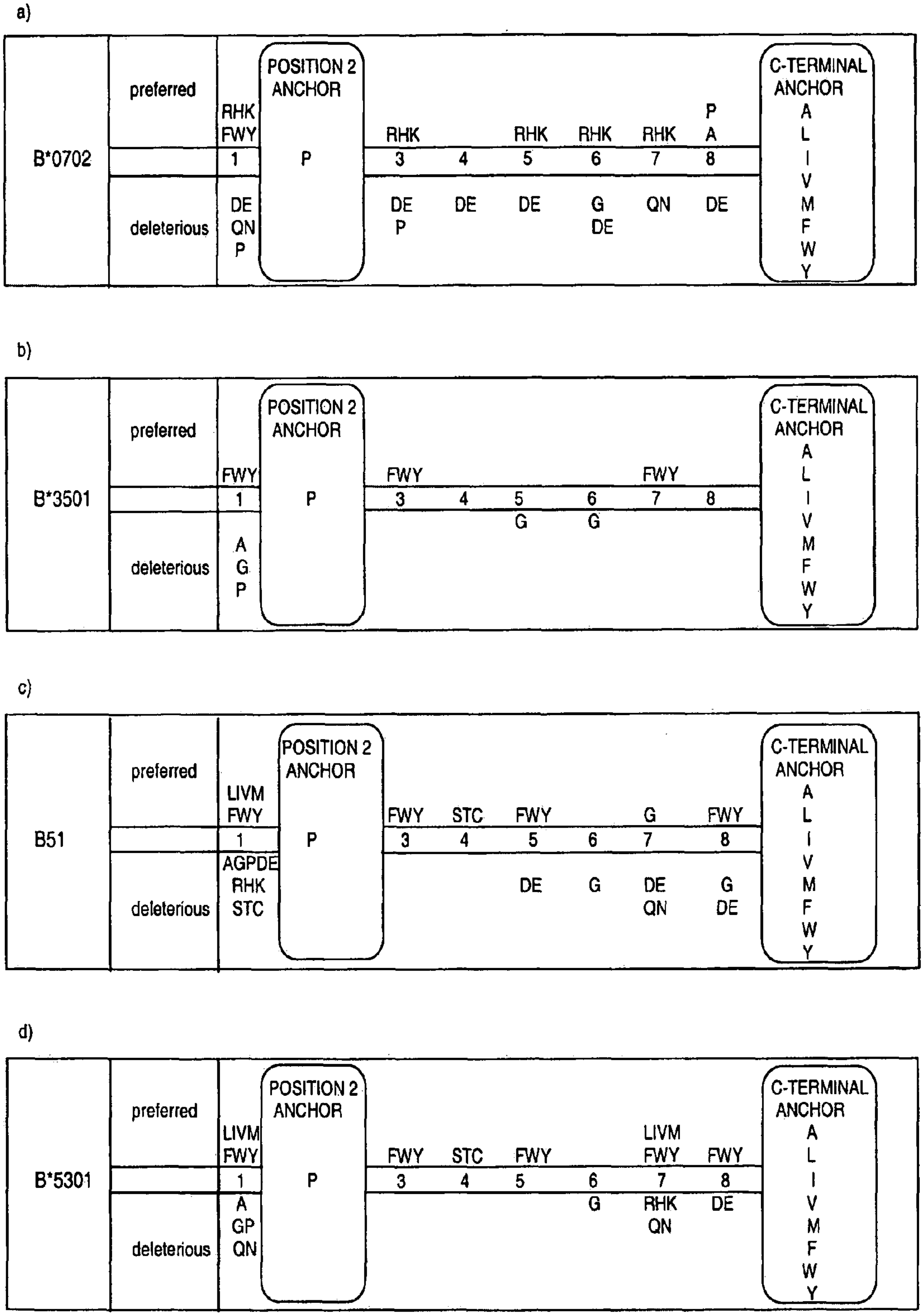

FIGURE 46A e)

| | | 1 | | 3 | 4 | 5 | 6 | 7 | | 8 | |
|---|---|---|---|---|---|---|---|---|---|---|---|
| preferred | | FWY | POSITION 2 ANCHOR | FWY LIVM | | LIVM | | A LIVM | FWY A P | | C-TERMINAL ANCHOR |
| | | | P | | | | DE | | | | A L I V M F W Y |
| B*5401 | deleterious | GP QN DE | | G DE STC | | DE RHK | DE | QN G DE | | DE | |

f)

| | | 1 | | 3 | 4 | 5 | 6 | 7 | 8 | |
|---|---|---|---|---|---|---|---|---|---|---|
| preferred | | FWY(5) | POSITION 2 ANCHOR | FWY(4) | | DE(3) | G(4) | QN(4) | FWY(3) | C-TERMINAL ANCHOR |
| | | | P | | | | | | | A L I V M F W Y |
| B7-like Supermotif | deleterious | P(5)DE(3) G(4)A(3) QN(3) | | | | | | | DE(4) | |

a)

HLA A1 average relative binding capacity: 9-mer peptides

Anchors: position 2 and C-terminus

| Group | 1 | 2 | 3 | 4 | 5 | 6 | 7 | 8 | 9 |
|---|---|---|---|---|---|---|---|---|---|
| A | 1.1 | Position 2 Anchor<br>S<br>T<br>(M) | 4.5 | *0.09* | 0.64 | *0.19* | 0.30 | 0.27 | C-terminal anchor<br>Y |
| G | 8.4 | | 0.69 | 0.84 | *0.10* | 1.4 | 0.31 | 0.55 | |
| DE | *0.20* | | 33 | 0.36 | 0.35 | 0.37 | 12 | 0.97 | |
| RHK | 0.78 | | *0.13* | 1.1 | 1.5 | 0.33 | 0.32 | 0.83 | |
| LIVM | 0.50 | | *0.17* | 0.97 | 2.2 | 1.7 | 1.2 | 1.7 | |
| YFW | 4.0 | | 1.8 | 4.5 | 2.6 | 3.4 | 2.4 | 6.2 | |
| QN | 1.3 | | 1.8 | 0.51 | 1.9 | 1.0 | 7.7 | 0.79 | |
| STC | 1.4 | | 2.4 | 2.6 | 1.0 | 2.0 | 0.74 | 0.97 | |
| P | 0.60 | | *0.17* | 1.2 | 0.57 | 2.2 | 0.27 | 0.87 | |

b)

HLA A1 average relative binding capacity: 9-mer peptides

Anchors: position 3 and C-terminus

| Group | 1 | 2 | 3 | 4 | 5 | 6 | 7 | 8 | 9 |
|---|---|---|---|---|---|---|---|---|---|
| A | *0.15* | 34 | Position 3 Anchor<br>D<br>E | 0.58 | 1.5 | 421 | 2.3 | 0.34 | C-terminal anchor<br>Y |
| G | 27 | 0.63 | | 63 | 3.2 | 0.49 | *0.16* | *0.052* | |
| DE | 1.3 | *0.033* | | *0.035* | 0.38 | 0.37 | 2.5 | 4.0 | |
| RHK | 8.3 | *0.029* | | 0.58 | 0.48 | *0.20* | 0.58 | 0.95 | |
| LIVM | 0.72 | 16 | | 2.1 | 1.7 | 0.92 | 5.4 | 2.3 | |
| YFW | 0.61 | *0.035* | | 0.75 | 1.1 | 1.8 | 1.3 | 0.41 | |
| QN | 0.27 | 0.43 | | 0.47 | *0.16* | 1.4 | 1.4 | 2.4 | |
| STC | 0.71 | 30 | | 4.7 | 3.8 | 11 | 0.80 | 1.9 | |
| P | 3.1 | *0.047* | | 0.91 | *0.032* | 0.76 | *0.052* | *0.073* | |

c)

HLA A1 secondary anchor motif: 9-mer peptides

Anchors: position 2 and C-terminus

| | 1 | 2 | 3 | 4 | 5 | 6 | 7 | 8 | 9 |
|---|---|---|---|---|---|---|---|---|---|
| preferred | G<br>YFW | Position 2 Anchor<br>S<br>T<br>(M) | DE<br>A | YFW | | P | DE<br>QN | YFW | C-terminal anchor<br>Y |
| deleterious | DE | | RHK<br>LIVM<br>P | A | G | A | | | |

d)

HLA A1 secondary anchor motif: 9-mer peptides

Anchors: position 3 and C-terminus

| | 1 | 2 | 3 | 4 | 5 | 6 | 7 | 8 | 9 |
|---|---|---|---|---|---|---|---|---|---|
| preferred | G<br>RHK | A<br>STC<br>LIVM | Position 3 Anchor<br>D<br>E | G<br>STC | | A<br>STC | LIVM | DE | C-terminal anchor<br>Y |
| deleterious | A | RHK<br>DE P<br>YFW | | DE | P<br>QN | RHK | P<br>G | G<br>P | |

FIGURE 47 a)

HLA A1 average relative binding capacity: 10-mer peptides

Anchors: position 2 and C-terminus

| Group | 1 | 2 | 3 | 4 | 5 | 6 | 7 | 8 | 9 | 10 |
|---|---|---|---|---|---|---|---|---|---|---|
| | Position | | | | | | | | | |
| A | 2.7 | Position 2 Anchor S T (M) | 8.5 | 15 | 2.3 | *0.23* | 6.8 | 0.78 | *0.058* | C-terminal anchor Y |
| G | *0.24* | | *0.16* | 0.31 | 0.67 | 1.8 | 0.65 | 14 | 0.87 | |
| DE | 0.42 | | 56 | *0.22* | 0.28 | 2.1 | 0.46 | 6.2 | 0.86 | |
| RHK | 0.61 | | *0.080* | 0.49 | *0.19* | 1.8 | *0.13* | *0.077* | 0.99 | |
| LIVM | 2.1 | | *0.15* | 0.39 | 0.75 | 1.1 | 0.66 | 2.3 | 1.5 | |
| YFW | 10 | | 0.94 | 0.26 | 5.5 | 1.4 | *0.13* | 2.5 | 2.0 | |
| QN | 0.94 | | 4.4 | 3.3 | 4.5 | *0.13* | 2.2 | 0.70 | 1.2 | |
| STC | 1.2 | | 0.71 | 2.8 | 0.83 | 1.0 | 4.5 | 1.1 | 0.71 | |
| P | *0.21* | | 2.2 | 0.77 | 0.72 | 0.89 | 18 | 1.1 | 4.3 | |

b)

HLA A1 average relative binding capacity: 10-mer peptides

Anchors: position 3 and C-terminus

| Group | 1 | 2 | 3 | 4 | 5 | 6 | 7 | 8 | 9 | 10 |
|---|---|---|---|---|---|---|---|---|---|---|
| | Position | | | | | | | | | |
| A | 0.67 | 0.80 | Position 3 Anchor D E | 11 | 0.67 | 1.5 | 1.7 | 0.67 | 0.26 | C-terminal anchor Y |
| G | 0.27 | *0.33* | | 2.7 | 3.2 | *0.093* | 7.1 | 6.5 | 1.0 | |
| DE | 1.4 | *0.048* | | 0.40 | 1.4 | 0.50 | 0.34 | 1.0 | 1.0 | |
| RHK | *0.14* | 0.046 | | 0.52 | 0.63 | 0.98 | 0.40 | *0.20* | 0.66 | |
| LIVM | 2.2 | 48 | | 1.0 | 1.7 | 1.2 | 1.0 | 0.76 | 1.0 | |
| YFW | 13 | *0.046* | | 0.59 | 7.5 | 3.6 | 3.4 | 2.8 | 19 | |
| QN | 0.65 | 0.76 | | 1.7 | 0.48 | 0.57 | 1.9 | 1.4 | *0.25* | |
| STC | 0.52 | 90 | | 0.84 | 0.44 | 2.1 | 0.84 | 0.78 | 0.72 | |
| P | 0.53 | *0.076* | | 1.3 | *0.098* | 3.1 | 15 | *0.15* | 1.9 | |

c)

HLA A1 secondary anchor motif: 10-mer peptides

Anchors: position 2 and C-terminus

| | 1 | 2 | 3 | 4 | 5 | 6 | 7 | 8 | 9 | 10 |
|---|---|---|---|---|---|---|---|---|---|---|
| preferred | YFW | Position 2 Anchor S T (M) | DE A QN | A | YFW QN | | P A STC | G DE | P | C-terminal anchor Y |
| deleterious | G P | | RHK G LIVM | DE | RHK | QN A | RHK YFW | RHK | A | |

d)

HLA A1 secondary anchor motif: 10-mer peptides

Anchors: position 3 and C-terminus

| | 1 | 2 | 3 | 4 | 5 | 6 | 7 | 8 | 9 | 10 |
|---|---|---|---|---|---|---|---|---|---|---|
| preferred | YFW | STC LIVM | Position 3 Anchor D E | A | YFW | | P G | G | YFW | C-terminal anchor Y |
| deleterious | RHK | RHK DE P YFW | | | P | G | | P RHK | QN | |

Figure 49:
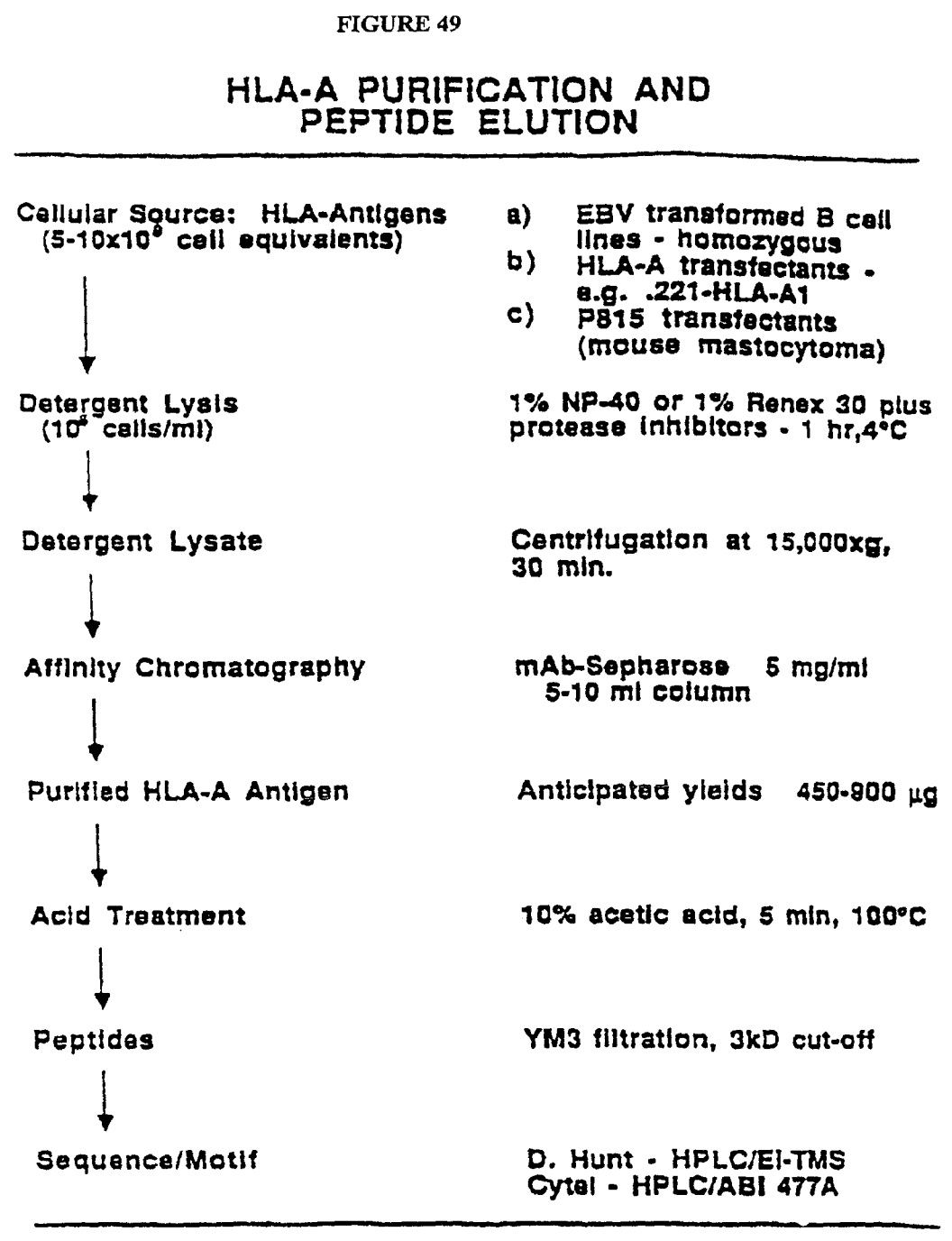

HLA-A PURIFICATION AND PEPTIDE ELUTION

| | |
|---|---|
| Cellular Source: HLA-Antigens ($5-10x10^9$ cell equivalents) | a) EBV transformed B cell lines - homozygous<br>b) HLA-A transfectants - e.g. .221-HLA-A1<br>c) P815 transfectants (mouse mastocytoma) |
| ↓ | |
| Detergent Lysis ($10^8$ cells/ml) | 1% NP-40 or 1% Renex 30 plus protease inhibitors - 1 hr,4°C |
| ↓ | |
| Detergent Lysate | Centrifugation at 15,000xg, 30 min. |
| ↓ | |
| Affinity Chromatography | mAb-Sepharose 5 mg/ml 5-10 ml column |
| ↓ | |
| Purified HLA-A Antigen | Anticipated yields 450-900 μg |
| ↓ | |
| Acid Treatment | 10% acetic acid, 5 min, 100°C |
| ↓ | |
| Peptides | YM3 filtration, 3kD cut-off |
| ↓ | |
| Sequence/Motif | D. Hunt - HPLC/EI-TMS<br>Cytel - HPLC/ABI 477A |

HLA BINDING MOTIFS AND PEPTIDES AND THEIR USES

CROSS-REFERENCE TO RELATED APPLICATIONS

The present application is a continuation-in-part of U.S. application Ser. No. 08/821,739, filed Mar. 20, 1997, abandoned; which claims the benefit of U.S. Provisional Appl. No. 60/013,833, filed Mar. 21, 1996; said U.S. application Ser. No. 08/821,739, filed Mar. 20, 1997, abandoned, is also a continuation-in-part of U.S. application Ser. No. 08/589,107, filed Jan. 23, 1996, abandoned; said U.S. application Ser. No. 08/821,739, filed Mar. 20, 1997, abandoned, is also a continuation-in-part of U.S. application Ser. No. 08/451,913, filed May 26, 1995, abandoned; said U.S. application Ser. No. 08/821,739, filed Mar. 20, 1997, abandoned, is also a continuation-in-part of U.S. application Ser. No. 08/186,266, filed Jan. 25, 1994, now U.S. Pat. No. 5,662,907; which is a continuation-in-part of U.S. application Ser. No. 08/159,339, filed Nov. 29, 1993, now U.S. Pat. No. 6,037,135; which is a continuation-in-part of U.S. application Ser. No. 08/103,396, filed Aug. 6, 1993, abandoned; which is a continuation-in-part of U.S. application Ser. No. 08/027,746, filed Mar. 5, 1993, abandoned; which is a continuation-in-part of U.S. application Ser. No. 07/926,666, filed Aug. 7, 1992, abandoned; said U.S. application Ser. No. 08/821,739, filed Mar. 20, 1997, abandoned, is also a continuation-in-part of U.S. application Ser. No. 08/347,610, filed Dec. 1, 1994, abandoned; which is a continuation-in-part of U.S. application Ser. No. 08/159,339, filed Nov. 29, 1993, now U.S. Pat. No. 6,037,135; which is a continuation-in-part of U.S. application Ser. No. 08/103,396, filed Aug. 6, 1993, abandoned; which is a continuation-in-part of U.S. application Ser. No. 08/027,746, filed Mar. 5, 1993, abandoned; which is a continuation-in-part of U.S. application Ser. No. 07/926,666, filed Aug. 7, 1992, abandoned; the present application is also a continuation-in-part of U.S. application Ser. No. 09/665,510, filed Sep. 19, 2000, abandoned; which is a continuation-in-part of U.S. application Ser. No. 08/347,610, filed Dec. 1, 1994, abandoned; which is a continuation-in-part of U.S. application Ser. No. 08/159,339, filed Nov. 29, 1993, now U.S. Pat. No. 6,037,135; which is a continuation-in-part of U.S. application Ser. No. 08/103,396, filed Aug. 6, 1993, abandoned; which is a continuation-in-part of U.S. application Ser. No. 08/027,746, filed Mar. 5, 1993, abandoned; which is a continuation-in-part of U.S. application Ser. No. 07/926,666, filed Aug. 7, 1992, abandoned; the present application is also a continuation-in-part of U.S. application Ser. No. 09/017,524, filed Feb. 3, 1998, abandoned; which is a continuation-in-part of U.S. application Ser. No. 08/589,107, filed Jan. 23, 1996, abandoned; said U.S. application Ser. No. 09/017,524, filed Feb. 3, 1998, abandoned, is also a continuation-in-part of U.S. application Ser. No. 08/758,409, filed Nov. 27, 1996, abandoned; said Ser. No. 09/017,524 application, filed Feb. 3, 1998, abandoned, is also a continuation-in-part of U.S. application Ser. No. 08/821,739, filed Mar. 20, 1997, abandoned, which claims the benefit of U.S. Provisional Appl. No. 60/013,833, filed Mar. 21, 1996, abandoned; said U.S. application Ser. No. 08/821,739, filed Mar. 20, 1997, abandoned, is also a continuation-in-part of U.S. application Ser. No. 08/589,107, filed Jan. 23, 1996, abandoned; said U.S. application Ser. No. 08/821,739, filed Mar. 20, 1997, abandoned, is also a continuation-in-part of U.S. application Ser. No. 08/451,913, filed May 26, 1995, abandoned; said U.S. application Ser. No. 08/821,739, filed Mar. 20, 1997, abandoned, is also a continuation-in-part of U.S. application Ser. No. 08/347,610, filed Dec. 1, 1994, abandoned; which is a continuation-in-part of U.S. application Ser. No. 08/159,339, filed Nov. 29, 1993, now U.S. Pat. No. 6,037,135; which is a continuation-in-part of U.S. application Ser. No. 08/103,396, filed Aug. 6, 1993, abandoned; which is a continuation-in-part of U.S. application Ser. No. 08/027,746, filed Mar. 5, 1993, abandoned; which is a continuation-in-part of U.S. application Ser. No. 07/926,666, filed Aug. 7, 1992, abandoned; said U.S. application Ser. No. 08/821,739, filed Mar. 20, 1997, abandoned, is also is a continuation-in-part of U.S. application Ser. No. 08/186,266, filed Jan. 25, 1994, now U.S. Pat. No. 5,662,907; which is a continuation-in-part of U.S. application Ser. No. 08/159,339, filed Nov. 29, 1993, now U.S. Pat. No. 6,037,135; which is a continuation-in-part of U.S. application Ser. No. 08/103,396, filed Aug. 6, 1993, abandoned; which is a continuation-in-part of U.S. application Ser. No. 08/027,746, filed Mar. 5, 1993, abandoned; which is a continuation-in-part of U.S. application Ser. No. 07/926,666, filed Aug. 7, 1992, abandoned; the present application is also a continuation-in-part of U.S. application Ser. No. 09/017,735, filed Feb. 3, 1998, abandoned; which is a continuation-in-part of U.S. application Ser. No. 08/205,713, filed Mar. 4, 1994, abandoned; which is a continuation-in-part of U.S. application Ser. No. 08/159,184, filed Nov. 29, 1993, abandoned; which is a continuation-in-part of U.S. application Ser. No. 08/073,205, filed Jun. 4, 1993, abandoned; which is a continuation-in-part of U.S. application Ser. No. 08/027,146, filed Mar. 5, 1993, abandoned; said U.S. application Ser. No. 09/017,735, filed Feb. 3, 1998, abandoned, is also a continuation-in-part of U.S. application Ser. No. 08/589,108, filed Jan. 23, 1996, abandoned; said U.S. application Ser. No. 09/017,735, filed Feb. 3, 1998, abandoned, is also a continuation-in-part of U.S. application Ser. No. 08/454,033, filed May 26, 1995, abandoned; said U.S. application Ser. No. 09/017,735, filed Feb. 3, 1998, abandoned, is also a continuation-in-part of U.S. application Ser. No. 08/349,177, filed Dec. 2, 1994, abandoned; which is a continuation-in-part of U.S. application Ser. No. 08/159,184, filed Nov. 29, 1993, abandoned; which is a continuation-in-part of U.S. application Ser. No. 08/073,205, filed Jun. 4, 1993, abandoned; which is a continuation-in-part of U.S. application Ser. No. 08/027,146, filed Mar. 5, 1993, abandoned; said U.S. application Ser. No. 09/017,735, filed Feb. 3, 1998, abandoned, is also a continuation-in-part of U.S. application Ser. No. 08/822,382, filed Mar. 20, 1997, abandoned; which claims the benefit of U.S. Provisional Appl. No. 60/013,980, filed Mar. 21, 1996, abandoned; said U.S. application Ser. No. 09/017,735, filed Feb. 3, 1998, abandoned, is also a continuation-in-part of U.S. application Ser. No. 08/753,622, filed Nov. 27, 1996, abandoned; said U.S. application Ser. No. 09/017,735, filed Feb. 3, 1998, abandoned, is also a continuation-in-part of U.S. application Ser. No. 08/205,713, filed Mar. 4, 1994, abandoned; which is a continuation-in-part of U.S. application Ser. No. 08/159,184, filed Nov. 29, 1993, abandoned; which is a continuation-in-part of U.S. application Ser. No. 08/073,205, filed Jun. 4, 1993, abandoned; which is a continuation-in-part of U.S. application Ser. No. 08/027,146, filed Mar. 5, 1993, abandoned; the present application is also a continuation-in-part of U.S. application Ser. No. 08/454,033, filed May 26, 1995, abandoned; which is a continuation-in-part of U.S. application Ser. No. 08/349,177, filed Dec. 2, 1994, abandoned; which is a continuation-in-part of U.S. application Ser. No. 08/159,184, filed Nov. 29, 1993, abandoned; which is a continuation-in-part of U.S. application Ser. No. 08/073,205, filed Jun. 4, 1993, abandoned; which is a continuation-in-part of U.S. application Ser. No. 08/027,146, filed Mar. 5, 1993, abandoned; the present application is also a continuation-in-part of U.S. application Ser. No. 09/017,743, filed Feb. 3, 1998, abandoned; which is a continuation-in-part of U.S. application Ser. No. 08/753,615, filed Nov. 27, 1996, abandoned; which is a continuation-in-part of U.S. application Ser. No. 08/590,298, filed Jan. 23, 1996, abandoned; which is a continuation-in-part of U.S. application Ser. No. 08/452,843, filed May 30, 1995, abandoned; which is a continuation-in-part of U.S. application Ser. No. 08/344,824, filed Nov. 23, 1994, abandoned; which is a continuation-in-part of U.S. application Ser. No. 08/278,634, filed Jul. 21, 1994, abandoned; said Ser. No. 09/017,743, filed Feb. 3, 1998, abandoned, is also a continuation-in-part of said application Ser. No. 08/344,824, filed Nov. 23, 1994, abandoned; and a continuation-in-part of said application Ser. No. 08/452,843, filed May 30, 1995, abandoned; the present application is also a continuation-in-part of U.S. application Ser. No. 08/452,843, filed May 30, 1995, abandoned; which is a continuation-in-part of U.S. application Ser. No. 08/344,824, filed Nov. 23, 1994, abandoned; which is a continuation-in-part of U.S. application Ser. No. 08/278,634, filed Jul. 21, 1994, abandoned; the present application is also a continuation-in-part of U.S. application Ser. No. 08/344,824, filed Nov. 23, 1994, abandoned; which is a continuation-in-part of U.S. application Ser. No. 08/278,634, filed Jul. 21, 1994, abandoned; the present application is also a continuation-in-part of U.S. application Ser. No. 09/226,775, filed Jan. 6, 1999, abandoned; which is a continuation-in-part of U.S. application Ser. No. 08/815,396, filed Mar. 10, 1997, abandoned; which claims the benefit of U.S. Provisional Appl. No. 60/013,113, filed Mar. 11, 1996, abandoned; U.S. application Ser. No. 09/226,775, filed Jan. 6, 1999, abandoned, is also a continuation-in-part of U.S. application Ser. No. 08/485,218, filed Jun. 7, 1995, abandoned; which is a continuation-in-part of U.S. application Ser. No. 08/305,871, filed Sep. 14, 1994, now U.S. Pat. No. 5,736,142; which is a continuation-in-part of U.S. application Ser. No. 08/121,101, filed Sep. 14, 1993, abandoned; the present application is also a continuation-in-part of U.S. application Ser. No. 10/030,014, filed Dec. 28, 2001, abandoned; which is the national stage of International Appl. No. PCT/US00/17842, filed Jun. 28, 2000; which claims the benefit of U.S. Provisional Appl. No. 60/141,422, filed Jun. 29, 1999, abandoned; the present application is also a continuation-in-part of U.S. application Ser. No. 10/121,415, filed Apr. 11, 2002, abandoned; which is a continuation-in-part of U.S. application Ser. No. 09/189,702, filed Nov. 10, 1998, now U.S. Pat. No. 7,252,829; which is a continuation-in-part of U.S. application Ser. No. 09/098,584, filed Jun. 17, 1998, abandoned; the present application is also a continuation-in-part of International Appl. No. PCT/US03/31308, filed Oct. 3, 2003; which claims the benefit of U.S. Provisional Appl. No. 60/416,207, filed Oct. 3, 2002, abandoned; said International Appl. No. PCT/US03/31308, filed Oct. 3, 2003, also claims the benefit of U.S. Provisional Appl. No. 60/417,269, filed Oct. 8, 2002, abandoned; the present application is also a continuation-in-part of U.S. application Ser. No. 09/260,714, filed Mar. 1, 1999, abandoned; the present application is also a continuation-in-part of U.S. application Ser. No. 10/470,364, filed Apr. 9, 2004, abandoned, which is the national stage of International Appl. No. PCT/US02/02708, filed Jan. 29, 2002; which is a continuation-in-part of U.S. application Ser. No. 09/935,476, filed Aug. 22, 2001, abandoned; which claims the benefit of U.S. Provisional Appl. No. 60/264,969, filed Jan. 29, 2001, abandoned; said U.S. application Ser. No. 09/935,476, filed Aug. 22, 2001, abandoned; is also a continuation-in-part of U.S. application Ser. No. 09/346,105, filed Jun. 30, 1999, abandoned; the present application is also a continuation-in-part of U.S. application Ser. No. 10/469,201, filed Aug. 25, 2003, abandoned, which is the national stage of International Appl. No. PCT/US01/51650, filed Oct. 18, 2001; which claims the benefit of U.S. Provisional Appl. No. 60/285,624, filed Apr. 20, 2001, abandoned; said International Appl. No. PCT/US01/51650, filed Oct. 18, 2001, also claims the benefit of U.S. Provisional Appl. No. 60/242,350, filed Oct. 19, 2000, abandoned.

The present application is a continuation-in-part of U.S. Ser. No. 08/205,713 filed Mar. 4, 1994, abandoned.

This application is a continuation-in-part of application U.S. Ser. No. 08/278,634 filed Jul. 21, 1994, abandoned; which is incorporated herein by reference.

This application is a continuation-in-part of application U.S. Ser. No. 08/278,634 filed Jul. 21, 1994, abandoned; which is incorporated herein by reference.

This application is a continuation-in-part of U.S. application Ser. No. 09/346,105, filed Jun. 30, 1999, abandoned; entitled "Consistent Immune Responses in Diverse Genetic Populations," filed 30 Jun. 1999, Sidney et al. This application also claims the benefit of the 29 Jan. 2001 filing date of U.S. Application Ser. No. 60/264,969, abandoned; entitled "Subunit Vaccines with A2 Supermotifs," Sidney, et al., each of which is incorporated by reference in its entirety.

This application is a Continuation in Part ("CIP") of U.S. Ser. No. 08/815,396, filed Mar. 10, 1997, abandoned; which is a CIP of U.S. Ser. No. 60/013,113, filed Mar. 11, 1996, abandoned; and is a CIP of U.S. Ser. No. 08/485,218 filed Jun. 7, 1995, abandoned; which is a CIP of U.S. Ser. No. 08/305,871 filed Sep. 14, 1994, now U.S. Pat. No. 5,736,142 issued Apr. 7, 1998, which is a CIP of abandoned application U.S. Ser. No. 08/121,101 filed Sep. 14, 1993, abandoned.

The present application is a continuation in part of U.S. Ser. No. 08/159,184, filed Nov. 29, 1993, abandoned; which is a continuation in part of U.S. Ser. No. 08/073,205, filed Jun. 4, 1993, abandoned; which is a continuation in part of U.S. Ser. No. 08/027,146, filed Mar. 5, 1993, abandoned; all of which are incorporated herein by reference.

The present application is a continuation in part of U.S. Ser. No. 08/159,339, filed Nov. 29, 1993, now U.S. Pat. No. 6,037,135, abandoned; which is continuation in part of U.S. Ser. No. 08/103,396, filed Aug. 6, 1993, abandoned; which is a continuation in part of U.S. Ser. No. 08/027,746, filed Mar. 5, 1993, abandoned; which is a continuation in part of U.S. Ser. No. 07/926,666, filed Aug. 7, 1992, abandoned.

This application is a Continuation in Part ("CIP") of U.S. Ser. No. 08/815,396, filed Mar. 10, 1997, abandoned; which is a CIP of U.S. Ser. No. 60/013,113, filed Mar. 11, 1996, abandoned; and is a CIP of U.S. Ser. No. 08/485,218 filed Jun. 7, 1995, abandoned; which is a CIP of U.S. Ser. No. 08/305,871 filed Sep. 14, 1994, now U.S. Pat. No. 5,736,142 issued Apr. 7, 1998, which is a CIP of abandoned application U.S. Ser. No. 08/121,101 filed Sep. 14, 1993.

All of the above applications are incorporated herein by reference. These applications are referred to herein as the "parent applications."

FEDERALLY SPONSORED RESEARCH AND DEVELOPMENT

Subject matter disclosed herein was funded, in part, by the United States government under grants from the National Institutes of Health. The U.S. government may have certain rights in this invention. This invention was funded, in part, by the U.S. government under a contract from the National Institutes of Health. The U.S. government may have certain rights in the invention.

REFERENCE TO A SEQUENCE LISTING, A TABLE, OR A COMPUTER PROGRAM LISTING APPENDIX SUBMITTED ON A COMPACT DISC

The Sequence Listing written in file "Sequence Listing.txt," 2.9 megabytes, created on Jan. 24, 2005 on two identical copies of compact discs for application Ser. No. 10/817,970, Grey et al., HLA Binding Motifs and Peptides and Their Uses, is herein incorporated-by-reference.

BACKGROUND OF THE INVENTION

The present invention relates to compositions and methods for preventing, treating or diagnosing a number of pathological states such as viral diseases and cancers. In particular, it provides novel peptides capable of binding selected major histocompatibility complex (MHC) molecules and inducing an immune response.

The genetic makeup of a given mammal encodes the structures associated with the immune system of that species. Although there is a great deal of genetic diversity in the human population, even more so comparing humans and other species, there are also common features and effects. In mammals, certain molecules associated with immune function are termed the major histocompatibility complex.

MHC molecules are classified as either Class I or Class II molecules. Class II MHC molecules are expressed primarily on cells involved in initiating and sustaining immune responses, such as T lymphocytes, B lymphocytes, dendritic cells, macrophages, etc. Class II MHC molecules are recognized by helper T lymphocytes and induce proliferation of helper T lymphocytes and amplification of the immune response to the particular immunogenic peptide that is displayed. Complexes between a particular disease-associated antigenic peptide and class II HLA molecules are recognized by helper T lymphocytes and induce proliferation of helper T lymphocytes and amplification of specific CTL and antibody immune responses.

Class I MHC molecules are expressed on almost all nucleated cells and are recognized by cytotoxic T lymphocytes (CTLs), which then destroy the antigen-bearing cells. Complexes between a particular antigenic peptide and class I MHC molecules are recognized by CD8+ cytotoxic T lymphocytes (CTLs), which then destroy the cells bearing antigens bound by the HLA class I molecules expressed on those cells. CD8+ T lymphocytes frequently mature into cytotoxic effector which can lyse cells bearing the stimulating antigen. CTLs are particularly important in tumor rejection and in fighting viral, fungal, and parasitic infections.

A complex of an HLA molecule and a peptidic antigen acts as the ligand recognized by HLA-restricted T cells (Buus, S. et al., *Cell* 47:1071, 1986; Babbitt, B. P. et al., *Nature* 317: 359, 1985; Townsend, A. and Bodmer, H., *Annu. Rev. Immunol.* 7:601, 1989; Germain, R. N., *Annu. Rev. Immunol.* 11:403, 1993).

Through the study of single amino acid substituted antigen analogs and the sequencing of endogenously bound, naturally processed peptides, critical residues that correspond to motifs required for specific binding to HLA antigen molecules have been identified (see also, e.g., Southwood, et al., *J. Immunol.* 160:3363, 1998; Rammensee, et al., *Immunogenetics* 41:178, 1995; Sette, A. and Sidney, J. *Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, J. *Curr. Biol.* 6:52, 1994; Ruppert et al., *Cell* 74:929-937, 1993; Kondo et al., *J. Immunol.* 155: 4307-4312, 1995; Sidney et al., *J. Immunol.* 157:3480-3490, 1996; Sidney et al., *Human Immunol.* 45:79-93, 1996; Sette, A. and Sidney, J. *Immunogenetics* 50:201-212, 1999). The presence of these residues correlates with binding affinity for HLA molecules. The identification of motifs and/or supermotifs that correlate with high and intermediate affinity binding is an important issue with respect to the identification of immunogenic peptide epitopes for the inclusion in a vaccine. Kast et al. (*J. Immunol.* 152:3904-12, 1994) have shown that motif-bearing peptides account for 90% of the epitopes that bind to allele-specific HLA class I molecules. In this study all possible peptides of 9 amino acids in length and overlapping by eight amino acids (240 peptides), which cover the entire sequence of the E6 and E7 proteins of human papillomavirus type 16, were evaluated for binding to five allele-specific HLA molecules that are expressed at high frequency among different ethnic groups. This unbiased set of peptides allowed an evaluation of the predictive value of HLA class I motifs. From the set of 240 peptides, 22 peptides were identified that bound to an allele-specific HLA molecule with high or intermediate affinity. Of these 22 peptides, 20 (i.e. 91%) were motif-bearing. Thus, this study demonstrates the value of motifs for the identification of peptide epitopes for inclusion in a vaccine: application of motif-based identification techniques will identify about 90% of the potential epitopes in a target antigen protein sequence.

A relationship between binding affinity for HLA class I molecules and immunogenicity of discrete peptide epitopes on bound antigens was determined by the present inventors. As disclosed in greater detail herein, higher HLA binding affinity is correlated with greater immunogenicity.

Furthermore, x-ray crystallographic analysis of HLA-peptide complexes has revealed pockets within the peptide binding cleft of HLA molecules which accommodate, in an allele-specific mode, specific residues of peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.).

Peptides of the present invention may also comprise epitopes that bind to HLA class II DR molecules. A greater degree of heterogeneity in both size and binding frame position of the motif, relative to the N- and C-termini of the peptide, exists for class II peptide ligands. This increased heterogeneity of HLA class II peptide ligands is due to the structure of the binding groove of the HLA class II molecule which, unlike its class I counterpart, is open at both ends. Crystallographic analysis of HLA class II DRB*0101-peptide complexes showed that the major energy of binding is contributed by peptide residues complexed with complementary pockets on the DRB*0101 molecules. An important anchor residue engages the deepest hydrophobic pocket (see, e.g., Madden, D. R. *Ann. Rev. Immunol.* 13:587, 1995) and is referred to as position 1 (P1). P1 may represent the N-terminal residue of a class II binding peptide epitope, but more typically is flanked towards the N-terminus by one or more residues. Other studies have also pointed to an important role for the peptide residue in the sixth position towards the C-terminus, relative to P1, for binding to various DR molecules.

In the past few years evidence has accumulated to demonstrate that a large fraction of HLA class I and class II molecules can be classified into a relatively few supertypes, each characterized by largely overlapping peptide binding repertoires, and consensus structures of the main peptide binding pockets. Thus, peptides of the present invention are identified by any one of several HLA-specific amino acid motifs, or if the presence of the motif corresponds to the ability to bind several allele-specific HLA molecules, a supermotif. The HLA molecules that bind to peptides that possess a particular amino acid supermotif are collectively referred to as an HLA "supertype."

Accordingly, the definition of class I and class II allele-specific HLA binding motifs, or class I or class II supermotifs allows identification of regions within a protein that have the potential of binding particular HLA molecules.

The MHC class I antigens are encoded by the HLA-A, B, and C loci. HLA-A and HLA-B antigens are expressed at the cell surface at approximately equal densities, whereas the expression of HLA-C is significantly lower (perhaps as much as 10-fold lower). Each of these loci have a number of alleles.

Specific motifs for several of the major HLA-A alleles (copending U.S. patent application Ser. Nos. 08/159,339 and 08/205,713, referred to here as the copending applications) and HLA-B alleles have been described. Several authors (Melief, *Eur. J. Immunol.,* 21:2963-2970 (1991); Bevan, et al., *Nature,* 353:852-955 (1991)) have provided preliminary evidence that class I binding motifs can be applied to the identification of potential immunogenic peptides in animal models. Strategies for identification of peptides or peptide regions capable of interacting with multiple MHC alleles have been described in the literature.

Because human population groups, including racial and ethnic groups, have distinct patterns of distribution of HLA alleles it will be of value to identify motifs that describe peptides capable of binding more than one HLA allele, so as to achieve sufficient coverage of all population groups. The present invention addresses these and other needs.

The recognition of foreign pathogens, foreign cells (i.e., tumor), or one's own cells by the immune system occurs largely through major histocompatibility (MHC) molecules. MHC molecules present unique molecular fragments of foreign and self molecules that permit recognition and, when appropriate, stimulation of various immune effectors, namely B and T lymphocytes. MHC molecules are classified as either class I or class II. Class II MHC molecules are expressed primarily on cells involved in initiating and sustaining immune responses, such as T lymphocytes, B lymphocytes, macrophages, etc. Class II MHC molecules are recognized by helper T lymphocytes and induce proliferation of helper T lymphocytes and amplification of the immune response to the particular immunogenic peptide that is displayed. CD4+ T lymphocytes are activated with recognition of a unique peptide fragment presented by a class II MHC molecule, usually found on an antigen presenting cell like a macrophage or dendritic cell. Often known as helper T lymphocytes (HTL), CD4+ lymphocytes proliferate and secrete cytokines that either support a antibody-mediated response through the production of IL-4 and IL-10 or support a cell-mediated response through the production of IL-2 and IFN-γ.

T lymphocytes recognize an antigen in the form of a peptide fragment bound to the MHC class I or class II molecule rather than the intact foreign antigen itself. An antigen presented by a MHC class I molecule is typically one that is endogenously synthesized by the cell (i.e., an intracellular pathogen). The resulting cytoplasmic antigens are degraded into small fragments in the cytoplasm, usually by the proteosome (Niedermann et al., *Immunity,* 2: 289-99 (1995)). Some of these small fragments are transported into the endoplasmic reticulum (a pre-Golgi compartment) where the fragment interacts with class I heavy chains to facilitate proper folding and association with the subunit β2 microglobulin to result in a stable complex formation between the fragment, MHC class I chain and β2 microglobulin. This complex is then transported to the cell surface for expression and potential recognition by specific CTLs. Antigens presented by MHC class II molecules are usually soluble antigens that enter the antigen presenting cell via phagocytosis, pinocytosis, or receptor-mediated endocytosis. Once in the cell, the antigen is partially degraded by acid-dependent proteases in endosomes. The resulting fragments or peptide associate with the MHC class II molecule after the release of the CLIP fragment to form a stable complex that is then transported to the surface for potential recognition by specific HTLs. See Blum, et al., *Crit. Rev. Immunol.,* 17: 411-17 (1997); Arndt, et al., *Immunol. Res.,* 16: 261-72 (1997).

Investigations of the crystal structure of the human MHC class I molecule, HLA-A2.1, indicate that a peptide binding groove is created by the folding of the α1 and α2 domains of the class I heavy chain (Bjorkman, et al., *Nature* 329:506 (1987). In these investigations, however, the identity of peptides bound to the groove was not determined.

Buus, et al., *Science* 242:1065 (1988) first described a method for acid elution of bound peptides from MHC. Subsequently, Rammensee and his coworkers (Falk, et al., *Nature* 351:290 (1991) have developed an approach to characterize naturally processed peptides bound to class I molecules. Other investigators have successfully achieved direct amino acid sequencing of the more abundant peptides in various HPLC fractions by conventional automated sequencing of peptides eluted from class I molecules of the B type (Jardetzky, et al., *Nature* 353:326 (1991) and of the A2.1 type by mass spectrometry (Hunt, et al., *Science* 225:1261 (1992). A review of the characterization of naturally processed peptides in MHC Class I has been presented by Rötzschke and Falk (Rötzschke and Falk, *Immunol. Today* 12:447 (1991). PCT publication WO97/34621, incorporated herein by reference, describes peptides which have a binding motif for A2.1 alleles.

Peptides that bind a particular MHC allele frequently will fit within a motif and have amino acid residues with particular biochemical properties at specific positions within the peptide. Such residues are usually dictated by the biochemical properties of the MHC allele. Peptide sequence motifs have been utilized to screen peptides capable of binding MHC molecules (Sette, et al., *Proc. Natl. Acad. Sci. USA* 86:3296 (1989)), and it has been reported that class I binding motifs identified potential immunogenic peptides in animal models (De Bruijn, et al., *Eur. J. Immunol.* 21: 2963-70 (1991); Pamer, et al., *Nature* 353: 852-955 (1991)). Also, binding of a particular peptide to a MHC molecule has been correlated with immunogenicity of that peptide (Schaeffer, et al., *Proc. Natl. Acad. Sci. USA* 86:4649 (1989)).

Of the many thousand possible peptides that are encoded by a complex foreign pathogen, only a small fraction ends up in a peptide form capable of binding to MHC class I or class II antigens and thus of being recognized by T cells. This phenomenon is known as immunodominance (Yewdell et al., *Ann. Rev. Immunol.,* 17: 51-88 (1997)). More simply, immunodominance describes the phenomenon whereby immunization or exposure to a whole native antigen results in an immune response directed to one or a few "dominant" epitopes of the antigen rather than every epitope that the native antigen contains. Immunodominance is influenced by a variety of factors that include MHC-peptide affinity, antigen processing, and antigen availability.

In general, CTL and HTL responses are not directed against all possible epitopes. Rather, they are restricted to a few immunodominant determinants. (Zinkernagel, et al., *Adv. Immunol.* 27:51-59 (1979); Bennink, et al., *J. Exp. Med.* 168:1935-1939 (1988); Rawle, et al., *J. Immunol.* 146:3977-84 (1991); Sercarz et al. *Ann. Rev. Immunol.* 11:729-766 (1993)). It has been recognized that immunodominance (Benacerraf, et al., *Science* 175:273-79 (1972)) could be explained by either the ability of a given epitope to selectively bind a particular HLA protein (determinant selection theory) (Vitiello, et al., *J. Immunol.* 131:1635 (1983); Rosenthal, et al., *Nature* 267:156-58 (1977)), or being selectively recognized by the existing TCR (T cell receptor) specificity (repertoire theory) (Klein, J., Immunology, the Science of Self-Nonself Discrimination, John Wiley & Sons, New York, pp. 270-310 (1982)). It has been demonstrated that additional factors, mostly linked to processing events, can also play a key role in dictating, beyond strict immunogenicity, which of the many potential determinants will be presented as immunodominant (Sercarz, et al., *Annu. Rev. Immunol.* 11:729-66 (1993)).

The present understanding is that because T cells to dominant epitopes may have been clonally deleted, selecting subdominant epitopes may allow extant T cells to be recruited which will then lead to a therapeutic response. However, the binding of HLA molecules to subdominant epitopes is often less vigorous than to dominant ones. Accordingly, there is a need to be able to modulate the binding affinity of particular immunogenic epitopes for one or more HLA molecules, and thereby to modulate the immune response elicited by the peptide.

Accordingly, while some MHC binding peptides have been identified, there is a need in the art to identify novel MHC binding peptides from pathogens that can be utilized to generate an immune response in vaccines against the pathogens from which they originate. Further, there is a need in the art to identify peptides capable of binding a wide array of different types of MHC molecules such they are immunogenic in a large fraction a human outbred population.

Sette et al., *Proc. Natl. Acad. Sci. USA* 86:3296 (1989) showed that MHC allele specific motifs could be used to predict MHC binding capacity. Schaeffer et al., *Proc. Natl. Acad. Sci. USA* 86:4649 (1989) showed that MHC binding was related to immunogenicity. Several authors (De Bruijn et al., *Eur. J. Immunol.,* 21:2963-2970 (1991); Pamer et al., 991 Nature 353:852-955 (1991)) have provided preliminary evidence that class I binding motifs can be applied to the identification of potential immunogenic peptides in animal models. Class I motifs specific for a number of human alleles of a given class I isotype have yet to be described. It is desirable that the combined frequencies of these different alleles should be high enough to cover a large fraction or perhaps the majority of the human outbred population.

Thus a need exists, met for the first time herein, to prepare analog peptides which elicit a more vigorous response. This ability greatly enhances the usefulness of peptide-based vaccines and therapeutic agents. The present invention provides these and other advantages.

One of the most formidable obstacles to the development of broadly efficacious peptide-based immunotherapeutics has been the extreme polymorphism of HLA molecules. Effective coverage of a population without bias would thus be a task of considerable complexity if epitopes were used specific for HLA molecules corresponding to each individual allele because a huge number of them would have to be used in order to cover an ethnically diverse population. There exists, therefore, a need to develop peptide epitopes that are bound by multiple HLA antigen molecules at high affinity for use in epitope-based vaccines. The greater the number of HLA antigen molecules bound, the greater the breadth of population coverage by the vaccine. Analog peptides may be engineered based on the information disclosed herein and thereby used to achieve such an enhancement in breadth of population coverage.

Thus, the use of analoguing to modify peptide epitopes to enhance population coverage and/or immunogenicity provides a heretofore undisclosed advantage of the present invention in creating effective, immunogenic vaccines for a broad segment of the population.

Despite the developments in the art, the prior art has yet to provide a useful human peptide-based vaccine or therapeutic agent based on this work. The present invention provides these and other advantages.

BRIEF DESCRIPTION OF THE DRAWINGS

FIG. 1. Preferred Motif Table.

FIG. 2. HLA superfamilies for HLA-A and HLA-B alleles. Various alleles of HLA-A and HLA-B are classified according to superfamily based on sequencing analysis or binding assays (verified supertype members) or on the basis of B and F pocket structure (predicted supertype members).

FIG. 3 shows binding motifs for peptides capable of binding HLA alleles sharing the B7-like specificity.

FIG. 4 shows the B7-like cross-reactive motif.

FIGS. 6A-6D. Map of the A*0201 motif. Summary map of the A*0201 motif for 8-mer (b), 10-mer (c) and 11-mer (d) peptides. At secondary anchor positions, residues shown as preferred (or deleterious) are associated with an average binding capacity at least 3-fold greater than (or 3-fold less than) peptides of the same size carrying other residues at the same position. At the primary anchor positions, preferred residues are those associated with an average binding capacity within 10-fold of the optimal residue at the same position. Tolerated primary anchor residues are those associated with an average binding capacity between 10- and 100-fold of the optimal residue at the same position.

FIG. 9. Map of the A*0202 motif Summary map of A*0202 motif for 9-mer (a) and 10-mer (b) peptides. At secondary anchor positions, residues shown as preferred (or deleterious) are associated with an average binding capacity at least 3-fold greater than (or 3-fold less than) peptides of the same size carrying other residues at the same position. At the primary anchor positions, preferred residues are those associated with an average binding capacity within 10-fold of the optimal residue at the same position. Tolerated primary anchor residues are those associated with an average binding capacity between 10- and 100-fold of the optimal residue at the same position.

FIG. 10. Map of the A*0203 motif. Summary maps of A*0203 motif for 9-mer (a) and 10-mer (b) peptides. At secondary anchor positions, residues shown as preferred (or deleterious) are associated with an average binding capacity at least 3-fold greater than (or 3-fold less than) peptides of the same size carrying other residues at the same position. At the primary anchor positions, preferred residues are those associated with an average binding capacity within 10-fold of the optimal residue at the same position. Tolerated primary anchor residues are those associated with an average binding capacity between 10- and 100-fold of the optimal residue at the same position.

FIG. 11. Map of the A*0206 motif. Summary maps of A*0206 motif for 9-mer (a) and 10-mer (b) peptides. At secondary anchor positions, residues shown as preferred (or deleterious) are associated with an average binding capacity at least 3-fold greater than (or 3-fold less than) peptides of the same size carrying other residues at the same position. At the primary anchor positions, preferred residues are those associated with an average binding capacity within 10-fold of the optimal residue at the same position. Tolerated primary anchor residues are those associated with an average binding capacity between 10- and 100-fold of the optimal residue at the same position.

Lane 1—Molecular weight standards
Lane 2—A3.2 acid eluate
Lane 3—A3.2 a second acid eluate
Lane 4—Base elution #1
Lane 5—Base elution #2
Lane 6—Concentrated base elution1
Lane 7—Concentrated base elution 2
Lane 8—BSA—10 pg
Lane 9—BSA—3 pg
Lane 10—BSA—1 pg

FIG. 30 shows CTL induction using X351 or X355 A2.1 responders and autologous acid stripped PBMCs or PHA blasts as stimulators after loading with the 1044.04-1044.05-1044.06 peptide pool.

FIG. 35 shows a CTL response to an immunogenic peptide for MAGE/A11.

FIG. 43 shows allele specific motifs of five A3 supertype alleles: A*0301 (shown as A3), A*1101 (shown as A11), A*3101, A*3301, and A*6801. Individual residues, or groups of residues, associated for each non-anchor position with either good ("preferred") or poor ("deleterious") binding capacities to each individual allele are shown.

FIG. 44 shows preferred and deleterious secondary anchor residues for the refined A24 9-mer and 10-mer motifs.

FIG. 46A and FIG. 46B summarize the motifs for the B7 supertype alleles (FIGS. 46Aa-d, 46Be) and for the B7 supermotif (FIG. 46Bf). The Figure and corresponding motif/supermotif is as follows: a) B*0702, b) B*3501, c) B51, d) B*5301, and e) B*5401. These maps were subsequently used to define the B7 supermotif (f). Values in parenthesis indicate the frequency that a residue or residue group was preferred or deleterious.

FIG. 47 shows relative average binding capacity of the A*0101 motif 9-mer peptides as a function of the different residues occurring at each of the non-anchor positions. FIG. 47*a* and FIG. 47*b* depict data, and FIG. 47*c* and FIG. 47*d* depict graphics. Data sets from either 2-9 motif (FIG. 47*a*), 3-9 motif (FIG. 47*b*) peptide sets were analyzed and tabulated [as described in the Examples]. The 2-9 and 3-9 sets contained 101 and 85 different peptides, respectively. Maps of secondary effects influencing the binding capacity of 9-mer peptides carrying the 2-9 (FIG. 47*c*) 3-9 mer (FIG. 47*d*) A*0101 motifs are also shown.

FIG. 48 shows relative average binding capacity of the A*0101 motif 10 mer peptides as function of the different residues occurring at each of the non-anchor positions. Data sets from either 2-10 mer (FIG. 48*a*) or 3-10 (FIG. 48*b*) motif sets of peptides were analyzed and tabulated. The 2-10 and 3-10 sets contained 91 and 89 different peptides, respectively. Maps of secondary effects influencing the binding capacity of 10 mer peptides carrying the 2-10 (FIG. 48*c*) mer and (1) and or 3-10 mer (FIG. 48*d*) A1 motifs are also shown.

FIG. 49 is a flow diagram of an HLA-A purification scheme.

BRIEF SUMMARY OF THE INVENTION

Figure 5A:
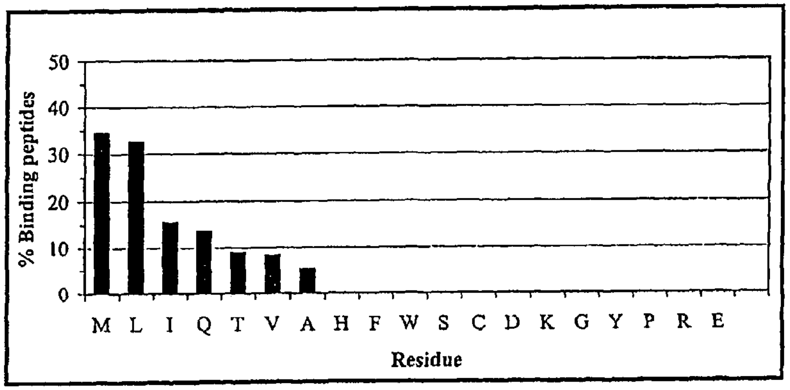
FIGS. 5A and 5B. Position 2 and C-terminus define specificity of HLA-A*0201. The preference for specific residues in position 2(a) or at the C-terminus (b) is shown as a function of the percent of peptides bearing a specific residue that bind A*0201 with $IC_{50}$ of 500 nM or better. ARB values of peptides bearing specific residues in position 2 (a) or at the C-terminus (b) were calculated as described herein, and indexed relative to the residue with the highest binding capacity. The average (geometric) binding capacity of peptides with L in position 2 was 1991 nM. The average (geometric) binding capacity of peptides with V at the C-terminus was 2133 nM. Peptides included in the analysis had at least one tolerated anchor residue, as described in the text, at either position 2 or the C-terminus.

The present invention relates to compositions and methods for preventing, treating or diagnosing a number of pathological states such as viral diseases and cancers. Thus, provided herein are novel peptides capable of binding selected major histocompatibility complex (MHC) molecules and inducing or modulating an immune response. Some of the peptides disclosed are capable of binding human class II MHC (HLA) molecules, including HLA-DR and HLA-DQ alleles. Other peptides disclosed herein are capable of binding to human class I molecules, including one or more of the following: HLA-A1, HLA-A2.1, HLA-A3.2, HLA-A11, HLA-A24.1, HLA-B7, and HLA-B44 molecules. Other peptides disclosed are capable of binding to murine class I molecules. Also provided are compositions that include immunogenic peptides having binding motifs specific for MHC molecules. The peptides and compositions disclosed can be utilized in methods for inducing an immune response, a cytotoxic T lymphocyte (CTL) response or helper T lymphocyte (HTL) response in particular, when administered to a system.

The present invention also provides a method of identifying peptide epitopes comprising an HLA A3 supermotif. An A3 supermotif, when present in a peptide, allows the peptide to bind more than one HLA molecule that is a member of the HLA A3 supertype. An HLA supertype describes a set of HLA molecules grouped on the basis of shared peptide-binding specificities. Accordingly, HLA molecules that share similar binding repertoires for peptides bearing the HLA-A3 supermotif are grouped into the HLA A3 supertype. The HLA A3 supertype is comprised by HLA A3, A11, A31, A3301, and A6801.

The present invention provides compositions comprising immunogenic peptides having binding motifs for HLA alleles. The immunogenic peptides are about 9 to 10 residues in length and comprise conserved residues at certain positions such as a proline at position 2 and an aromatic residue (e.g., Y, W, F) or hydrophobic residue (e.g., L, I, V, M, or A) at the carboxy terminus. In particular, an advantage of the peptides of the invention is their ability to bind to two or more different HLA alleles.

The present invention also provides compositions comprising immunogenic peptides having binding motifs for MHC Class I molecules. The immunogenic peptides are typically between about 8 and about 11 residues and comprise conserved residues involved in binding proteins encoded by the appropriate MHC allele. A number of allele specific motifs have been identified.

For instance, the motif for HLA-A3.2 comprises from the N-terminus to C-terminus a first conserved residue of L, M, I, V, S, A, T and F at position 2 and a second conserved residue of K, R or Y at the C-terminal end. Other first conserved residues are C, G or D and alternatively E. Other second conserved residues are H or F. The first and second conserved residues are preferably separated by 6 to 7 residues.

The motif for HLA-A1 comprises from the N-terminus to the C-terminus a first conserved residue of T, S or M, a second conserved residue of D or E, and a third conserved residue of Y. Other second conserved residues are A, S or T. The first and second conserved residues are adjacent and are preferably separated from the third conserved residue by 6 to 7 residues. A second motif consists of a first conserved residue of E or D and a second conserved residue of Y where the first and second conserved residues are separated by 5 to 6 residues.

The motif for HLA-A11 comprises from the N-terminus to the C-terminus a first conserved residue of T or V at position 2 and a C-terminal conserved residue of K. The first and second conserved residues are preferably separated by 6 or 7 residues.

The motif for HLA-A24.1 comprises from the N-terminus to the C-terminus a first conserved residue of Y, F or W at position 2 and a C terminal conserved residue of F, I, W, M or L. The first and second conserved residues are preferably separated by 6 to 7 residues.

The present invention also provides compositions comprising immunogenic peptides having allele-specific binding motifs, such as binding motifs for HLA-A2.1 molecules. For HLA class I epitopes, which bind to the appropriate HLA Class I allele, the peptides typically comprise epitopes from 8-11 amino acids in length, often 9 to 10 residues in length, that comprise conserved residues at certain positions such as positions 2 and the C-terminal position. Moreover, the peptides preferably do not comprise negative binding residues as defined herein at other positions such as, in an HLA-A2.1 motif-bearing epitope, positions 1, 3, 6 and/or 7 in the case of peptides 9 amino acids in length and positions 1, 3, 4, 5, 7, 8 and/or 9 in the case of peptides 10 amino acids in length. For HLA class II epitopes, the peptides typically comprise a motif of 6 to about 25 amino acids for a class II HLA motif, typically, 9 to 13 amino acids in length, which is recognized by a particular HLA molecule. The present invention defines positions within a motif enabling the selection of peptides which will bind efficiently to HLA A2.1.

The invention also provides the parameters for the design of vaccines which are expected to effectively target large portions of the population. Following the guidance set forth herein, to prepare vaccines with respect to a particular infectious organism or virus or tumor, the relevant antigen is assessed to determine the location of epitopes which are most likely to effect a cytotoxic T response to an infection or tumor. By analyzing the amino acid sequence of the antigen according to the methods set forth herein, an appropriate set of epitopes can be identified. Peptides which consist of these epitopes can readily be tested for their ability to bind one or more HLA alleles characteristic of the A2 supertype. In general, peptides which bind with an affinity represented by an $IC_{50}$ of 500 nM or less have a high probability of eliciting a cytotoxic T lymphocyte (CTL) response. The ability of these peptides to do so can also readily be verified. Vaccines can then be designed based on the immunogenic peptides thus identified. The vaccines themselves can consist of the peptides per se, precursors which will be expected to generate the peptides in vivo, or nucleic acids encoding these peptides for production in vivo.

Thus, in one aspect, the invention is directed to a method for identifying an epitope in an antigen characteristic of a pathogen or tumor. The epitope identified by this method is more likely to enhance an immune response in an individual bearing an allele of the A2 supertype than an arbitrarily chosen peptide. The method comprises analyzing the amino acid sequence of the antigen for segments of 8-11 amino acids, where the amino acid at position 2 is a small or aliphatic hydrophobic residue (L, I, V, M, A, T or Q) and the amino acid at the C-terminus of the segment is also a small or aliphatic hydrophobic residue (L, I, V, M, A or T). In preferred embodiments, the residue at position 2 is L or M. In other preferred embodiments, the segment contains 9-10 amino acids. In another preferred embodiment, the segment contains Q or N at position 1 and/or R, H or K at position 8, and lacks a D, E and G at position 3 when the segment is a 10-mer. Also preferred is V at position 2 and at the C-terminus.

The corresponding family of HLA molecules (i.e., the HLA-A2 supertype that binds these peptides) is comprised of at least: A *0201, A *0202, A *0203, A *0204, A*0205, A*0206, A*0207, A*0209, A*0214, A*6802, and A*6901.

Also described herein are compositions comprising immunogenic peptides having binding motif subsequences for HLA-A2.1 molecules. The immunogenic epitopes in the peptides, which bind to the appropriate MHC allele, are preferably 8-11 residues in length and more preferably 9 to 10 residues in length and comprise conserved residues at certain positions such as positions 2 and the C-terminus (often position 9). Moreover, the peptides do not comprise negative binding residues as defined herein at other positions such as positions 1, 3, 6 and/or 7 in the case of peptides 9 amino acids in length and positions 1, 3, 4, 5, 7, 8 and/or 9 in the case of peptides 10 amino acids in length. The present invention defines positions within a motif enabling the selection of peptides which will bind efficiently to HLA A2.1.

The HLA-A2.1 motif-bearing peptides comprise epitopes of 8-11 amino acids which typically have a first conserved residue at the second position from the N-terminus selected from the group consisting of L, M, I, V, A, T, and Q and a second conserved residue at the C-terminal position selected from the group consisting of V, L, I, A, M, and T. In a preferred embodiment, the peptide may have a first conserved residue at the second position from the N-terminus selected from the group consisting of V, A, T, or Q; and a second conserved residue at the C-terminal position selected from the group consisting of L, M, I, V, A, and T. Secondary anchor specificities have also been defined for the HLA-A2.1 binding motif.

The HLA-A1 motifs characterized by the presence in peptide ligands of T, S, or M as a primary anchor residue at position 2 and the presence of Y as a primary anchor residue at the C-terminal position of the epitope. An alternative allele-specific A1 motif is characterized by a primary anchor residue at position 3 rather than position 2. This motifs characterized by the presence of D, E, A, or S as a primary anchor residue in position 3, and a Y as a primary anchor residue at the C-terminal position of the epitope (see, e.g., DiBrino et al., J. Immunol., 152:620, 1994; Kondo et al., *Immunogenetics* 45:249, 1997; and Kubo et al., *J Immunol.* 152:3913, 1994 for reviews of relevant data).

The motif for HLA-A1 comprises from the N-terminus to the C-terminus a first conserved residue of T, S or M, a second conserved residue of D or E, and a third conserved residue of Y. Other second conserved residues are A, S or T. The first and second conserved residues are adjacent and are preferably separated from the third conserved residue by 6 to 7 residues. A second motif consists of a first conserved residue of E or D and a second conserved residue of Y where the first and second conserved residues are separated by 5 to 6 residues.

The HLA-A3 motif is characterized by the presence in peptide ligands of L, M, V, I, S, A, T, F, C, G, or D as a primary anchor residue at position 2, and the presence of K, Y, R, H, F, or A as a primary anchor residue at the C-terminal position of the epitope (see, e.g., DiBrino et al., *Proc. Natl. Acad. Sci USA* 90:1508, 1993; and Kubo et al., *J Immunol.* 152:3913-24, 1994).

For instance, the motif for HLA-A3.2 comprises from the N-terminus to C-terminus a first conserved residue of L, M, I, V, S, A, T and F at position 2 and a second conserved residue of K, R or Y at the C-terminal end. Other first conserved residues are C, G or D and alternatively E. Other second conserved residues are H or F. The first and second conserved residues are preferably separated by 6 to 7 residues.

The HLA-A11 motif is characterized by the presence in peptide ligands of V, T, M, L, I, S, A, G, N, C, D, or F as a primary anchor residue in position 2, and K, R, Y, or H as a primary anchor residue at the C-terminal position of the epitope (see, e.g., Zhang et al., *Proc. Natl. Acad. Sci USA* 90:2217-2221, 1993; and Kubo et al., *J Immunol.* 152:3913-3924, 1994). The first and second conserved residues are preferably separated by 6 or 7 residues.

The HLA-A3 and HLA-A11 are members of the HLA-A3 supertype family. The HLA-A3 supermotifs characterized by the presence in peptide ligands of A, L, I, V, M, S, or, T as a primary anchor at position 2, and a positively charged residue, R or K, at the C-terminal position of the epitope, e.g., in position 9 of 9-mers (see, e.g., Sidney et al., *Hum. Immunol.* 45:79, 1996). Exemplary members of the corresponding family of HLA molecules (the HLA-A3 supertype) that bind the A3 supermotif include A *0301, A *1101, A*3101, A*3301, and A *6801.

The invention further comprises an extended A3 supermotif, which is based on a detailed map of the secondary anchor requirements for binding to molecules of the HLA A3 supertype. The extended supermotif allows for the efficient prediction of cross-reactive binding of peptides to alleles of the A3 supertype by screening the native sequence of a particular antigen. It is also used to select analog options for peptides that bear amino acids defined by the primary supermotif. Analoging can comprise selection of desired residues at the primary and/or secondary anchor positions, thereby altering the binding affinity and immune modulating properties of the resulting analogs.

In order to identify A3 supermotif-bearing epitopes in a target antigen, a native protein sequence, e.g., a tumor-associated antigen, an infectious organism, or a donor tissue for transplantation, is screened using a means for computing, such as an intellectual calculation or a computer, to determine the presence of an A3 supermotif within the sequence. The information obtained from the analysis of native peptide can be used directly to evaluate the status of the native peptide or may be utilized subsequently to generate the peptide epitope.

The HLA-A24 motifs characterized by the presence in peptide ligands ofY, F, W, or M as a primary anchor residue in position 2, and F, L, I, or W as a primary anchor residue at the C-terminal position of the epitope (see, e.g., Kondo et al., *J: Immunol.* 155:4307-4312, 1995; and Kubo et al., *J. Immunol.* 152:3913-3924, 1994). The motif for HLA-A24.1 comprises from the N-terminus to the C-terminus a first conserved residue of Y, F or W at position 2 and a C terminal conserved residue of F, I, W, M or L. The first and second conserved residues are preferably separated by 6 to 7 residues.

The invention also comprises peptides comprising epitopes containing an HLA-B7 supermotif. Following the methods described in the copending applications noted above, certain peptides capable of binding at multiple HLA alleles which possess a common motif have been identified. The motifs of those peptides can be characterized as follows: N-XPXXXXXX(A,V,I,L,M)-C (SEQ ID NO:14618); N-XPXXXXXXX(A,V,I,L,M)-C (SEQ ID NO:14619); N-XPXXXXXX(F,W,Y)-C (SEQ ID NO:14620); and N-XPXXXXXXX(F,W,Y)-C (SEQ ID NO:14621). Motifs that are capable of binding at multiple alleles are referred to here as "supermotifs." The particular supermotifs above are specifically called "B7-like-supermotifs." The epitopes are 8-11 amino acids in length, often 9 or 10 amino acids in length, and comprise conserved residues of a proline at position 2 and an aromatic residue (e.g., Y, W, F) or hydrophobic residue (e.g., L, I, V, M, A) at the C-terminal position of the epitope. Peptides bearing an HLA-B7 supermotif bind to more than one HLA-B7 supertype family member. The corresponding family of HLA molecules that bind the B7 supermotif (i.e., the HLA-B7 supertype) is comprised of at least twenty six HLA-B proteins comprising at least: B*0702, B*0703, B*0704, B*0705, B*1508, B*3501, B*3502, B*3503, B*3504, B*3505, B*3506, B*3507, B*3508, B*5101, B*5102, B*5103, B*5104, B*5105, B*5301, B*5401, B*5501, B*5502, B*5601, B*5602, B*6701, and B*7801 (see, e.g., Sidney, et al., J: *Immunol.* 154:247, 1995; Barber, et al., Curro *Bioi.* 5:179, 1995; Hill, et aI., *Nature* 360:434, 1992; Ramannsee, et aI., *Immunogenetics* 41:178, 1995).

The present invention defines positions within a motif enabling the selection of peptides that will bind efficiently to more than one HLA-A, HLA-B or HLA-C alleles. Immunogenic peptides of the invention are typically identified using a computer to scan the amino acid sequence of a desired antigen for the presence of the supermotifs. Examples of antigens include viral antigens and antigens associated with cancer. An antigen associated with cancer is an antigen, such as a melanoma antigen, that is characteristic of (i.e., expressed by) cells in a malignant tumor but not normally expressed by healthy cells. Epitopes on a number of immunogenic target proteins can be identified using the sequence motifs described herein. Examples of suitable antigens particularly include hepatitis B core and surface antigens (HBVc, HBVs) hepatitis C antigens, Epstein-Barr virus antigens, and human immunodeficiency virus (HIV) antigens, and also include prostate specific antigen (PSA), melanoma antigens (e.g., MAGE-1), and human papilloma virus (HPV) antigens Lassa virus, p53 CEA, and Her2/neu; this list is not intended to exclude other sources of antigens.

Epitopes on a number of immunogenic target proteins, i.e., target antigens, have been identified. Examples of suitable antigens include tumor-associated antigens such as tyrosinase related proteins 1 and 2 (TRP 1 and TRP), which are frequently associated with melanoma; MART1; p53 and murine p53 (mp53), carcinoembryonic antigen (CEA), Her2/neu; and MAGE, including MAGE1, MAGE2, and MAGE3, which are expressed on a broad range of tumors; prostate cancer-associated antigens such as prostate specific antigen (PSA), human kallikrein (huK2), prostate specific membrane antigen (PSM), and prostatic acid phosphatase (PAP); antigens from viruses such as hepatitis B (e.g., HBV core and surface antigens (HBVc, HBVs)) hepatitis C antigens, Epstein-Barr virus, human immunodeficiency type-1 virus (HIV 1), Kaposi's sarcoma herpes (KSHV), human papilloma virus (HPV), influenza virus, and Lassa virus antigens, *Mycobacterium tuberculosis* (MT) antigens, trypanosome, e.g., *Trypansoma cruzi* (*T. cruzi*), antigens such as surface antigen (TSA), and malaria antigens.

The peptides are thus useful in pharmaceutical compositions for both in vivo and ex vivo therapeutic and diagnostic applications (e.g., tetramer reagents; Beckman Coulter).

The present invention also provides compositions comprising immunogenic peptides having binding motifs for non-A2 HLA alleles. The immunogenic peptides are preferably about 9 to 10 residues in length and comprise conserved residues at certain positions such as proline at position 2 and an aromatic residue (e.g., Y, W, F) or hydrophobic residue (e.g., L, I, V, M, or A) at the carboxy terminus. In particular, an advantage of the peptides of the invention is their ability to bind to two or more different HLA alleles.

Upon identification of epitopes comprising the HLA A3 supermotif, motif-bearing peptides can be isolated from a native sequence or synthesized. Accordingly, epitope-based vaccine compositions directed to a target antigen are prepared. These epitope-based vaccines preferably have enhanced, typically broadened, population coverage. The HLA-A3 supermotif-bearing epitopes comprising the vaccine composition preferably bind to more than one HLA A3 supertype molecule with a $K_D$ of less than 500 nM, and stimulate a CTL response in patients bearing an HLA A3 supertype allele to which the peptide binds.

Motif-bearing peptides may additionally be used as diagnostic, rather than immunogenic, reagents to evaluate an immune response. For example, an HLA-A3 supermotif-bearing peptide epitope may be used prognostically to analyze an immune response for the presence of specific CTL populations from patients who possess an HLA A3 supertype allele bound by the peptide epitope.

Certain specific embodiments of the invention are summarized below.

The present invention provides a method for identifying a peptide epitope predicted to bind two or more allele-specific HLA A3 supertype molecules. The peptide epitope of, for example, 8-15 amino acid residues, typically 8-11 amino acid residues, and preferably 9-10 amino acid residues, is identified in an amino acid sequence using a means for computing such as an intellectual calculation, preferably a computer, to determine the presence of an A3 supermotif within the sequence. As noted above, the A3 supermotif comprises a first primary amino acid anchor residue that is V, S, M, A, T, L, or I at position two from the amino terminal end of the epitope and a second primary amino acid anchor residue that is R or K at the carboxyl terminal end of the epitope. We note that the epitope may be comprised by a peptide or protein sequence larger than the epitope itself and still fall within the bounds of the invention.

Following identification, the peptide epitope may be synthesized such that the first residue of the motif is at the second position from the amino terminal residue of the peptide. Further, a peptide may be synthesized that comprises at least two epitopes, preferably at least two distinct epitopes.

The binding affinity of a peptide epitope in accordance with the invention for at least one HLA A3 supertype molecule is preferably determined. A preferred peptide epitope has a binding affinity of less than 500 nM for the at least one HLA A3 supertype molecule, and more preferably less than 50 nM.

Synthesis of an A3 supermotif-containing epitope may occur in vitro or in vivo. In a preferred embodiment, the peptide is encoded by a recombinant nucleic acid and expressed in a cell. The nucleic acid may encode one or more peptides, at least one of which is an epitope of the invention.

A peptide epitope of the invention, in the context of an HLA A-3 supertype molecule to which it binds, can be contacted, either in vitro or in vivo, with a cytotoxic T lymphocyte and thereby be used to elicit a T cell response in an HLA-diverse population.

A CTL response against a target antigen may be induced, preferably with peripheral blood mononuclear cells (PBMCs), from a patient that has an allele-specific HLA-A3 molecule that is a member of the A3 supertype. A CTL response can be induced by contacting the PBMCs with an A3 supermotif-bearing peptide epitope derived from the target antigen. Preferably, the supermotif-bearing epitope binds the HLA molecule with a $K_D$ of less than 500 nM. The CTLs or PBMCs may further be contacted with a helper T lymphocyte (HTL) peptide epitope, whereby both a CTL and an HTL response are induced. The CTL epitope and the HTL epitope may be comprised by a single peptide. Further, the HTL epitope may be lipidated, preferably with palmitic acid, and may be linked by a spacer molecule to the CTL epitope. The epitope may be expressed by a nucleotide sequence; in a preferred embodiment the nucleotide sequence is comprised by an attenuated viral host.

As will be apparent from the discussion below, other embodiments of methods and compositions are also within the scope of the invention. Further, novel synthetic peptides produced by any of the methods described herein are also part of the invention.

The present invention provides peptides and nucleic acids encoding them for use in vaccines and therapeutics. The invention provides methods of inducing a cytotoxic T cell response against a preselected antigen in, a patient, the method comprising contacting a cytotoxic T cell with an immunogenic peptide of the invention. The peptides of the invention may be derived from a number of antigens including viral antigens, tumor associated antigens, parasitic antigens, fungal antigens and the like. The methods of the invention can be carried out in vitro or in vivo. In a preferred embodiment the peptides are contacted with the cytotoxic T cell by administering to the patient a nucleic acid molecule comprising a sequence encoding the immunogenic peptide.

In one embodiment, the peptide is of between about 9 and about 15 residues and binds to at least two HLA-A3-like molecules with a dissociation constant of less than about 500 nM and induces a cytotoxic T cell response. The immunogenic peptides have a sequence of 9 residues comprising a binding motif from the N-terminus to the C-terminus as follows:

a first primary anchor residue at the second position selected from the group consisting of A, L, I, V, M, S and T and a second primary anchor residue at the ninth position selected from the group consisting of R and K; and one or more secondary anchor residues selected from the group consisting of Y, F, or W, at the third position, Y, F, or W at the sixth position, Y, F, or W at the seventh position, P at the eighth position, and any combination thereof.

The invention further provides immunogenic peptides which bind to HLAA*0301 gene products. These peptides comprise a nine residue binding motif from the N-terminus to the C-terminus as follows:

a first primary anchor residue at the second position selected from the group consisting of A, L, I, V, M, S and T and a second primary anchor residue at the ninth position selected from the group consisting of R and K; and one or more secondary anchor residues selected from the group consisting of R, H, or K at the first position, Y, F, or W, at the third position, P, R, H, K, Y, F, or W at the fourth position, A at the fifth position, Y, F, or W at the sixth position, P at the eighth position, and any combination thereof.

The invention also provides immunogenic peptides which bind to HLAA* 1101 gene products. These peptides comprise a nine residue binding motif from the N-terminus to the C-terminus as follows:

a first primary anchor residue at the second position selected from the group consisting of A, L, 1, V, M, S and T and a second primary anchor residue at the ninth position selected from the group consisting of R and K; and a secondary anchor residue selected from the group consisting of A at the first position, Y, F, or W, at the third position, Y, F, or W at the fourth position, A at the fifth position, Y, F, or W at the sixth position, Y, F, or W at the seventh position, P at the eighth position, and any combination thereof.

The present invention is directed to methods of modulating the binding of peptide epitopes to HLA class I molecules and HLA class II molecules. The invention includes a method of modifying binding of an original peptide epitope that bears a motif correlated with binding to an HLA molecule, said motif comprising at least one primary anchor position, said at least one primary anchor position having specified therefore primary anchor amino acid residues consisting essentially of two or more residues, said method comprising exchanging the primary anchor residue of the original peptide epitope for another primary anchor residue, with the proviso that the original primary anchor residue is not the same as the exchanged primary anchor residue. A preferred embodiment of the invention includes a method where the original primary anchor residue is a less preferred residue, and the exchanged residue is a more preferred residue.

One alternative embodiment of the invention includes a method of modifying binding of an original peptide epitope that bears a motif correlated with binding to an HLA molecule, said motif comprising at least one primary anchor position having specified therefore at least one primary anchor residue, and at least one secondary anchor position having specified therefore at least one secondary residue, said method comprising exchanging the secondary anchor residue of the original peptide epitope for another secondary anchor residue, with the proviso that the original secondary anchor residue is different than the exchanged amino acid residue. In some cases the original secondary residue is a deleterious residue and the exchanged residue is a residue other than a deleterious residue and/or the original secondary anchor residue is a less preferred residue and the exchanged residue is a more preferred residue.

Another alternative embodiment is a method comprising modifying binding of an epitope that bears an HLA B7 supermotif of a primary anchor amino acid residue P at a position two and a primary anchor amino acid residue which is V, I, L, F, M, W, Y or A at a carboxyl terminus, wherein said residues are separated by at least five residues and wherein the amino acid positions are numbered consecutively from an amino to carboxyl orientation, said method comprising:

(a) exchanging a primary anchor residue at the carboxyl terminus for a residue which is V, I, L, F, M, W, Y or A, with the proviso that the original primary anchor residue at the carboxyl terminus is not the same as the exchanged residue.

An alternative method of this embodiment includes a method wherein the primary anchor residue at the carboxyl terminus is separated from the primary anchor residue at position two by six residues. The method further comprises:

(a) exchanging a secondary anchor residue at position one for a residue which is F, Y, W, L, I, V, or M with the proviso that the original secondary anchor residue at positions one is not the same as the exchanged residue; or (b) exchanging a secondary anchor residue at position three and/or eight for a residue which is F, Y or W with the proviso that the original secondary anchor residue at positions three, and/or eight is not the same as the exchanged residue.

A further alternative embodiment is a method comprising modifying binding of an epitope that bears an HLA B7 supermotif of a primary anchor amino acid residue P at a position two and a primary anchor amino acid residue which is V, I, L, F, M, W, Y or A at a carboxyl terminus, wherein said residues are separated by at least six residues and wherein the amino acid positions are numbered consecutively from an amino to carboxyl orientation, said method comprising:

(a) exchanging a secondary anchor residue at position one for a residue which is F, Y, W, L, I, V, or M with the proviso that the original secondary anchor residue at positions one is not the same as the exchanged residue; or (b) exchanging a secondary anchor residue at position three and/or eight for a residue which is F, Y or W with the proviso that the original secondary anchor residue at positions three, and/or eight is not the same as the exchanged residue;

(c) performing steps (a) and (b).

Another embodiment of the invention comprises a method of modifying binding of a peptide epitope that bears an HLA A2 supermotif of a primary anchor amino acid residue which is L, I, V, M, A, T, or Q at a position two and a primary anchor amino acid residue which is L, I, V, M, A, or T at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is L, I, V, M, A, T, or Q with the proviso that the original primary anchor residue at position two is not the same as the exchanged residue at position two; or (b) exchanging a primary anchor residue at the carboxyl terminus of the epitope for a residue which is L, I, V, M, A, or T with the proviso that the original primary anchor residue at the carboxyl terminus is not the same as the exchanged residue; or, (c) performing steps (a) and (b).

Also included is a method comprising modifying binding of a peptide epitope that bears an HLA A3 supermotif of a primary anchor amino acid residue which is V, S, M, A, T, L, or I at a position two and a primary anchor amino acid residue which is R or K at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is V, S, M, A, T, L, or I with the proviso that the original primary anchor residue at position two is not the same as the exchanged residue at position two; or (b) exchanging a primary anchor residue at the carboxyl terminus of the epitope for a residue which is R or K with the proviso that the original primary anchor residue at the carboxyl terminus is not the same as the exchanged residue; or, (c) performing steps (a) and (b).

The preceding embodiment may be a method where the primary anchor residue at the carboxyl terminus is separated from the primary anchor residue at position two by six residues, said method comprising:

(a) exchanging an original secondary anchor residue at position three, six or seven which is Y, F or W, with the proviso that the original secondary anchor residue at position three, six or seven, respectively, is not the same as the exchanged residue; or (b) exchanging an original secondary anchor residue at position eight for a residue which is P with the proviso that the original secondary anchor residue at position eight is not P.

Another embodiment of the invention includes a method comprising modifying binding of a peptide epitope that bears an HLA A3 supermotif of a primary anchor amino acid residue which is V, S, M, A, T, L, or I at a position two and a primary anchor amino acid residue which is R or K at a carboxyl terminus, wherein said residues are separated by six residues, and wherein the amino acid positions are numbered consecutively from an amino to carboxyl orientation, said method comprising:

(a) exchanging an original secondary anchor residue at position three, six or seven which is Y, F or W, with the proviso that the original secondary anchor residue at position three, six or seven, respectively, is not the same as the exchanged residue; or (b) exchanging an original secondary anchor residue at position eight for a residue which is P with the proviso that the original secondary anchor residue at position eight is not P; or (c) where the epitope bears at least one deleterious residue indicated for said supermotif in Table 138, exchanging said deleterious residue for a residue which is not deleterious; or (d) performing two or more of steps (a)-(c).

Alternative embodiments of the invention include a method comprising modifying binding of a peptide epitope that bears an HLA A3 motif of a primary anchor amino acid residue which is A, L, I, V, M, S, T, F, C, G, or D at a position two and a primary anchor amino acid residue which is R, K, Y, H, F, or A at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is A, L, I, V, M, S, T, F, C, G, or D with the proviso that the original primary anchor residue at position two is not the same as the exchanged residue at position two; or (b) exchanging a primary anchor residue at the carboxyl terminus of the epitope for a residue which is R, K, Y, H, F, or A with the proviso that the original primary anchor residue at the carboxyl terminus is not the same as the exchanged residue; or, (c) performing steps (a) and (b).

Another embodiment of the invention is a method comprising modifying binding of a peptide epitope that bears an HLA A3 motif of a primary anchor amino acid residue which is A, L, I, V, M, S, T, F, C, G, or D at a position two and a primary anchor amino acid residue which is R, K, Y, H, F, or A at a carboxyl terminus, wherein said residues are separated by six residues, and wherein the amino acid positions are numbered consecutively from an amino to carboxyl orientation, said method comprising:

(a) exchanging an original secondary anchor residue at position one for a residue which is R, H, or K with the proviso that the original secondary anchor residue at position one is not the same as the exchanged residue of position one; or (b) exchanging a secondary anchor residue at position three for a residue which is Y, F or W with the proviso that the original secondary anchor residue at position three is not the same as the exchanged residue of position three; or, (c) exchanging an original secondary anchor residue at position four for a residue which is P, R, H, K, Y, F, or W with the proviso that the original secondary anchor residue at position four is not the same as the exchanged residue at position four; or (d) exchanging an original secondary anchor residue at position five for a residue which is A with the proviso that the original secondary anchor residue at position five is not A; or (e) exchanging an original secondary anchor residue at position six for a residue which is Y, F or W with the proviso that the original secondary anchor residue at position six is not the same as the exchanged residue at position six; or (f) exchanging an original secondary anchor residue at position eight for a residue which is P with the proviso that the original secondary anchor residue at position eight is not P; or (g) where the epitope bears at least one deleterious residue indicated for said motif in Table 138, exchanging said deleterious residue for a residue which is not a deleterious residue; or (h) performing two or more of steps (a)-(g).

Further, the invention includes a method comprising modifying binding of a peptide epitope that bears an HLA A11 motif of a primary anchor amino acid residue which is V, T, M, L, I, S, A, G, N, C, D, or F at a position two and a primary anchor amino acid residue which is K, R, Y, or H at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is V, T, M, L, I, S, A, G, N, C, D or F with the proviso that the original primary anchor residue at position two is not the same as the exchanged residue at position two; or (b) exchanging a primary anchor residue at the carboxyl terminus of the epitope for a residue which is K, R, Y, or H with the proviso that the original primary anchor residue at the carboxyl terminus is not the same as the exchanged residue; or, (c) performing steps (a) and (b).

An alternative method comprises modifying binding of a peptide epitope that bears an HLA A11 motif of a primary anchor amino acid residue which is V, T, M, L, I, S, A, G, N, C, D or F at a position two and a primary anchor amino acid residue which is K, R, Y, or H at a carboxyl terminus, wherein said residues are separated by six residues, and wherein the amino acid positions are numbered consecutively from an amino to carboxyl orientation, said method comprising:

(a) exchanging an original secondary anchor residue at position one for a residue which is A with the proviso that the original secondary anchor residue at position one is not the same as the exchanged residue; or (b) exchanging a secondary anchor residue at position three, four, six, or seven for a residue which is Y, F or W with the proviso that the original secondary anchor residue at position three, four, six or seven respectively is not the same as the exchanged residue at such position; or (c) exchanging a secondary residue at position five for a residue which is A with the proviso that the original secondary anchor residue at position five is not the same as the exchanged residue at position five; or (d) exchanging a secondary anchor residue at position eight for a residue which is P with the proviso that the original secondary anchor residue at position eight is not the same as the exchanged residue at position eight; or (e) where the epitope bears at least one deleterious residue indicated for said motif in Table 138, exchanging said deleterious residue for a residue which is not a deleterious residue; or (f) performing two or more of steps (a)-(e).

An additional embodiment of the invention comprises a method for modifying binding of a peptide epitope that bears an HLA A2.1 motif of a primary anchor amino acid residue which is L, M, V, Q, I, A, or T at a position two and a primary anchor amino acid residue which is V, L, I, M, A, or T at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is L, M, V, Q, I, A, or T with the proviso that the original primary anchor residue at position two is not the same as the exchanged residue at position two; or (b) exchanging a primary anchor residue at the carboxyl terminus of the epitope for a residue which is V, L, I, M, A, or T with the proviso that the original primary anchor residue at the carboxyl terminus is not the same as the exchanged residue; or, (c) performing steps (a) and (b).

An alternative embodiment of the invention comprises a method of modifying binding of a peptide epitope that bears an HLA A2.1 motif of a primary anchor amino acid residue which is L, M, V, Q, I, A, or T at a position two and a primary anchor amino acid residue which is V, L, I, M, A, or T at a carboxyl terminus, wherein said residues are separated by six residues, and wherein the amino acid positions are numbered consecutively from an amino to carboxyl orientation, said method comprising:

(a) exchanging an original secondary anchor residue at positions one, three, and/or five for a residue which is Y, F or W with the proviso that the original secondary anchor residue at positions one, three, and/or five respectively is not the same as the exchanged residue at such a position; or (b) exchanging an original secondary anchor residue at position four for a residue which is S, T or C with the proviso that the original secondary anchor residue at position four is not the same as the exchanged residue at position four; or (c) exchanging an original secondary anchor residue at position seven for a residue which is A with the proviso that the original secondary anchor residue at position seven is not A; or (d) exchanging a secondary anchor residue at position eight for a residue which is P with the proviso that the original secondary anchor residue at position eight is not P; or (e) where the epitope bears at least one deleterious residue indicated for said motif in Table 138, exchanging said deleterious residue for a residue which is not a deleterious residue; or (f) performing two or more of steps (a)-(e).

Further, an additional embodiment of the invention comprises a method of modifying binding of a peptide epitope that bears an HLA A2.1 motif of a primary anchor amino acid residue which is L, M, V, Q, I, A, or T at a position two and a primary anchor amino acid residue which is V, L, I, M, A, or T at a carboxyl terminus, wherein said residues are separated by seven residues, and wherein the amino acid positions are numbered consecutively from an amino to carboxyl orientation, said method comprising:

(a) exchanging an original secondary anchor residue at position one for a residue which is A, Y, F, or W with the proviso that the original secondary anchor residue at position one is not the same as the exchanged residue; or (b) exchanging an original secondary anchor residue at position three for a residue which is L, V, I, or M with the proviso that the original secondary anchor residue at position three is not the same as the exchanged residue; or (c) exchanging a secondary anchor residue at positions four and/or six for a residue which is G with the proviso that the original secondary anchor residue at position four and/or six respectively is not G; or (d) exchanging an original secondary anchor residue at position eight for a residue which is F, Y, W, L, V, I or M with the proviso that the original secondary anchor residue at position eight is not the same as the exchanged residue; or (e) where the epitope bears at least one deleterious residue indicated for said motif in Table 138, exchanging said deleterious residue for a residue which is not a deleterious residue; or (f) performing two or more of steps (a)-(e).

Another embodiment of the invention comprises a method of modifying binding of a peptide epitope that bears an HLA A24 motif of a primary anchor amino acid residue which is Y, F, W or M at a position two and a primary anchor amino acid residue which is F, L, I, or W at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is Y, F, W or M with the proviso that the original primary anchor residue at position two is not the same as the exchanged residue; or (b) exchanging a primary anchor residue at the carboxyl terminus for a residue which is F, L, I, or W with the proviso that the original primary anchor residue at the carboxyl terminus is not the same as the exchanged residue; or, (c) performing steps (a) and (b).

A further embodiment comprises a method of modifying binding of a peptide epitope that bears an HLA A24 motif of a primary anchor amino acid residue which is Y, F, W or M at a position two and a primary anchor amino acid residue which is F, L, I, or W at a carboxyl terminus, wherein said residues are separated by six residues, and wherein the amino acid positions are numbered consecutively from an amino to carboxyl orientation, said method comprising:

(a) exchanging an original secondary anchor residue at position one for a residue which is Y, F, W, R, H, or K with the proviso that the original secondary anchor residue at position one is not the same as the exchanged residue at position one; or (b) exchanging a secondary anchor residue at position four for a residue which is S, T, or C with the proviso that the original secondary anchor residue at position four is not the same as the exchanged residue; or (c) exchanging a secondary anchor residue at positions seven and/or eight for a residue which is Y, F or W with the proviso that the original secondary anchor residue at positions seven and/or eight respectively is not the same as the exchanged residue at position seven or eight; or (d) where the epitope bears at least one deleterious residue indicated for said motif in Table 138, exchanging said deleterious residue for a residue which is not a deleterious residue; or (e) performing two or more of steps (a)-(d).

An alternative embodiment of the invention includes a method comprises modifying binding of a peptide epitope that bears an HLA A24 motif of a primary anchor amino acid residue which is Y, F, W, or M at a position two and a primary anchor amino acid residue which is F, L, I, or W at a carboxyl terminus, wherein said residues are separated by seven residues, and wherein the amino acid positions are numbered consecutively from an amino to carboxyl orientation, said method comprising:

(a) exchanging a secondary anchor residue at position four for a residue which is P with the proviso that the original secondary anchor residue at position four is not P; or (b) exchanging an original secondary anchor residue at position five for a residue which is Y, F, W or P with the proviso that the original secondary anchor residue at position five is not the same as the exchanged residue at position five; or (c) exchanging a secondary anchor residue at position seven for a residue which is P with the proviso that the original secondary anchor residue at position seven is not the same as the exchanged residue at position seven; or (d) where the epitope bears at least one deleterious residue indicated for said motif in Table 138, exchanging said deleterious residue for a residue which is not a deleterious residue; or (e) performing two or more of steps (a)-(d).

An alternative embodiment of the invention includes a method comprising modifying binding of a peptide epitope that bears an HLA A1 motif of a primary anchor amino acid residue which is S, T, or M at a position two and a primary anchor amino acid residue which is Y at a carboxyl terminus, wherein said residues are separated by at least five residues, and wherein the amino acid positions are numbered consecutively from an amino to carboxyl orientation, said method comprising:

(a) exchanging an original primary anchor residue at position two for a residue which is S, T, or M with the proviso that the original primary anchor residue at position two is not the same as the exchanged residue at position two.

Another embodiment of the invention comprises a method of modifying binding of a peptide epitope that bears an HLA A1 motif of a primary anchor amino acid residue which is S, T, or M at a position two and a primary anchor amino acid residue which is Y at a carboxyl terminus, wherein said residues are separated by six residues, and wherein the amino acid positions are numbered consecutively from an amino to carboxyl orientation, said method comprising:

(a) exchanging a secondary anchor residue at position one for a residue which is G, F, W, or Y with the proviso that the original secondary anchor residue at position one is not the same as the exchanged residue at position one; or (b) exchanging an original secondary anchor residue at position three for a residue which is D, E, or A with the proviso that the original secondary anchor residue at position three is not the same as the exchanged residue at position three; or (c) exchanging a secondary anchor residue at position four and/or position eight for a residue which is Y, F, or W with the proviso that the original secondary anchor residue at position four and/or eight is not the same as the exchanged residue at position four and/or eight; or (d) exchanging a secondary anchor residue at position six for a residue which is P with the proviso that the original secondary anchor residue at position six is not P; or (e) exchanging a secondary anchor residue at position seven for a residue which is D, E, Q, or N with the proviso that the original secondary anchor residue at position seven is not the same as the exchanged residue at position seven; or (f) where the epitope bears at least one deleterious residue indicated for said motif in Table 138, exchanging said deleterious residue for a residue which is not a deleterious residue; or (e) performing two or more of steps (a)-(f).

An additional embodiment of the invention comprises a method of modifying binding of a peptide epitope that bears an HLA A1 motif of a primary anchor amino acid residue which is S, T, or M at a position two and a primary anchor amino acid residue which is Y at a carboxyl terminus, wherein said residues are separated by seven residues, and wherein the amino acid positions are numbered consecutively from an amino to carboxyl orientation, said method comprising:

(a) exchanging a secondary anchor residue at position one for a residue which is Y, F, or W with the proviso that the original secondary anchor residue at position one is not the same as the exchanged residue at position one; or (b) exchanging an original secondary anchor residue at position three for a residue which is D, E, A, Q, or N with the proviso that the original secondary anchor residue at position three is not the same as the exchanged residue at position three; or (c) exchanging a secondary anchor residue at position four for a residue which is A with the proviso that the original secondary anchor residue at position four is not A; or (d) exchanging a secondary anchor residue at position five for a residue which is Y, F, W, Q, or N with the proviso that the original secondary anchor residue at position five is not the same as the exchanged residue at position five; or (e) exchanging a secondary anchor residue at position seven for a residue which is P, A, S, T, or C with the proviso that the original secondary anchor residue at position seven is not the same as the exchanged residue at position seven; or (f) exchanging a secondary anchor residue at position eight for a residue which is G, D, or E with the proviso that the original secondary anchor residue at position eight is not the same as the exchanged residue at position seven; or (g) exchanging a secondary anchor residue at position nine for a residue which is P with the proviso that the original secondary anchor residue at position nine is not P; or (h) where the epitope bears at least one deleterious residue indicated for said motif in Table 138, exchanging said deleterious residue for a residue which is not a deleterious residue; or (i) performing two or more of steps (a)-(h).

Further, a method of the invention comprises modifying binding of a peptide epitope that bears an HLA A1 motif of a primary anchor amino acid residue which is D, E, A, or S at a position three and a primary anchor amino acid residue which is Y at a carboxyl terminus, wherein said residues are separated by at least five residues, and wherein the amino acid positions are numbered consecutively from an amino to carboxyl orientation, said method comprising:

(a) exchanging an original primary anchor residue at position three for a residue which is D, E, A, or S with the proviso that the original primary anchor residue at position three is not the same as the exchanged residue at position three.

Another embodiment of the invention comprises a method of modifying binding of a peptide epitope that bears an HLA A1 motif of a primary anchor amino acid residue which is D, E, A, or S at a position three and a primary anchor amino acid residue which is Y at a carboxyl terminus, wherein said residues are separated by five residues, and wherein the amino acid positions are numbered consecutively from an amino to carboxyl orientation, said method comprising:

(a) exchanging a secondary anchor residue at position one for a residue which is G, R, H, or K with the proviso that the original secondary anchor residue at position one is not the same as the exchanged residue at position one; or (b) exchanging an original secondary anchor residue at position two for a residue which is A, S, T, C, L, I, V, or M with the proviso that the original secondary anchor residue at position two is not the same as the exchanged residue at position two; or (c) exchanging a secondary anchor residue at position four for a residue which is G, S, T, or C with the proviso that the original secondary anchor residue at position four is not the same as the exchanged residue at position four; or (d) exchanging a secondary anchor residue at position six for a residue which is A, S, T, or C with the proviso that the original secondary anchor residue at position six is not the same as the exchanged residue at position six; or (e) exchanging a secondary anchor residue at position seven for a residue which is L, I, V, or M with the proviso that the original secondary anchor residue at position seven is not the same as the exchanged residue at position seven; or (f) exchanging a secondary anchor residue at position eight for a residue which is D or E with the proviso that the original secondary anchor residue at position eight is not the same as the exchanged residue at position eight; or (g) where the epitope bears at least one deleterious residue indicated for said motif in Table 138, exchanging said deleterious residue for a residue which is not a deleterious residue; or (h) performing two or more of steps (a)-(g).

An alternative method of the invention comprises modifying binding of a peptide epitope that bears an HLA A1 motif of a primary anchor amino acid residue which is D, E, A, or S at a position three and a primary anchor amino acid residue which is Y at a carboxyl terminus, wherein said residues are separated by six residues, and wherein the amino acid positions are numbered consecutively from an amino to carboxyl orientation, said method comprising:

(a) exchanging a secondary anchor residue at position one, position five, and/or position nine for a residue which is Y, F, or W with the proviso that the original secondary anchor residue at position one, position five, and/or position nine is not the same as the exchanged residue at position one, position five, or position nine; or (b) exchanging an original secondary anchor residue at position two for a residue which is S, T, C, L, I, V, or M with the proviso that the original secondary anchor residue at position two is not the same as the exchanged residue at position two; or (c) exchanging a secondary anchor residue at position four for a residue which is A with the proviso that the original secondary anchor residue at position four is not A; or (d) exchanging a secondary anchor residue at position seven for a residue which is P or G with the proviso that the original secondary anchor residue at position seven is not the same as the exchanged residue at position seven; or (e) exchanging a secondary anchor residue at position eight for a residue which is G with the proviso that the original secondary anchor residue at position eight is not G; or (f) where the epitope bears at least one deleterious residue indicated for said motif in Table 138, exchanging said deleterious residue for a residue which is not a deleterious residue; or (g) performing two or more of steps (a)-(f).

An additional embodiment of the invention comprises a method of modifying binding of an epitope that bears an HLA DR motif or supermotif of a primary anchor amino acid residue which is L, I, V, M, F, W, or Y at a position one and a primary anchor amino acid residue which is C, S, T, P, A, L, I, V, or M at a position six, wherein said residues are separated by 4 residues and wherein the amino acid positions are numbered consecutively from an amino to carboxyl orientation, said method comprising:

(a) exchanging an original primary anchor residue at position one for a residue which is L, I, V, M, F, W, or Y, with the proviso that the original primary anchor residue at position one is not the same as the exchanged residue; or (b) exchanging an original primary anchor residue at position six for a residue which is C, S, T, P, A, L, I, V, or M, with the proviso that the original primary anchor residue at position six is not the same as the exchanged residue; or (c) performing steps (a) and (b).

Alternative embodiments of the invention also include a method comprising of modifying binding of a peptide epitope that bears an HLA DR4 motif of a primary anchor amino acid residue which is F, M, Y, L, I, V, or W at a position one and a primary anchor amino acid residue which is V, S, T, C, P, A, L, I, or M at a position six, wherein said residues are separated by four residues, and wherein the amino acid positions are numbered consecutively from an amino to carboxyl orientation, said method comprising:

(a) exchanging an original secondary anchor residue at position two for a residue which is M with the proviso that the original secondary anchor residue at position two is not M; or (b) exchanging an original secondary anchor residue at position three for a residue which is T with the proviso that the original secondary anchor residue at position three is not T; or (c) exchanging an original secondary anchor residue at position five for a residue which is I with the proviso that the original secondary anchor residue at position five is not I; or (d) exchanging an original secondary anchor residue at position seven for a residue which is M or H with the proviso that the original secondary anchor residue at position seven is not the same as the exchanged residue at position seven; or (e) where the epitope bears at least one deleterious residue indicated for said motif in Table 139, exchanging said deleterious residue for a residue which is not a deleterious residue; or (f) performing two or more of steps (a)-(e).

An additional embodiment of the invention comprises a method of modifying binding of a peptide epitope that bears an HLA DR1 motif of a primary anchor amino acid residue which is F, M, Y, L, I, V, or W at a position one and a primary anchor amino acid residue which is V, M, A, T, S, P, L, or I at a position six, wherein said residues are separated by four residues, and wherein the amino acid positions are numbered consecutively from an amino to carboxyl orientation, said method comprising:

(a) exchanging an original secondary anchor residue at position four for a residue which is P, A, M, or Q with the proviso that the original secondary anchor residue at position four is not the same as the exchanged residue at position four.

(b) exchanging an original secondary anchor residue at position seven for a residue which is M with the proviso that the original secondary anchor residue at position seven is not M; or (c) exchanging an original secondary anchor residue at position nine for a residue which is A, V, or M with the proviso that the original secondary anchor residue at position nine is not the same as the exchanged residue at position nine; or (d) where the epitope bears at least one deleterious residue indicated for said motif in Table 139, exchanging said deleterious residue for a residue which is not a deleterious residue; or (e) performing two or more of steps (a)-(d).

Further, an embodiment of the invention comprises a method of modifying binding of a peptide epitope that bears an HLA DR7 motif of a primary anchor amino acid residue which is F, M, Y, L, I, V, or W at a position one and a primary anchor amino acid residue which is I, V, M, S, A, C, T, P, or L at a position six, wherein said residues are separated by four residues, and wherein the amino acid positions are numbered consecutively from an amino to carboxyl orientation, said method comprising:

(a) exchanging an original secondary anchor residue at position two and/or position seven for a residue which M with the proviso that the original secondary anchor residue at position two and/or seven is not M;

(b) exchanging an original secondary anchor residue at position three for a residue which is W with the proviso that the original secondary anchor residue at position three is not M; or (c) exchanging an original secondary anchor residue at position four for a residue which is A with the proviso that the original secondary anchor residue at position four is not A; or (d) exchanging an original secondary anchor residue at position nine for a residue which is I or V with the proviso that the original secondary anchor residue at position nine is not the same as the exchanged residue; or (e) where the epitope bears at least one deleterious residue indicated for said motif in Table 139, exchanging said deleterious residue for a residue which is not a deleterious residue; or (f) performing two or more of steps (a)-(e).

An additional embodiment of the invention comprises a method of modifying binding of an epitope that bears an HLA DR3 motif of a primary anchor amino acid residue which is L, I, V, M, F, or Y at a position one and a primary anchor amino acid residue which is D at a position four, wherein said residues are separated by two residues and wherein the amino acid positions are numbered consecutively from an amino to carboxyl orientation, said method comprising:

(a) exchanging an original primary anchor residue at position one for a residue which is L, I, V, M, F, or Y, with the proviso that the original primary anchor residue at position one is not the same as the exchanged residue.

Another embodiment of the invention comprises a method of modifying binding of an epitope that bears an HLA DR3 motif of a primary anchor amino acid residue which is L, I, V, M, F, A, or Y at a position 1 and a primary anchor amino acid residue which is D, N, Q, E, S, or T at a position four, and a primary anchor amino acid residue which is K, R, or H at a position six, wherein the amino acid positions are numbered consecutively from an amino to carboxyl orientation, said method comprising:

(a) exchanging an original primary anchor residue at position one for a residue which is L, I, V, M, F, A, or Y with the proviso that the original primary anchor residue at position one is not the same as the exchanged residue; or (b) exchanging an original primary anchor residue at position four for a residue which is D, N, Q, E, S, or T with the proviso that the original primary anchor residue at position four is not the same as the exchanged residue; or (c) exchanging an original primary anchor residue at position six for a residue which is K, R, or H with the proviso that the original primary anchor residue at position six is not the same as the exchanged residue; or (d) performing two or more of steps (a)-(c).

Lastly, an additional embodiment of the invention comprises a method of modifying an epitope to alter its stability by exchanging a C residue for a residue which is α-amino butyric acid.

As will be apparent from the discussion below, other methods and embodiments are also contemplated. Further, novel synthetic peptides produced by any of the methods described herein are also part of the invention.

DEFINITIONS

The following definitions are provided to enable one of ordinary skill in the art to understand some of the preferred embodiments of invention disclosed herein. It is understood, however, that these definitions are exemplary only and should not be used to limit the scope of the invention as set forth in the claims. Those of ordinary skill in the art will be able to construct slight modifications to the definitions below and utilize such modified definitions to understand and practice the invention disclosed herein. Such modifications, which would be obvious to one of ordinary skill in the art, as they may be applicable to the claims set forth below, are considered to be within the scope of the present invention. If a definition set forth in this section is contrary to or otherwise inconsistent with a definition set forth in patents, published patent applications and other publications and sequences from GenBank and other data bases that are herein incorporated by reference, the definition set forth in this section prevails over the definition that is incorporated herein by reference.

An "HLA supertype or family", as used herein, describes sets of HLA molecules grouped on the basis of shared peptide-binding specificities, rather than serologic supertypes based on shared antigenic determinants. HLA class I molecules that share somewhat similar binding affinity for peptides bearing certain amino acid motifs are grouped into HLA supertypes. The terms "HLA superfamily," "HLA supertype family," "HLA family," and "HLA xx-like molecules" (where xx denotes a particular HLA type), are synonyms.

An "HLA-A3-like" HLA molecule (also referred to as an allele as used herein refers to a group of HLA molecules encoded by HLA-A alleles that share an overlapping peptide binding motif with the HLA-A3 supermotif disclosed here. The 9 residue supermotif shared by these alleles comprises the following primary anchor residues: A, L, I, V, M, S, or, T at position 2 and positively charged residues, such as R and K at position 9 (the C-terminus in 9-mers). Exemplary members of this family, identified by either serology or DNA typing, include: A3 (A*0301), A11 (A*1101, A31 (A*3101), A*3301, and A*6801. Other members of the family include A34 A66 and A*7401. As explained in detail below, binding to each of the individual alleles can be finely modulated by substitutions at the secondary anchor positions.

The "HLA-A2-like" supertype is characterized by a preference for peptide ligands with small or aliphatic amino acids (L,1, V, M A and T at position 2 and the C-terminus. The family is comprised of at least eight HLA-A alleles (A*0201, A*0202, A*0203, A*0204, A*0205, A*0206, A*6802, and A*6901).

The "HLA-B7-like" supertype is comprised of products from at least a dozen HLA-B alleles (B7, B*3501-3, B51 B*5301 B*5401 B*5501 B*5502 B*5601 BB*6701, and B*7801) (Sidney, et al., *J Immunol* 154:247 (1995); Barber, et al., *Curr Biol* 5:179 (1995); Hill, et al., *Nature* 360:434 (1992); Rammensee et al. *Immunogeneties* 41:178 (1995)), and is characterized by molecules that recognize peptides bearing proline in position 2 and hydrophobic or aliphatic amino acids (L, I, V, W, and Y) at their C-terminus.

As used herein, the term "$IC_{50}$" refers to the concentration of peptide in a binding assay at which 50% inhibition of binding of a reference peptide is observed. Depending on the conditions in which the assays are run (i.e., limiting MHC proteins and labeled peptide concentrations), these values may approximate $K_D$ values. It should be noted that $IC_{50}$ values can change, often dramatically, if the assay conditions are varied, and depending on the particular reagents used (e.g., HLA preparation, etc.). For example, excessive concentrations of HLA molecules will increase the apparent measured $IC_{50}$ of a given ligand.

Alternatively, binding is expressed relative to a reference peptide. As a particular assay becomes more, or less, sensitive, the $IC_{50}$'s of the peptides tested may change somewhat. However, the binding relative to the reference peptide will not change. For example, in an assay run under conditions such that the $IC_{50}$ of the reference peptide increases 10-fold, the $IC_{50}$ values of the test peptides will also shift approximately 10-fold. Therefore, to avoid ambiguities, the assessment of whether a peptide is a good, intermediate, weak, or negative binder is generally based on its $IC_{50}$, relative to the $IC_{50}$ of a standard peptide. The binding may be reported as a ratio or the ratio may be used to normalize the $IC_{50}$ value as described in Example 1.

As used herein, "high affinity" with respect to peptide binding to HLA class I molecules is defined as binding with an $K_D$ (or $IC_{50}$) of less than 50 nM. "Intermediate affinity" is binding with a $K_D$ (or $IC_{50}$) of between about 50 and about 500 nM. As used herein, "high affinity" with respect to binding to HLA class II molecules is defined as binding with an $K_D$ (or $IC_{50}$) of less than 100 nM. "Intermediate affinity" is binding with a $K_D$ (or $IC_{50}$) of between about 100 and about 1000 nM. Assays for determining binding are described in detail, e.g., in PCT publications WO 94/20127 and WO 94/03205.

Binding may also be determined using other assay systems including those using: live cells (e.g., Ceppellini et al., *Nature* 339:392 (1989); Christnick et al., *Nature* 352:67 (1991); Busch et al., *Int. Immunol.* 2:443 (1990); Hill et al., J *Immunol.* 147:189 (1991); del Guercio et al., J *Immunol.* 154:685 (1995)), cell free systems using detergent lysates (e.g., Cerundolo et al., J *Immunol.* 21:2069 (1991)), immobilized purified MHC (e.g., Hill et al., J *Immunol.* 152, 2890 (1994); Marshall et al., J *Immunol.* 152:4946 (1994)), ELISA systems (e.g., Reay et al., *EMBO* J 11:2829 (1992)), surface plasmon resonance (e.g., Khilko et al., J *Biol. Chem.* 268:15425 (1993)); high flux soluble phase assays (Hammer et al., *J. Exp. Med.* 180:2353 (1994)), and measurement of class I MHC stabilization or assembly (e.g., Ljunggren et al., *Nature* 346:476 (1990); Schumacher et al., *Cell* 62:563 (1990); Townsend et al., *Cell* 62:285 (1990); Parker et al., J *Immunol.* 149:1896 (1992))

The relationship between binding affinity for MHC class I molecules and immunogenicity of discrete peptide epitopes has been analyzed in two different experimental approaches (Sette, et al., *J. Immunol.,* 153:5586-92 (1994)). In the first approach, the immunogenicity of potential epitopes ranging in MHC binding affinity over a 10,000-fold range was analyzed in HLA-A*0201 transgenic mice. In the second approach, the antigenicity of approximately 100 different hepatitis B virus (HBV)-derived potential epitopes, all carrying A*0201 binding motifs, was assessed by using PBL of acute hepatitis patients. In both cases, it was found that an affinity threshold of approximately 500 nM (preferably 500 nM or less) determines the capacity of a peptide epitope to elicit a CTL response. These data correlate well with class I binding affinity measurements of either naturally processed peptides or previously described T cell epitopes. These data indicate the important role of determinant selection in the shaping of T cell responses.

The term "peptide" is used interchangeably with "oligopeptide" in the present specification to designate a series of residues, typically L-amino acids, connected one to the other typically by peptide bonds between the alpha-amino and carbonyl groups of adjacent amino acids. In certain embodiments, the oligopeptides of the invention are less than about 15 residues in length and usually consist of between about 8 and about 11 residues, preferably 9 or 10 residues. In certain embodiments, the oligopeptides are generally less than 250 amino acids in length, and can be less than 150, 100, 75, 50, 25, or 15 amino acids in length. Further, an oligopeptide of the invention can be such that it does not comprise more than 15 contiguous amino acids of a native antigen. The preferred CTL-inducing peptides of the invention are 13 residues or less in length and usually consist of between about 8 and about 11 residues, preferably 9 or 10 residues.

"Synthetic peptide" refers to a peptide that is not naturally occurring, but is man-made using such methods as chemical synthesis or recombinant DNA technology.

The nomenclature used to describe peptide compounds follows the conventional practice wherein the amino group is presented to the left (the N-terminus) and the carboxyl group to the right (the C-terminus) of each amino acid residue. In the formulae representing selected specific embodiments of the present invention, the amino- and carboxyl-terminal groups, although not specifically shown, are in the form they would assume at physiologic pH values, unless otherwise specified. In the amino acid structure formulae, each residue is generally represented by standard three letter or single letter designations. The L-form of an amino acid residue is represented by a capital single letter or a capital first letter of a three-letter symbol, and the D-form for those amino acids having D-forms is represented by a lower case single letter or a lower case three letter symbol. Glycine has no asymmetric carbon atom and is simply referred to as "Gly" or G. Symbols for each amino acids are shown below:

TABLE 1

Amino acids with their abbreviations

| Amino acid | Three letter code | Single letter code |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Isoleucine | Ile | I |
| Leucine | Leu | L |

TABLE 1-continued

| Amino acids with their abbreviations | | |
|---|---|---|
| Amino acid | Three letter code | Single letter code |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

In some embodiments, as used herein, the term "peptide" is used interchangeably with "epitope" in the present specification to designate a series of residues, typically L-amino acids, connected one to the other, typically by peptide bonds between the c'-amino and carboxyl groups of adjacent amino acids, that binds to a designated MHC allele.

With regard to a particular amino acid sequence, an "epitope" is a set of amino acid residues which is involved in recognition by a particular immunoglobulin, or in the context of T cells, those residues necessary for recognition by T cell receptor proteins and/or Major Histocompatibility Complex (MHC) receptors. In an immune system setting, in vivo or in vitro, an epitope is the collective features of a molecule, such as primary, secondary and tertiary peptide structure, and charge, that together form a site recognized by an immunoglobulin, T cell receptor or HLA molecule. Throughout this disclosure epitope and peptide are often used interchangeably.

It is to be appreciated that protein or peptide molecules that comprise an epitope of the invention as well as additional amino acid(s) are still within the bounds of the invention. In certain embodiments, there is a limitation on the length of a peptide of the invention. The embodiment that is length-limited occurs when the protein/peptide comprising an epitope of the invention comprises a region (i.e., a contiguous series of amino acids) having 100% identity with a native sequence. In order to avoid the definition of epitope from reading, e.g., on whole natural molecules, there is a limitation on the length of any region that has 100% identity with a native peptide sequence. Thus, for a peptide comprising an epitope of the invention and a region with 100% identity with a native peptide sequence, the region with 100% identity to a native sequence generally has a length of: less than or equal to 600 amino acids, often less than or equal to 500 amino acids, often less than or equal to 400 amino acids, often less than or equal to 250 amino acids, often less than or equal to 100 amino acids, often less than or equal to 85 amino acids, often less than or equal to 75 amino acids, often less than or equal to 65 amino acids, and often less than or equal to 50 amino acids. In certain embodiments, an "epitope" of the invention is comprised by a peptide having a region with less than 51 amino acids that has 100% identity to a native peptide sequence, in any increment down to 5 amino acids.

Accordingly, peptide or protein sequences longer than 600 amino acids are within the scope of the invention, so long as they do not comprise any contiguous sequence of more than 600 amino acids that have 100% identity with a native peptide sequence. For any peptide that has five contiguous residues or less that correspond to a native sequence, there is no limitation on the maximal length of that peptide in order to fall within the scope of the invention. It is presently preferred that a CTL epitope be less than 600 residues long in any increment down to eight amino acid residues.

A "dominant epitope" induces an immune response upon immunization with whole native antigens which comprise the epitope. (See, e.g., Sercarz, et al., *Annu. Rev. Immunol.* 11:729-766 (1993)). Such a response is cross-reactive in vitro with an isolated peptide epitope.

A "cryptic epitope" elicits a response by immunization with isolated peptide, but the response is not cross-reactive in vitro when intact whole protein which comprises the epitope is used as an antigen.

A "subdominant epitope" is an epitope which evokes little or no response upon immunization with whole antigens which comprise the epitope, but for which a response can be obtained by immunization in vivo or in vitro with an isolated epitope, and this response (unlike the case of cryptic epitopes) is detected when whole protein is used to recall the response in vitro.

A "pharmaceutical excipient" comprises a material such as an adjuvant, a carrier, pH-adjusting and buffering agents, tonicity adjusting agents, wetting agents, preservatives, and the like.

As used herein, the term "pharmaceutically acceptable" refers to a generally non-toxic, inert, and/or physiologically compatible composition.

As used herein, the term "protective immune response" or "therapeutic immune response" refers to a CTL and/or an HTL response to an antigen derived from an infectious agent or a tumor antigen, which in some way prevents or at least partially arrests disease symptoms, side effects or progression. The immune response may also include an antibody response that has been facilitated by the stimulation of helper T cells.

In certain embodiments, an "immunogenic peptide" is a peptide which comprises an allele-specific motif such that the peptide will bind an MHC (HLA) molecule and induce a CTL response. Immunogenic peptides of the invention are capable of binding to an appropriate class I MHC molecule (e.g., HLA-A2.1) and inducing a cytotoxic T cell response against the antigen from which the immunogenic peptide is derived.

An "immunogenic response" includes one that stimulates a CTL and/or HTL response in vitro and/or in vivo as well as modulates an ongoing immune response through directed induction of cell death (or apoptosis) in specific T cell populations.

In certain embodiments, an "immunogenic peptide" or "peptide epitope" is a peptide which comprises an allele-specific motif or supermotif such that the peptide will bind an HLA molecule and induce a CTL or HTL response. Thus, immunogenic peptides of the invention are capable of binding to an appropriate HLA molecule and thereafter inducing a cytotoxic T cell response, or a helper T cell response, to the antigen from which the immunogenic peptide is derived.

Immunogenic peptides of the invention are capable of binding to an appropriate HLA-A2 molecule and inducing a cytotoxic T-cell response against the antigen from which the immunogenic peptide is derived. The immunogenic peptides of the invention are less than about 15 residues in length, often less than 12 residues in length and usually consist of between about 8 and about 11 residues, preferably 9 or 10 residues.

The term "derived" when used to discuss an epitope is a synonym for "prepared." A derived epitope can be isolated from a natural source, or it can be synthesized in accordance with standard protocols in the art. Synthetic epitopes can comprise artificial amino acids "amino acid mimetics," such as D isomers of natural occurring L amino acids or non-natural amino acids such as cyclohexylalanine. A derived/prepared epitope can be an analog of a native epitope.

Immunogenic peptides are conveniently identified using the algorithms of the invention. The algorithms are mathematical procedures that produce a score which enables the selection of immunogenic peptides. Typically one uses the algorithmic score with a "binding threshold" to enable selection of peptides that have a high probability of binding at a certain affinity and will in turn be immunogenic. The algorithm is based upon either the effects on MHC binding of a particular amino acid at a particular position of a peptide or the effects on binding of a particular substitution in a motif containing peptide.

The term "residue" refers to an amino acid or amino acid mimetic incorporated into an oligopeptide by an amide bond or amide bond mimetic.

A "conserved residue" is an amino acid which occurs in a significantly higher frequency than would be expected by random distribution at a particular position in a peptide. Typically a conserved residue is one where the MHC structure may provide a contact point with the immunogenic peptide. At least one to three or more, preferably two, conserved residues within a peptide of defined length defines a motif for an immunogenic peptide. These residues are typically in close contact with the peptide binding groove, with their side chains buried in specific pockets of the groove itself. Typically, an immunogenic peptide will comprise up to three conserved residues, more usually two conserved residues.

Alternatively, a "conserved residue" is a conserved amino acid occupying a particular position in a peptide motif typically one where the MHC structure may provide a contact point with the immunogenic peptide. One to three, typically two, conserved residues within a peptide of defined length defines a motif for an immunogenic peptide. These residues are typically in close contact with the peptide binding groove, with their side chains buried in specific pockets of the groove itself.

A "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding grooves of an HLA molecule, with their side chains buried in specific pockets of the binding grooves themselves. For example, analog peptides have been created by altering the presence or absence of particular residues in these primary anchor positions. Such analogs are used to finely modulate the binding affinity of a peptide comprising a particular motif or supermotif. Typically, the primary anchor residues are located in the 2 and 9 position of 9 residue peptide.

A "secondary anchor residue" is an amino acid at a position other than a primary anchor position in a peptide. The secondary anchor residues are said to occur at secondary anchor positions. A secondary anchor residue occurs at a significantly higher frequency than would be expected by random distribution of amino acids at one position. A secondary anchor residue can be identified as a residue which is present at a higher frequency among high affinity binding peptides, or a residue otherwise associated with high affinity binding. For example, analog peptides have been created by altering the presence or absence of particular residues in these secondary anchor positions. Such analogs are used to finely modulate the binding affinity of a peptide comprising a particular motif or supermotif.

As used herein, "negative binding residues" or "deleterious" residues are amino acids which if present at certain positions (for example, positions 1, 3 and/or 7 of a 9-mer) (typically not primary anchor positions) will, in certain embodiments, result in decreased binding affinity for its target HLA molecule, and in certain embodiments, will result in a peptide being a nonbinder or poor binder and in turn fail to be immunogenic (i.e., induce a CTL response) or induce a CTL response despite the presence of the appropriate conserved residues within the peptide. For motif-bearing peptides, by definition negative residues will not be at primary anchor positions.

The term "motif" refers to the pattern of residues in a peptide of defined length, usually about 8 to about 11 amino acids, which is recognized by a particular MHC allele (one or more HLA molecules). The peptide motifs are typically different for each human MHC allele and differ in the pattern of the highly conserved residues and negative residues. Peptide motifs are often unique for the protein encoded by each human HLA allele, differing in their pattern of the primary and secondary anchor residues. Typically as used herein, a "motif" refers to that pattern of residues which is recognized by an HLA molecule encoded by a particular allele.

The binding motif for an allele can be defined with increasing degrees of precision. In one case, all of the conserved residues are present in the correct positions in a peptide and there are no negative residues in positions 1, 3 and/or 7.

The designation of a residue position in an epitope as the "carboxyl terminus" or the "carboxyl terminal position" refers to the residue position at the end of the epitope which is nearest to the carboxyl terminus of a peptide, which is designated using conventional nomenclature as defined below. The "carboxyl terminal position" of the epitope may or may not actually correspond to the end of the peptide or polypeptide.

The designation of a residue position in an epitope as "amino terminus" or "amino-terminal position" refers to the residue position at the end of the epitope which is nearest to the amino terminus of a peptide, which is designated using conventional nomenclature as defined below. The "amino terminal position" of the epitope may or may not actually correspond to the end of the peptide or polypeptide.

The term "tolerated residue" is a synonym for a "less preferred residue". A "tolerated" residue refers to an anchor residue specific for a particular motif, the presence of which residue is correlated with suboptimal, but acceptable, binding to the particular HLA molecule.

A "motif bearing peptide" or "peptide which comprises a motif" refers to a peptide that comprises primary anchors specified for a given motif or supermotif.

In certain embodiments, a "supermotif" is a peptide binding specificity shared by HLA molecules encoded by two or more HLA alleles. Preferably, a supermotif-bearing peptide is recognized with high or intermediate affinity (as defined herein) by two or more HLA molecules or antigens.

Alternatively, the term "supermotif" refers to motifs that, when present in an immunogenic peptide, allow the peptide to bind more than one HLA antigen. The supermotif preferably is recognized with high or intermediate affinity (as defined herein) by at least one HLA allele having a wide distribution in the human population, preferably recognized by at least two alleles, more preferably recognized by at least three alleles, and most preferably recognized by more than three alleles.

"Human Leukocyte Antigen" or "HLA" is a human class I or class II Major Histocompatibility Complex (MHC) protein (see, Stites, et al., IMMUNOLOGY, $8^{TH}$ ED., Lange Publishing, Los Altos, Calif. (1994).

"Major Histocompatibility Complex" or "MHC" is a cluster of genes which plays a role in control of the cellular interactions responsible for physiologic immune responses.

In humans, the MHC complex is also known as the HLA complex. For a detailed description of the MHC and HLA complexes, see, Paul, FUNDAMENTAL IMMUNOLOGY, $3^{RD}$ ED., Raven Press, New York, 1993.

"Heteroclitic analogs" are defined herein as a peptide with increased potency for a specific T cell, as measured by increased responses to a given dose, or by a requirement of lesser amounts to achieve the same response as a homologous native class I peptide. Advantages of heteroclitic analogs include that the antigens can be more potent, or more economical (since a lower amount is required to achieve the same effect as a homologous class I peptide). In addition, heteroclitic analogs are also useful to overcome antigen-specific T cell unresponsiveness (T cell tolerance).

The phrases "isolated" or "biologically pure" refer to material which is substantially or essentially free from components which normally accompany it as found in its native state. Thus, the peptides of this invention do not contain materials normally associated with their in situ environment, e.g., MHC I molecules on antigen presenting cells. Even where a protein has been isolated to a homogenous or dominant band, there are trace contaminants in the range of 5-10% of native protein which co-purify with the desired protein. Isolated peptides of this invention do not contain such endogenous co-purified protein.

"Peripheral blood mononuclear cells" (PBMCs) are cells found in from the peripheral blood of a patient. PBMCs comprise, e.g., CTLs and HTLs and antigen presenting cells. These cells can contact an antigen in vivo, or be obtained from a mammalian source and contacted with an antigen in vitro.

"Cross-reactive binding" indicates that a peptide is bound by more than one HLA molecule; a synonym is degenerate binding.

"Promiscuous recognition" is where the same peptide bound by different HLA molecules is recognized by the same T cell clone. It may also refer to the ability of a peptide to be recognized by a single T cell receptor in the context of multiple HLA alleles.

"Link" or "join" refers to any method known in the art for functionally connecting peptides, including, without limitation, recombinant fusion, covalent bonding, disulfide bonding, ionic bonding, hydrogen bonding, and electrostatic bonding.

A "non-native" sequence or "construct" refers to a sequence that is not found in nature, i.e., is "non-naturally occurring". Such sequences include, e.g., peptides that are lipidated or otherwise modified, and polyepitopic compositions that contain epitopes that are not contiguous in a native protein sequence.

As used herein, a "vaccine" is a composition that contains one or more peptides of the invention, see, e.g., TABLE 2, TABLE 11, TABLE 12, TABLE 10, TABLE 11, TABLE 12, TABLE 13, TABLE 14, TABLE 15, TABLE 16, TABLE 17, TABLE 18, TABLE 19, and TABLE 20. There are numerous embodiments of vaccines in accordance with the invention, such as by a cocktail of one or more peptides; one or more peptides of the invention comprised by a polyepitopic peptide; or nucleic acids that encode such peptides or polypeptides, e.g., a minigene that encodes a polyepitopic peptide. The "one or more peptides" can include any whole unit integer from 1-150, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I-binding peptides of the invention can be linked to HLA class II-binding peptides, to facilitate activation of both cytotoxic T lymphocytes and helper T lymphocytes. Vaccines can comprise peptide pulsed antigen presenting cells, e.g., dendritic cells.

DETAILED DESCRIPTION OF THE INVENTION

Certain embodiments of the present invention relate in part to an epitope-based approach for vaccine design. Such an approach is based on the well-established finding that the mechanism for inducing CTL immune response comprises the step of presenting a CTL epitope as a peptide of about 8-11 amino acids bound to an HLA molecule displayed on an antigen-presenting cell. The HLA molecule is the product of a class I MHC wherein the product is expressed on most nucleated cells.

Certain embodiments of the present invention relate to the determination of allele-specific peptide motifs for human Class I (and class II) MHC (sometimes referred to as HLA) allele subtypes. These motifs are then used to define T cell epitopes from any desired antigen, particularly those associated with human viral diseases, cancers or autoimmune diseases, for which the amino acid sequence of the potential antigen or auto-antigen targets is known.

Certain embodiments of the present invention relate to peptides comprising allele-specific peptide motifs and supermotifs which bind to HLA class I and class II molecules, in particular, HLA-A3-like alleles. Such motifs (i.e., allele-specific motifs or supermotifs) are then used to identify, prepare and modify epitopes from a source protein which are recognized and bound by HLA molecules, e.g., to create analogs of any desired peptide antigen, particularly those associated with human cancers and precancerous conditions, and from infectious agents such as viruses, bacteria, fungi, and protozoal parasite.

As noted above, high HLA binding affinity is correlated with higher immunogenicity. Higher immunogenicity can be manifested in several different ways. For instance, a higher binding peptide will be immunogenic more often. Close to 90% of high binding peptides are immunogenic, as contrasted with about 50% of the peptides which bind with intermediate affinity. A higher binding peptide will also lead to a more vigorous response. As a result, less peptide is required to elicit a similar biological effect. Thus, in some embodiments of the invention high binding epitopes are particularly desired.

In some embodiments of the invention, the identification of subdominant, as opposed to dominant epitopes is desired. In the nomenclature adopted here (see, Sercarz, et al., (1993), supra), a "dominant epitope" induces a response upon immunization with whole native antigens. Such a response is cross-reactive in vitro with the peptide epitope. A "cryptic epitope" elicits a response by peptide immunization, but is not cross-reactive in vitro when intact whole protein is used as an antigen. Finally, a "subdominant epitope" is an epitope which evokes little or no response upon immunization with whole antigens, but for which a response can be obtained by peptide immunization, and this response (unlike the case of cryptic epitopes) is detected when whole protein is used to recall the response in vitro.

HLA class I alleles have historically been classified based on serology or phylogenetic relationships, however, these alleles can be (re)classified into supertypes on the basis of their ligand specificity. At least two HLA class I supertypes, A2 and B7, have been identified. In certain embodiments, the HLA class I A3 supertype is disclosed and claimed herein.

It remains unknown how many supertypes will be identified and how inclusive they will be, data demonstrate that the phenomenon of cross-reactivity of peptide-binding specificities, previously thought to be restricted to HLA class II (Panina-Bordignon, et al., *Eur J Immunol* 19:2237 (1989); O'Sullivan, et al., *J Immunol* 145:1799 (1990); Busch, et al., *Int Immunol* 2:443 (1990)), is also a feature of peptide binding to HLA class I molecules. The availability of quantitative binding assays along with the detailed supermotifs disclosed herein allows the identification of highly cross-reactive peptides. This, in turn, allows for broad population coverage with a cocktail of a few CTL and/or HTL epitopes, a scenario of great significance for the use of epitope-based vaccines (Vitiello, et al., *J Clin Invest* 95:341 (1995)).

The data presented herein demonstrate that products from at least five different HLA alleles (A3, A11, A31, A*3301, and A*6801), and likely at least three others (A*3401, A*6601, and A*7401) predicted on the basis of pocket analysis (data not shown), are properly grouped into a single functional HLA A3 supertype. This determination was made on the basis of a number of observations. As a group, these molecules: (a) share certain key structural features within their peptide-binding regions; (b) have similar preferences for the primary anchor residues in the peptides they bind, i.e., a primary supermotif present in the peptides bound by the HLA molecules of the superfamily; and (c) share largely overlapping binding repertoires. Knowledge of the A3 supermotif allows for identification of a cross-reactive peptide for a source, and allows for production of peptide analogs by substituting at primary anchor positions to alter the binding properties of the peptides.

Furthermore, by examining the binding activity of a large panel of peptides bearing the primary A3 supermotif, an extended A3 supermotif was defined. This extended supermotif was based on a detailed map of the secondary anchor requirements for binding to molecules of the A3 supertype. The extended supermotif allows for the efficient prediction of cross-reactive binding of peptides to alleles of the A3 supertype by screening the native sequence of a particular antigen. This extended supermotif is also used to select analog options for peptides which bear amino acids defined by the primary supermotif.

By examining the binding activity of a large panel of peptides bearing anchor residues preferred by these allelic molecules, an A3-like supermotif was also defined. This supermotif, which is based on a detailed map of the secondary anchor requirements of each of the A3-like supertype molecules, allows for the efficient prediction of A3-like degenerate binding peptides. Finally, it was shown that the A3-like supertype, and supertypes in general, are represented with remarkably high phenotypic frequencies in all major ethnic groups. As such, HLA class I supertypes based on peptide-binding specificities represent a functional alternative to serologic and phylogenetic classification for understanding the relationships between HLA class I molecules. Besides their use for the generation of the A3-like supermotif, the individual secondary anchor maps disclosed in this study represent in themselves a significant contribution to the understanding of peptide binding to class I molecules. Because these maps were derived using peptides of homogeneous size, the preference determinations at each of the secondary positions may be more accurate than those derived from the sequencing of pools of naturally processed peptides. Also, the motifs defined herein allow the determination of residues which have deleterious effects on peptide binding.

Barber and co-workers (Barber, et al., Curr Biol 5:179 (1995)) have demonstrated that peptides could be recognized in the context of two molecules we have included in the HLA-B7-like supertype, and two other peptides have been reported as being recognized in the context of more than one A3-like allele (Missale, et al., J Exp Med 177:751 (1993); Koenig, et al., J Immunol 145:127 (1990); Culmann, et al., J Immunol 146:1560 (1991)) (see TABLE 142). Using a method for in vitro induction of primary CTLs (Wentworth, et al., Mol Immunol 32:603 (1995)) we observed several instances in which peptides can be recognized in the context of both A3 and A11. We tested the A3-like supertype restricted epitopes for binding capacity to A3-like supertype molecules, and noted relatively high levels of degeneracy. Of the seven epitopes listed in TABLE 142, only one was a nonamer that could be analyzed for the supermotif proposed in FIG. 40A (future studies will be aimed at extending the supermotif to peptides longer than 15 nine-mers). This peptide was supermotif positive, and bound three of five A3-like molecules. Nonetheless, it is important that each of the epitopes conformed to the A3-like supertype primary anchor specificities.

Comparison of the supertype classifications we have proposed on the basis of peptide binding with the classification of HLA-A alleles on the basis of DNA sequence (and serologic reactivity) relationships (Ishikawa, et al., Hum Immonol 39:220 (1994); Firgaira, et al., Immunogenetics 40:445 (1994); Karo, et al., J Immunol 143:3371 (1989)) reveals both similarities and differences. For example, HLA-A3 and A11 appear to be closely related and derived from a common ancestral gene (48-50). A31 and A33, however, derive from the ancient lineage comprising the A2/A10/A19 groups, which is different from the lineage of A3 and A11. Finally, HLA-A*6901 belongs to the A28 HLA evolutionary group [Fernandez-Viiia, et al., Hum Immunol 33:163 (1992); Ishikawa, et al., Hum Immonol 39:220 (1994); Lawlor, et al., Annu Rev Immunol 8:23 (1990)], which also contains the HLA-A*6802 and -A*6901 alleles. Yet, on the basis of their peptide-binding specificity, HLA A*6801 is a member of the A3-like supertype, whereas A*6802 and A*6901 have been demonstrated to belong to the A2-like supertype [del Guercio, et al., J Immunol 154:685 (1995)]. Thus, based on the available phylogenetic tree of HLA alleles [Ishikawa, et al., Hum Immonol 39:220 (1994); Firgaira, et al., Immunogenetics 40:445 (1994); Karo, et al., J Immunol 143:3371 (1989)], A3-like alleles are found in both of the ancient HLA lineages: A 11A9 which includes A3 and A11, and A21A 101A which includes A31, A33, and A*6801. If the existence of the HLA-A3-like supertype is reflective of common ancestry, then the A3-like motif might in fact represent primeval human HLA class I peptide-binding specificity, and other specificities may represent adaptations to changing pathogenic environments.

The discovery of the individual residues of the secondary anchor motif disclosed herein represents a significant contribution to the understanding of peptide binding to class I molecules. These secondary anchor maps were derived using peptides of homogeneous size. Thus, the preference determinations at each of the secondary positions may be more accurate than those derived from the sequencing of pools of naturally processed peptides. Also, the motifs defined herein allow the determination of residues which have deleterious or other types of effects on peptide binding.

The definition of primary and secondary anchor specificities for the A3 supertype provides guidance for modulating the binding activity of peptides that bind to members of the A3 supertype family. This information may be used to generate highly cross-reactive epitopes by identifying residues within a native peptide sequence that can be analogued to increase greater binding cross-reactivity within a supertype, or analogued to increase immunogenicity.

The phenomena of HLA supertypes may be related to optimal exploitation of the peptide specificity of human transporter associated with antigen processing (TAP) molecules (Androlewicz, et al., *Proc. Nat'l Acad. Sci. USA* 90:9130 (1993); Androlewicz, et al., *Immunity* 1:7 (1994); van Endert, et al., *Immunity* 1:491 (1994); Heemels, et al., *Immunity* 1:775 (1994); Momburg, et al., *Curr. Opin. Immunol.* 6:32 (1994); Neefjes, et al., *Science* 261:769 (1993)). The TAP molecules have been shown to preferentially transport peptides with certain sequence features such as hydrophobic, aromatic, or positively charged C-termini.

Recent studies, performed by van Endert and associates, in collaboration with the present inventors, evaluated the relative affinities for TAP of a large collection of peptides, and have described an extended TAP binding motif (Van Endert et al. *J. Exp. Med.* 182:1883 (1995)) Strikingly, this tap motif contains many of the structural features associated with the A3 extended supermotif, such as the preference for aromatic residues at positions 3 and 7 of nonamer peptides and the absence of negatively charged residues at positions 1 and 3, and P at position 1.

The preparation and evaluation of motif-bearing peptides are described in PCT publications WO 94/20127 and WO 94/03205. Briefly, peptides from a particular antigen are synthesized and tested for their ability to bind to HLA proteins in assays using, for example, purified HLA class I molecules and radioiodinated peptides and/or cells expressing empty class I molecules (which lack peptide in their receptor) by, for instance, immunofluorescent staining and flow microfluorimetry, peptide-dependent class I assembly assays, and inhibition of CTL recognition by peptide competition. Those peptides that bind to the class I molecule are further evaluated for their ability to serve as targets for CTLs derived from infected or immunized individuals, as well as for their capacity to induce primary in vitro or in vivo CTL responses that can give rise to CTL populations capable of reacting with selected target cells associated with a disease.

The concept of dominance and subdominance is relevant to immunotherapy of infectious diseases and cancer. For example, in the course of chronic viral disease, recruitment of subdominant epitopes can be crucial for successful clearance of the infection, especially if dominant CTL specificities have been inactivated by functional tolerance, suppression, mutation of viruses and other mechanisms (Franco, et al., *Curr. Opin. Immunol.* 7:524-531, (1995)). Furthermore, in the case of cancer and tumor antigens, it appears that CTLs recognizing at least some of the highest binding affinity peptides might have been functionally inactivated by tolerance and suppression, and that lower binding affinity peptides are preferentially recognized.

In particular, it has been noted that a significant number of epitopes derived from known non-viral tumor associated antigens (TAA) bind HLA Class I with intermediate affinity ($IC_{50}$ in the 50-500 mM range). It has been found that 8 of 15 known TAA peptides recognized by tumor infiltrating lymphocytes (TIL) or CTL bound in the 50-500, mM range. These data are in contrast with estimates that 90% of known viral antigens that were recognized as peptides bound HLA with $IC_{50}$ of 50 IM or less while only approximately 10% bound in the 50-500 mM range (Sette, et al., J. Immunol., 153:5586-5592 (1994)). This phenomenon is probably due in the cancer setting to elimination, or functional inhibition of the CTL recognizing several of the highest binding peptides, presumably because of T cell tolerization events.

The present invention provides methods for modulating binding affinity of immunogenic peptides by selection of desired residues in the primary and secondary anchor positions. As explained in detail below, a supermotif for enhanced binding to A3 like alleles is provided here. Depending on the desired affect on binding affinity, the anchor residues in a desired peptide are substituted. Examples of modulations that may be achieved using the present invention include increased affinity for a particular allele (e.g., by substitution of secondary anchor residues specific for the allele), increased cross-reactivity among different alleles (e.g., by substitution of secondary anchor residues shared by more than one allele), and production of a subdominant epitope (e.g., by substitution of residues which increase affinity but are not present on the immunodominant epitope).

Thus, in some embodiments of the invention, the identification of subdominant, as opposed to dominant epitopes is desired. In a preferred embodiment, these subdominant epitopes can then be engineered to increase HLA binding affinity. As noted herein, higher HLA binding affinity is correlated with greater immunogenicity. Greater immunogenicity can be manifested in several different ways. Close to 90% of "high" binding peptides have been found to be immunogenic, as contrasted with about 50% of the peptides which bind with "intermediate" affinity. Moreover, higher binding affinity peptides lead to more vigorous immunogenic responses. As a result, less peptide is required to elicit a similar biological effect. Thus, in preferred embodiments of the invention, high binding epitopes are particularly desired.

Epitope-bearing peptides in accordance with the invention can be prepared synthetically, by recombinant DNA technology, or from natural sources such as whole viruses or tumors. Although the peptide will preferably be substantially free of other naturally occurring host cell proteins and fragments thereof, in some embodiments the peptides are synthetically conjugated to native molecules or particles; the peptides can also be conjugated to non-native molecules or particles.

The peptides in accordance with the invention can be a variety of lengths, and either in their neutral (uncharged) forms or in forms which are salts. The peptides in accordance with the invention are either free of modifications such as glycosylation, side chain oxidation, or phosphorylation; or they contain these modifications.

Desirably, the epitope-bearing peptide will be as small as possible while still maintaining relevant immunologic activity of the large peptide; of course it is particularly desirable with peptides from pathogenic organisms that the peptide be small in order to avoid pathogenic function. When possible, it may be desirable to optimize epitopes of the invention to a length of about 8 to about 13, preferably 9 to 10 amino acid residues for a class I molecule and about 6 to about 25 amino acid residues for a class II molecules. Preferably, the peptides are commensurate in size with endogenously processed viral peptides or tumor cell peptides that are bound to HLA class I or class II molecules on the cell surface. Nevertheless, the identification and preparation of peptides of other lengths can be carried out using the techniques described here such as the disclosures of primary anchor positions. It is to be appreciated that peptide epitopes in accordance with the invention can be present in peptides or proteins that are longer than the epitope itself. Moreover, multiepitopic peptides can comprise at least one epitope of the invention along with other epitope(s).

In particular, the invention provides motifs that are common to peptides bound by more than one HLA allele. By a combination of motif identification and MHC-peptide interaction studies, peptides useful for peptide vaccines have been identified.

Peptides comprising the epitopes from these antigens are synthesized and then tested for their ability to bind to the appropriate MHC molecules in assays using, for example, purified class I molecules and radioiodinated peptides and/or cells expressing empty class I molecules by, for instance, immunofluorescent staining and flow microfluorometry, peptide-dependent class I assembly assays, and inhibition of CTL recognition by peptide competition. Those peptides that bind to the class I molecule are further evaluated for their ability to serve as targets for CTLs derived from infected or immunized individuals, as well as for their capacity to induce primary in vitro or in vivo CTL responses that can give rise to CTL populations capable of reacting with virally infected target cells or tumor cells as potential therapeutic agents.

The (HLA) MHC class I antigens (i.e., the products of the MHC class I alleles) are encoded by the HLA-A, B, and C loci. HLA-A and B antigens are expressed at the cell surface at approximately equal densities, whereas the expression of HLA-C is significantly lower (perhaps as much as 10-fold lower). Each of these loci have a number of alleles (i.e., a multiplicity of allelic variants) in the population. Indeed, there are believed to be well over 500 class I and class II alleles. The peptide binding motifs of the invention are relatively specific for each allelic subtype.

Since a cytotoxic T-cell response cannot be elicited unless the epitope is presented by the class I HLA contained on the surface of the cells of the individual to be immunized, it is important that the epitope be one that is capable of binding the HLA exhibited by that individual.

The starting point, therefore, for the design of effective vaccines is to ensure that the vaccine will generate a large number of epitopes that can successfully be presented. It may be possible to administer the peptides representing the epitopes per se. Such administration is dependent on the presentation of "empty" HLA molecules displayed on the cells of the subject. In one approach to use of the immunogenic peptides per se, these peptides may be incubated with antigen-presenting cells from the subject to be treated ex vivo and the cells then returned to the subject.

Alternatively, the 8-11 amino acid peptide can be generated in situ by administering a nucleic acid containing a nucleotide sequence encoding it. Means for providing such nucleic acid molecules are described in WO99/58658, the disclosure of which is incorporated herein by reference. Further, the immunogenic peptides can be administered as portions of a larger peptide molecule and cleaved to release the desired peptide. The larger peptide may contain extraneous amino acids, in general the fewer the better. Thus, peptides which contain such amino acids are typically 25 amino acids or less, more typically 20 amino acids or less, and more typically 15 amino acids or less. The precursor may also be a heteropolymer or homopolymer containing a multiplicity of different or same CTL epitopes. Of course, mixtures of peptides and nucleic acids which generate a variety of immunogenic peptides can also be employed. The design of the peptide vaccines, the nucleic acid molecules, or the hetero- or homo-polymers is dependent on the inclusion of the desired epitope. Thus, in certain embodiments, the present invention provides a paradigm for identifying the relevant epitope which is effective across the broad population range of individuals who are characterized by the A2 supertype. The following pages describe the methods and results of experiments for identification of the A2 supermotif, and other motifs and supermotifs.

In certain embodiments, it is preferred that peptides include an epitope that binds to an HLA-A2 supertype allele. These motifs may be used to define T-cell epitopes from any desired antigen, particularly those associated with human viral diseases, cancers or autoimmune diseases, for which the amino acid sequence of the potential antigen or autoantigen targets is known.

Epitopes on a number of potential target proteins can be identified based upon HLA binding motifs. Examples of suitable antigens include TRP1, prostate cancer-associated antigens such as prostate specific antigen (PSA), human kallikrein (huK2), prostate specific membrane antigen (PSM), and prostatic acid phosphatase (PAP), antigens from viruses such as hepatitis B (e.g., hepatitis B core and surface antigens (HBVc, HBVs)), hepatitis C antigens, Epstein-Ban virus (EBV) antigens, human immunodeficiency virus (HIV) antigens, human papilloma virus (HPV) antigens, Kaposi's sarcoma virus (KSHV), influenza virus, Lassa virus, melanoma antigens (e.g., MAGE-1, MAGE2, and MAGE3) *Mycobacterium tuberculosis* (MT) antigens, p53, carcinoembryonic antigen (CEA), trypanosome, e.g., *Trypansoma cruzi* (*T. cruzi*), antigens such as surface antigen (TSA), Her2/neu, and malaria antigens. Examples of suitable fungal antigens include those derived from *Candida albicans, Cryptococcus neoformans, Coccidoides* spp., *Histoplasma* spp, and *Aspergillus fumigatis*. Examples of suitable protozoal parasitic antigens include those derived from *Plasmodium* spp., *Trypanosoma* spp., *Schistosoma* spp., *Leishmania* spp and the like. Examples of suitable bacterial antigens include those derived from *Mycobacterium* spp., *Chlamydiaceae* spp, and the like.

The peptides are thus useful in pharmaceutical compositions for both in vivo and ex vivo therapeutic and diagnostic applications.

Autoimmune associated disorders for which the peptides of the invention may be employed to relieve the symptoms of, treat or prevent the occurrence or reoccurrence of include, for example, multiple sclerosis (MS), rheumatoid arthritis (RA), Sjogren syndrome, scleroderma, polymyositis, dermatomyositis, systemic lupus erythematosus, juvenile rheumatoid arthritis, ankylosing spondylitis, myasthenia gravis (MG), bullous pemphigoid (antibodies to basement membrane at dermal-epidermal junction), pemphigus (antibodies to mucopolysaccharide protein complex or intracellular cement substance), glomerulonephritis (antibodies to glomerular basement membrane), Goodpasture's syndrome, autoimmune hemolytic anemia (antibodies to erythrocytes), Hashimoto's disease (antibodies to thyroid), pernicious anemia (antibodies to intrinsic factor), idiopathic thrombocytopenic purpura (antibodies to platelets), Grave's disease, and Addison's disease (antibodies to thyroglobulin), and the like.

The autoantigens associated with a number of these diseases have been identified. For example, in experimentally induced autoimmune diseases, antigens involved in pathogenesis have been characterized: in arthritis in rat and mouse, native type-II collagen is identified in collagen-induced arthritis, and mycobacterial heat shock protein in adjuvant arthritis; thyroglobulin has been identified in experimental allergic thyroiditis (EAT) in mouse; acetyl choline receptor (AChR) in experimental allergic myasthenia gravis (EAMG); and myelin basic protein (MBP) and proteolipid protein (PLP) in experimental allergic encephalomyelitis (EAE) in mouse and rat. In addition, target antigens have been identified in humans: type-II collagen in human rheumatoid arthritis; and acetyl choline receptor in myasthenia gravis.

Without wishing to be bound by theory, it is believed that the presentation of antigen by HLA Class I mediates suppression of autoreactive T cells by $CD8^+$ suppressor T cells (see, e.g., Jiang, et al. *Science,* 256:1213 (1992)). Such suppressor T cells release cytokines such as transforming growth factor-β (TGF-β), which specifically inhibit the autoreactive T cells. Miller, et al., *Proc. Natl. Acad. Sci*., USA, 89:421-425 (1992).

Peptides comprising the epitopes from these antigens may be synthesized and then tested for their ability to bind to the appropriate MHC molecules in assays using, for example, purified class I molecules and radioiodonated peptides and/or cells expressing empty class I molecules by, for instance, immunofluorescent staining and flow microfluorometry, peptide-dependent class I assembly assays, and inhibition of CTL recognition by peptide competition. Those peptides that bind to the class I molecule may be further evaluated for their ability to serve as targets for CTLs derived from infected or immunized individuals, as well as for their capacity to induce primary in vitro or in vivo CTL responses that can give rise to CTL populations capable of reacting with virally infected target cells or tumor cells as potential therapeutic agents.

Recent evidence suggests however, that high affinity MHC binders might be, in most instances, immunogenic, suggesting that peptide epitopes might be selected on the basis of MHC binding alone.

Peptides comprising the supermotif sequences can be identified, as noted above, by screening potential antigenic sources. Useful peptides can also be identified by synthesizing peptides with systematic or random substitution of the variable residues in the supermotif, and testing them according to the assays provided. As demonstrated below, it is useful to refer to the sequences of the target HLA molecule, as well.

For epitope-based vaccines, the peptides of the present invention preferably comprise a supermotif and/or motif recognized by an HLA I or HLA II molecule having a wide distribution in the human population. TABLE 22 shows the distribution of certain HLA alleles in human populations. Since the MHC alleles occur at different frequencies within different ethnic groups and races, the choice of target MHC allele may depend upon the target population. TABLE 69 shows the frequency of various alleles at the HLA-A locus products among different races. For instance, the majority of the Caucasoid population can be covered by peptides which bind to four HLA-A allele subtypes, specifically HLA-A2.1, A1, A3.2, and A24.1. Similarly, the majority of the Asian population is encompassed with the addition of peptides binding to a fifth allele HLA-A11.2.

The nomenclature used to describe peptide compounds follows the conventional practice wherein the amino group is presented to the left (the N-terminus) and the carboxyl group to the right (the C-terminus) of each amino acid residue. In the formulae representing selected specific embodiments of the present invention, the amino- and carboxyl-terminal groups, although not specifically shown, are in the form they would assume at physiologic pH values, unless otherwise specified. In the amino acid structure formulae, each residue is generally represented by standard three letter or single letter designations. The L-form of an amino acid residue is represented by a capital single letter or a capital first letter of a three-letter symbol, and the D-form for those amino acids having D-forms is represented by a lower case single letter or a lower case three letter symbol. Glycine has no asymmetric carbon atom and is simply referred to as "Gly" or G. The letter X in a motif represents any of the 20 amino acids found in TABLE 72, as well non-naturally occurring amino acids or amino acid mimetics. Brackets surrounding more than one amino acid indicates that the motif includes any one of the amino acids. For example, the supermotif "N-XPXXXXXX(A,V,I,L,M)-C (SEQ ID NO:14618)" includes each of the following peptides: N-XPXXXXXXA-C (SEQ ID NO: 14618), N-XPXXXXXXV-C (SEQ ID NO: 14618), N-XPXXXXXXI-C (SEQ ID NO: 14618), N-XPXXXXXXL-C (SEQ ID NO: 14618), and N-XPXXXXXXM-C (SEQ ID NO: 14618).

The large degree of HLA polymorphism is an important factor to be taken into account with the epitope-based approach to vaccine development. To address this factor, epitope selection encompassing identification of peptides capable of binding at high or intermediate affinity to multiple HLA molecules is preferably utilized, most preferably these epitopes bind at high or intermediate affinity to two or more allele-specific HLA molecules.

CTL-inducing peptides of interest for vaccine compositions preferably include those that have an $IC_{50}$ or binding affinity value for a class HLA molecule(s) of 500 nM or better (i.e., the value is 500 nM or less) or, for class II HLA molecules, 1000 nM or better (i.e., the value is greater than or equal to 1000 nM). For example, peptide binding is assessed by testing the capacity of a candidate peptide to bind to a purified HLA molecule in vitro. Peptides exhibiting high or intermediate affinity are then considered for further analysis. Selected peptides are generally tested on other members of the supertype family. In preferred embodiments, peptides that exhibit cross-reactive binding are then used in cellular screening analyses or vaccines.

The relationship between binding affinity for HLA class I molecules and immunogenicity of discrete peptide epitopes on bound antigens was determined for the first time in the art by the present inventors. As disclosed in greater detail herein, higher HLA binding affinity is correlated with greater immunogenicity.

Greater immunogenicity can be manifested in several different ways. Immunogenicity corresponds to whether an immune response is elicited at all, and to the vigor of any particular response, as well as to the extent of a population in which a response is elicited. For example, a peptide might elicit an immune response in a diverse array of the population, yet in no instance produce a vigorous response. In accordance with these principles, close to 90% of high binding peptides have been found to elicit a response and thus be "immunogenic," as contrasted with about 50% of the peptides that bind with intermediate affinity (see, e.g., Schaeffer et al. PNAS (1988)). Moreover, not only did peptides with higher binding affinity have an enhanced probability of generating an immune response, the generated response tended to be more vigorous than the response seen with weaker binding peptides. As a result, less peptide is required to elicit a similar biological effect if a high affinity binding peptide is used rather than a lower affinity one. Thus, in preferred embodiments of the invention, high affinity binding epitopes are used.

The correlation between binding affinity and immunogenicity was analyzed by the present inventors by two different experimental approaches (see, e.g., Sette, et al., *J Immunol.* 153:5586-5592 (1994)). In the first approach, the immunogenicity of potential epitopes ranging in HLA binding affinity over a 10,000-fold range was analyzed in HLA-A*0201 transgenic mice. In the second approach, the antigenicity of approximately 100 different hepatitis B virus (HBV)-derived potential epitopes, all carrying A *0201 binding motifs, was assessed by using PBL from acute hepatitis patients. Pursuant to these approaches, it was determined that an affinity threshold value of approximately 500 nM (preferably 50 nM or less) determines the capacity of a peptide epitope to elicit a CTL response. These data are true for class I binding affinity measurements for naturally processed peptides and for synthesized T cell epitopes. These data also indicate the important role of determinant selection in the shaping of T cell responses (see, e.g., Schaeffer et al. *Proc. Natl. Acad. Sci. USA* 86:4649-4653 (1989)).

Peptides of the present invention may also comprise epitopes that bind to HLA class II molecules (HLA class II molecules are also referred to as MHC-DR molecules). An affinity threshold associated with immunogenicity in the context of HLA class II DR molecules has also been delineated (see, e.g., Southwood et al. *J. Immunology* 160:3363-73, 1998, and WO99/61916). In order to define a biologically significant threshold of DR binding affinity, a database of the binding affinities of 32 DR-restricted epitopes for their restricting element (i.e., the HLA molecule that binds the motif) was compiled. In approximately half of the cases (15 of 32 epitopes), DR restriction was associated with high binding affinities, i.e. binding affinity values of 100 nM or less (in some embodiments, the binding affinity value was less than 100 nM). In the other half of the cases (16 of 32), DR restriction was associated with intermediate affinity (binding affinity values in the 100-1000 nM range). In only one of 32 cases was DR restriction associated with an $IC_{50}$ of 1000 nM or greater. Thus, 1000 nM can be defined as an affinity threshold associated with immunogenicity in the context of DR molecules. Thus, as seen with HLA class I molecules, an affinity threshold associated with immunogenicity is defined for epitopes recognized by HLA class II molecules.

Definition of motifs that are predictive of binding to specific class I and class II alleles allows the identification of potential peptide epitopes from an antigenic protein whose amino acid sequence is known. Typically, identification of potential peptide epitopes is initially carried out using a computer to scan the amino acid sequence of a desired antigen for the presence of motifs and/or supermotifs.

Definition of motifs specific for different class I alleles allows the identification of potential peptide epitopes from an antigenic protein whose amino acid sequence is known. Typically, identification of potential peptide epitopes is initially carried out using a computer to scan the amino acid sequence of a desired antigen for the presence of motifs. The epitopic sequences are then synthesized. The capacity to bind MHC Class I molecules is measured in a variety of different ways. One means is a Class I molecule binding assay as described in the related applications, noted above. Other alternatives described in the literature include inhibition of antigen presentation (Sette, et al., *J Immunol.* 141:3893 (1991), in vitro assembly assays (Townsend, et al., *Cell* 62:285 (1990), and FACS based assays using mutated cells, such as RMA-S (Melief, et al., *Eur. J. Immunol.* 21:2963 (1991)).

In the typical case, immunoprecipitation is used to isolate the desired allele. A number of protocols can be used to isolate HLA molecules for use in binding assays, depending upon the specificity of the antibodies used. For example, allele-specific mAb reagents can be used for the affinity purification of the HLA-A, HLA-B1, and HLA-C molecules. Several mAb reagents for the isolation of HLA-A molecules are available (see TABLE 4, TABLE 71, and TABLE 24). The monoclonal BB7.2 is suitable for isolating HLA-A2 molecules. Thus, for each of the targeted HLA-A alleles, reagents are available that may be used for the direct isolation of the HLA-A molecules. Affinity columns prepared with these mAbs using standard techniques are successfully used to purify the respective HLA-A allele products. In addition to allele-specific mAbs, broadly reactive anti-HLA-A, B, C mAbs, such as W6/32 and B9.12.1, and one anti-HLA-B, C mAb, B1.23.2, could be used in alternative affinity purification protocols as described in previous applications or in the examples section below.

The procedures used to identify peptides of the present invention generally follow the methods disclosed in Falk et al., Nature 351:290 (1991), which is incorporated herein by reference. Briefly, the methods involve large-scale isolation of MHC class I molecules, typically by immunoprecipitation or affinity chromatography, from the appropriate cell or cell line. Examples of other methods for isolation of the desired MHC molecule equally well known to the artisan include ion exchange chromatography, lectin chromatography, size exclusion, high performance ligand chromatography, and a combination of all of the above techniques.

The peptides bound to the peptide binding groove of the isolated MHC molecules are eluted typically using acid treatment. Peptides can also be dissociated from class I molecules by a variety of standard denaturing means, such as heat, pH, detergents, salts, chaotropic agents, or a combination thereof.

Peptide fractions are further separated from the MHC molecules by reversed-phase high performance liquid chromatography (HPLC) and sequenced. Peptides can be separated by a variety of other standard means well known to the artisan, including filtration, ultrafiltration, electrophoresis, size chromatography, precipitation with specific antibodies, ion exchange chromatography, isoelectrofocusing, and the like.

Sequencing of the isolated peptides can be performed according to standard techniques such as Edman degradation (Hunkapiller, M. W., et al., *Methods Enzymol.* 91, 399 [1983]). Other methods suitable for sequencing include mass spectrometry sequencing of individual peptides as previously described (Hunt, et al., *Science* 225:1261 (1992), which is incorporated herein by reference). Amino acid sequencing of bulk heterogenous peptides (e.g., pooled HPLC fractions) from different class I molecules typically reveals a characteristic sequence motif for each class I allele.

Upon identification of motif-bearing sequences, peptides corresponding to the sequences are then synthesized and, typically, evaluated for binding to the corresponding HLA allele. The capacity to bind MHC Class molecules is measured in a variety of different ways. One means is a Class I molecule binding assay as described in the related applications, noted above. Other alternatives described in the literature include inhibition of antigen presentation (Sette, et al., *J. Immunol.* 141:3893 (1991), in vitro assembly assays (Townsend, et al., *Cell* 62:285 (1990), and FACS based assays using mutated ells, such as RMA-S (Melief, et al., *Eur. J. Immunol.* 21:2963 (1991)).

Next, peptides that test positive in the MHC class I binding assay are assayed for the ability of the peptides to induce specific CTL (or HTL, for class II motif-bearing peptides) responses in vitro. For instance, antigen-presenting cells that have been incubated with a peptide can be assayed for the ability to induce CTL responses in responder cell populations. Antigen-presenting cells can be normal cells such as peripheral blood mononuclear cells or dendritic cells (Inaba, et al., *J. Exp. Med.* 166:182 (1987); Boog, *Eur. J. Immunol.* 18:219 [1988]). Alternatively, transgenic mice comprising an appropriate HLA transgene can be used to assay the ability of a peptide to induce a response in cytotoxic T lymphocytes essentially as described in copending U.S. patent application Ser. No. 08/205,713.

Definition of motifs specific for different class I alleles allows the identification of potential peptide epitopes from an antigenic protein whose amino acid sequence is known. Typically, identification of potential peptide epitopes is initially carried out using a computer to scan the amino acid sequence of a desired antigen for the presence of motifs.

Following identification of motif-bearing epitopes, the epitopic sequences are then synthesized. The capacity to bind MHC Class molecules is measured in a variety of different ways. One means is a Class I molecule binding assay as described in the related applications, noted below. Other alternatives described in the literature include inhibition of antigen presentation (Sette, et al., *J. Immunol.* 141:3893 (1991), in vitro assembly assays (Townsend, et al., *Cell* 62:285 (1990), and FACS based assays using mutated cells, such as RMA.S (Melief, et al., *Eur. J. Immunol.* 21:2963 (1991)).

As disclosed herein, higher HLA binding affinity is correlated with greater immunogenicity. Greater immunogenicity can be manifested in several different ways. Immunogenicity can correspond to whether an immune response is elicited at all, and to the vigor of any particular response, as well as to the extent of a diverse population in which a response is elicited. For example, a peptide might elicit an immune response in a diverse array of the population, yet in no instance produce a vigorous response. In accordance with the principles disclosed herein, close to 90% of high binding peptides have been found to be immunogenic, as contrasted with about 50% of the peptides which bind with intermediate affinity. Moreover, higher binding affinity peptides lead to more vigorous immunogenic responses. As a result, less peptide is required to elicit a similar biological effect if a high affinity binding peptide is used. Thus, in preferred embodiments of the invention, high affinity binding epitopes are particularly useful. Nevertheless, substantial improvements over the prior art are achieved with intermediate or high binding peptides.

The relationship between binding affinity for HLA class I molecules and immunogenicity of discrete peptide epitopes has been determined for the first time in the art by the present inventors. In these experiments, in which discrete peptides were referred to, it is to be noted that cellular processing of peptides in vivo will lead to such peptides even if longer fragments are used. Accordingly, longer peptides comprising one or more epitopes are within the scope of the invention. The correlation between binding affinity and immunogenicity was analyzed in two different experimental approaches (Sette, et al., *J. Immunol.* 153:5586-5592, 1994). In the first approach, the immunogenicity of potential epitopes ranging in HLA binding affinity over a 10,000-fold range was analyzed in HLA-A*0201 transgenic mice. In the second approach, the antigenicity of approximately 100 different hepatitis B virus (HBV)-derived potential epitopes, all carrying A*0201 binding motifs, was assessed by using PBL (peripheral blood lymphocytes) from acute hepatitis patients. Pursuant to these approaches, it was determined that an affinity threshold value of approximately 500 nM (preferably 50 nM or less) is correlated with the capacity of a peptide epitope to elicit a CTL response. These data are true for class I binding affinity measurements for naturally processed peptides and for synthesized T-cell epitopes. These data also indicate the important role of determinant selection in the shaping of T-cell responses (see, e.g., Schaeffer, et al., *Proc. Natl. Acad. Sci. USA* 86:4649-4653, 1989).

Accordingly, CTL-inducing peptides preferably include those that have an $IC_{50}$ for class I HLA molecules of 500 nM or less. In the case of motif-bearing peptide epitopes from tumor associated antigens, a binding affinity threshold of 200 nM has been shown to be associated with killing of tumor cells by resulting CTL populations.

In a preferred embodiment, following assessment of binding activity for an HLA-A2 allele-specific molecule, peptides exhibiting high or intermediate affinity are then considered for further analysis. Selected peptides may be tested on other members of the supertype family. In preferred embodiments, peptides that exhibit cross-reactive binding are then used in vaccines or in cellular screening analyses.

For example, peptides that test positive in the HLA-A2 (or other MHC class I) binding assay, i.e., that have binding affinity values of 500 nM or less, are assayed for the ability of the peptides to induce specific CTL responses in vitro. For instance, antigen-presenting cells that have been incubated with a peptide can be assayed for the ability to induce CTL responses in responder cell populations. Antigen-presenting cells can be normal cells such as peripheral blood mononuclear cells or dendritic cells (Inaba, et al., J. Exp. Med. 166:182 (1987); Boog, Eur. J. Immunol. 18:219 [1988]).

Alternatively, mutant mammalian cell lines that are deficient in their ability to load class I molecules with internally processed peptides, such as the mouse cell lines RMA-S (Karre, et al. *Nature,* 319:675 (1986); Ljunggren, et al., *Eur. J. Immunol.* 21:2963-2970 (1991)), and the human somatic T cell hybrid, T-2 (Cerundolo, et al., *Nature* 345:449-452 (1990)) and which have been transfected with the appropriate human class I genes are conveniently used, when peptide is added to them, to test for the capacity of the peptide to induce in vitro primary CTL responses. Other eukaryotic cell lines which could be used include various insect cell lines such as mosquito larvae (ATCC cell lines CCL 125, 126, 1660, 1591, 6585, 6586), silkworm (ATTC CRL 8851), armyworm (ATCC CRL 1711), moth (ATCC CCL 80) and *Drosophila* cell lines such as a Schneider cell line (see Schneider *J. Embryol. Exp. Morphol.* 27:353-65 [1927]). That have been transfected with the appropriate human class I MHC allele encoding genes and the human B2 microglobulin genes.

Peripheral blood lymphocytes are conveniently isolated following simple venipuncture or leukapheresis of normal donors or patients and used as the responder cell sources of CTL precursors. In one embodiment, the appropriate antigen-presenting cells are incubated with 10-100 μM of peptide in serum-free media for 4 hours under appropriate culture conditions. The peptide-loaded antigen-presenting cells are then incubated with the responder cell populations in vitro for 7 to 10 days under optimized culture conditions. Positive CTL activation can be determined by assaying the cultures for the presence of CTLs that kill radiolabeled target cells, both specific peptide-pulsed targets as well as target cells expressing the endogenously processed form of the relevant virus or tumor antigen from which the peptide sequence was derived.

Specificity and MHC restriction of the CTL is determined by testing against different peptide target cells expressing appropriate or inappropriate human MHC class I. The peptides that test positive in the MHC binding assays and give rise to specific CTL responses are referred to herein as immunogenic peptides.

After determining their binding affinity, additional confirmatory work can be performed to select, amongst these vaccine candidates, epitopes with preferred characteristics in terms of population coverage, antigenicity, and immunogenicity.

Thus, various strategies can be utilized to evaluate immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998); This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine-release or a $^{51}$Cr cytotoxicity assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997); In this method, peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from patients who have been effectively vaccinated or who have a tumor; (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997; Tsang et al., *J. Natl. Cancer Inst.* 87:982-990, 1995; Disis et al., *J. Immunol.* 156:3151-3158, 1996). In applying this strategy, recall responses are detected by culturing PBL from patients with cancer who have generated an immune response "naturally", or from patients who were vaccinated with tumor antigen vaccines. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays for T cell activity including $^{51}$Cr release involving peptide-sensitized targets, T cell proliferation, or lymphokine release.

Kast, et al. (*J. Immunol.* 152:3904-3912, 1994) have shown that motif-bearing peptides account for 90% of the epitopes that bind to allele-specific HLA class I molecules. In this study all possible peptides of 9 amino acids in length and overlapping by eight amino acids (240 peptides), which cover the entire sequence of the E6 and E7 proteins of human papillomavirus type 16, were evaluated for binding to five allele-specific HLA molecules that are expressed at high frequency among different ethnic groups. This unbiased set of peptides allowed an evaluation of the predictive value of HLA class I motifs. From the set of 240 peptides, 22 peptides were identified that bound to an allele-specific HLA molecules with high or intermediate affinity. Of these 22 peptides, 20, (i.e. 91%), were motif-bearing. Thus, this study demonstrated the value of motifs for the identification of peptide epitopes for inclusion in a vaccine: application of motif-based identification techniques eliminates screening of 90% of the potential epitopes. The quantity of available peptides, and the complexity of the screening process would make a comprehensive evaluation of an antigen highly difficult, if not impossible without use of motifs.

An immunogenic peptide epitope of the invention may be included in a polyepitopic vaccine composition comprising additional peptide epitopes of the same antigen, antigens from the same source, and/or antigens from a different source. Moreover, class II epitopes can be included along with class I epitopes. Peptide epitopes from the same antigen may be adjacent epitopes that are contiguous in sequence or may be obtained from different regions of the protein.

The relationship between binding affinity for HLA class I molecules and immunogenicity of discrete peptide epitopes on bound antigens has been analyzed in three different experimental approaches (see, e.g. Sette, et al., *J. Immunol.* 153: 5586 (1994)). In the first approach, the immunogenicity of potential epitopes ranging in MHC binding affinity over a 10,000-fold range was analyzed in HLA-A*0201 transgenic mice. In the second approach, the antigenicity of approximately 100 different hepatitis B virus (HBV)-derived potential epitopes, all carrying A*0201 binding motifs, was assessed by using PBL (peripheral blood lymphocytes) of acute hepatitis patients (see, e.g. Sette, et al., *J. Immunol.* 153:5586 (1994)). In the third approach the binding affinity of previously known antigenic peptides for the relevant HLA class I was determined (Sette et al. *Molec. Immunol.* 31:813, 1994) In all cases, it was found that an affinity threshold of approximately 500 nM (preferably 500 nM or less) determines the capacity of a peptide epitope to elicit a CTL response. In the case of class II HLA a relevant threshold of affinity was set at 1000 nM by similar studies performed by Southwood and colleagues (Southwood et al. *J. Immunol.* 160:3363-3373 (1998). These data also indicate the important role of determinant selection in the shaping of T cell responses.

Immunogenic peptides can be identified in relevant native sequences with reference e.g., to one of the supermotifs or motifs set out in TABLE 137, TABLE 138, and TABLE 139. A particular motif is denoted in the tables and is defined by its primary anchor residues, i.e. a motif bearing peptide must comprise at least one of the specified residues at each primary anchor position. A peptide may be analogued at any one or more of its primary anchor residues by exchanging one of the specified primary anchor residues with another primary anchor residue at the same position specified for the same motif. The numeric positions within each motif are designated in an amino to carboxyl orientation. Alternatively, a peptide may be analogued at any one or more of the designated secondary anchor residues described on TABLE 138 and TABLE 139 by exchanging an existing residue with one of the designated secondary anchor residues at the designated positions. In a preferred embodiment, to enhance binding affinity, deleterious residues are removed from native sequences; similarly deleterious residues are not used to substitute for another residue at a designated position. Modifications to a primary anchor position and/or a secondary anchor position may be made at one position or multiple positions.

Peptides that comprise epitopes and/or immunogenic peptides of the invention can be prepared synthetically, or by recombinant DNA technology or from natural sources such as whole viruses or tumors. Although the peptide will preferably be substantially free of other naturally occurring host cell proteins and fragments thereof, in some embodiments the peptides can be synthetically conjugated to native fragments or particles.

The present invention relates to allele-specific peptide motifs and binding peptides for human and murine MHC allele. It is contemplated that the peptide binding motifs of the invention are relatively specific for each allele. In an embodiment of the invention, the allele-specific motifs and binding peptides are for human class I MHC (or HLA) alleles. HLA alleles include HLA-A, HLA-B, and HLA-C alleles. In another embodiment of the invention the allele-specific motifs and binding peptides are for human class II MHC (or HLA) alleles. Such HLA alleles include HLA-DR and HLA-DQ alleles. HLA molecules that share similar binding affinity for peptides bearing certain amino acid motifs are grouped into HLA supertypes. See, i.e., Stites, et al., IMMUNOLOGY, $8^{TH}$ ED., Lange Publishing, Los Altos, Calif. (1994). Peptides that bind one or more alleles in one or more supertypes are contemplated as part of the invention. Examples of the supertypes within HLA-A and HLA-B molecules are shown in FIG. 2. In yet another embodiment, the allele-specific motifs and binding peptides are for murine class I (or H-2) MHC alleles. Such H-2 alleles include H-2Dd, H-2Kb, H-2Kd, H-2Db, H-2Ld, and H-2Kk. Exemplary tables describing allele-specific motifs are presented below. Binding within a particular supertype for murine MHC alleles is also contemplated.

These peptides were then used to define specific binding motifs for each of the following alleles A3.2, A1, A11, and A24.1. These motifs are described previously. The motifs described in TABLES 6-9, below, are defined from pool sequencing data of naturally processed peptides as described in the related applications. Preferred (i.e., canonical) and tolerated (i.e., extended) residues associated with anchor positions of the indicated HLA supertypes are presented in FIG. 2 and TABLE 3.

In one embodiment, the motif for HLA-A3.2 comprises from the N-terminus to C-terminus a first conserved residue of L, M, I, V, S, A, T and F at position 2 and a second conserved residue of K, R or Y at the C-terminal end. Other first conserved residues are C, G or D and alternatively E. Other second conserved residues are H or F. The first and second conserved residues are preferably separated by 6 to 7 residues. In another embodiment, the motif for HLA-A1 comprises from the N-terminus to the C-terminus a first conserved residue of T, S or M, a second conserved residue of D or E, and a third conserved residue of Y. Other second conserved residues are A, S or T. The first and second conserved residues are adjacent and are preferably separated from the third conserved residue by 6 to 7 residues. A second motif consists of a first conserved residue of E or D and a second conserved residue of Y where the first and second conserved residues are separated by 5 to 6 residues.

In yet another embodiment, the motif for HLA-A11 comprises from the N-terminus to the C-terminus a first conserved residue of T, V, M, L, I, S, A, G, N, C D, or F at position 2 and a C-terminal conserved residue of K, R, Y or H. The first and second conserved residues are preferably separated by 6 or 7 residues. In one embodiment, the motif for HLA-A24.1 comprises from the N-terminus to the C-terminus a first conserved residue of Y, F or W at position 2 and a C terminal conserved residue of F, I, W, M or L. The first and second conserved residues are preferably separated by 6 to 7 residues.

The MHC-binding peptides identified herein represent epitopes of a native antigen. With regard to a particular amino acid sequence, an epitope is a set of amino acid residues which is recognized by a particular antibody or T cell receptor. Such epitopes are usually presented to lymphocytes via the MHC-peptide complex. An epitope retains the collective features of a molecule, such as primary, secondary and tertiary peptide structure, and charge, that together form a site recognized by an antibody, T cell receptor or MHC molecule. It is to be appreciated, however, that isolated or purified protein or peptide molecules larger than and comprising an epitope of the invention are still within the bounds of the invention. Moreover, it is contemplated that synthesized peptides can incorporate various biochemical changes that enhance their immunological effectiveness.

The epitopes present in the invention can be dominant, sub-dominant, or cryptic. A dominant epitope is an epitope that induces an immune response upon immunization with a whole native antigen. See, i.e., Sercarz, et al., *Ann. Rev. Immunol.* 11: 729-766 (1993). Such a peptide is considered immunogenic because it elicits a response against the whole antigen. A subdominant epitope, on the other hand, is one that evokes little or no response upon immunization with whole antigen that contains the epitope, but for which a response can be obtained by immunization with an isolated epitope. Immunization with a sub-dominant epitope will prime for a secondary response to the intact native antigen. A cryptic epitope elicits a response by immunization with an isolated peptide, but fails to prime a secondary response to a subsequent challenge with whole antigen.

An epitope present in the invention can be cross-reactive or non-cross-reactive in its interactions with MHC alleles and alleles subtypes. Cross-reactive binding of an epitope (or peptide) permits an epitope to be bound by more than one HLA molecule. Such cross-reactivity is also known as degenerate binding. A non-cross-reactive epitope would be restricted to binding a particular MHC allele or allele subtype.

Cross-reactive binding of HLA-A2.1 motif-bearing peptides with other HLA-A2 allele-specific molecules can occur. Those allele-specific molecules that share binding specificities with HLA-A2.1 are deemed to comprise the HLA-A2.1 supertype. The B pocket of A2 supertype HLA molecules is characterized by a consensus motif including residues (this nomenclature uses single letter amino acid codes, where the subscript indicates peptide position) $F/Y_9$, $A_{24}$, $M_{45}$, $E/N_{63}$, $K/N_{66}$, $V_{67}$, $H/Q_{70}$ and $Y/C_{99}$. Similarly, the A2-supertype F pocket is characterized by a consensus motif including residues $D_{77}$, $T_{80}$, $L_{81}$ and $Y_{116}$ (155). About 66% of the peptides binding A*0201 will be cross-reactive amongst three or more A2-supertype alleles.

The A2 supertype as defined herein is consistent with cross-reactivity data, (Fruci, D. et al., *Hum. Immunol.* 38:187, 1993), from live cell binding assays (del Guercio, M.-F. et al., *J. Immunol.* 154:685, 1995) and data obtained by sequencing naturally processed peptides (Sudo, T., et al., *J. Immunol.* 155:4749, 1995) bound to HLA-A2 allele-specific molecules. Accordingly the family of HLA molecules (i.e., the HLA-A2 supertype that binds these peptides) is comprised of at least nine HLA-A proteins: A*0201, A*0202, A*0203, A*0204, A*0205, A*0206, A*0207, A*6802, and A*6901.

As described herein, the HLA-A2 supermotif comprises peptide ligands with L, I, V, M, A, T, or Q as primary anchor residues at position 2 and L, I, V, M, A, or T as a primary anchor residue at the C-terminal position of the epitope. HLA-A2 motifs that are most particularly relevant to the invention claimed here comprise V, A, T, or Q at position two and L, I, V, M, A, or T at the C-terminal anchor position. A peptide epitope comprising an HLA-A2 supermotif may bind more than one HLA-A2 supertype molecule.

The epitopes of the present invention can be any suitable length. Class I molecule binding peptides typically are about 8 to 13 amino acids in length, and often 9, 10, 11, or 12 amino acids in length. These peptides include conserved amino acids at certain positions such as the second position from the N-terminus and the C-terminal position. Also, the peptides often do not include amino acids at certain positions that negatively affect binding of the peptide to the HLA molecules. For example, the peptides often do not include amino acids at positions 1, 3, 6 and/or 7 for peptides 9 amino acid peptides in length or positions 1, 3, 4, 5, 7, 8 and/or 9 for peptides 10 amino acids in length. Further, defined herein are positions within a peptide sequence that can be utilized as criteria for selecting HLA-binding peptide. These defined positions are often referred to herein as a binding "motif."

Definition of motifs specific for different MHC alleles allows the identification of potential peptide epitopes from an antigenic protein whose amino acid sequence is known. Typically, identification of potential peptide epitopes is initially carried out using a computer to scan the amino acid sequence of a desired antigen for the presence of motifs. The epitopic sequences are then synthesized.

In general, class I peptide binding motifs generally include a first conserved residue at position two from the N-terminus (wherein the N-terminal residue is position one) and a second conserved residue at the C-terminal position (often position 9 or 10). As a specific example, the HLA A*0201 class I peptide binding motifs include a first conserved residue at position two from the N-terminus (wherein the N-terminal residue is position one) selected from the group consisting of I, V, A and T and a second conserved residue at the C-terminal position selected from the group consisting of V, L, I, A and M. Alternatively, the peptide may have a first conserved residue at the second position from the N-terminus (wherein the N-terminal residue is position one) selected from the group consisting of L, M, I, V, A and T; and a second conserved residue at the C-terminal position selected from the group consisting of A and M. If the peptide has 10 residues it will contain a first conserved residue at the second position from the N-terminus (wherein the N-terminal residue is position one) selected from the group consisting of L, M, I, V, A, and T; and a second conserved residue at the C-terminal position selected from the group consisting of V, I, L, A and M; wherein the first and second conserved residues are separated by 7 residues.

One embodiment of an HTL-inducing peptide is less than about 50 residues in length and usually consist of between about 6 and about 30 residues, more usually between about 12 and 25, and often between about 15 and 20 residues, for example 15, 16, 17, 18, 19, or 20 residues. One embodiment of a CTL-inducing peptide is 13 residues or less in length and usually consists of about 8, 9, 10 or 11 residues, preferably 9 or 10 residues. In one embodiment, HLA-DR3 a binding is characterized by an L, I, V, M, F or Y residue at position 1 and a D or E residue at position 4. In another embodiment, HLA-DR3 b binding is characterized by an L, I, V, M, F, Y or A residue at position 1, a D, E, N, Q, S or T residue at position 4, and a K, R or H residue at position 6. In another embodiment, key anchor residues of a DR supertype binding motif are an L, I, V, M, F, W or Y residue at position 1 and an L, I, V, M, S, T, P, C or A residue at position 6. See, TABLE 3.

Moreover, in another embodiment, murine Db binding is characterized by an N residue at position 5 and L, I, V or M residue at the C-terminal position. In yet another embodiment, murine Kb binding is characterized by a Y or F residue at position 5 and an L, I, V or M residue at the C-terminal position. In an additional embodiment, murine Kd binding is characterized a Y or F residue at position 2 and an L, I, V, or M residue at the C-terminal position. In a further embodiment, murine Kk binding is characterized by an E or D residue at position 2 and an L, I, M, V, F, W, Y or A residue at the C-terminal position. In a further embodiment, murine Ld binding is characterized by a P residue at position 2 and an L, I, M, V, F, W or Y residue at the C-terminal position. See, TABLE 5.

HLA Class I Motifs Indicative of CTL Inducing Peptide Epitopes:

The primary anchor residues of the HLA class I peptide epitope supermotifs and motifs are delineated below. In some cases, peptide epitopes may be listed in both a motif and a supermotif Table. The relationship of a particular motif and respective supermotif is indicated in the description of the individual motifs.

The HLA-A1 supermotif is characterized by the presence in peptide ligands of a small (T or S) or hydrophobic (L, I, V, or M) primary anchor residue in position 2, and an aromatic (Y, F, or W) primary anchor residue at the C-terminal position of the epitope. The corresponding family of HLA molecules that bind to the A1 supermotif (i.e., the HLA-A1 supertype) is comprised of at least A*0101, A*2601, A*2602, A*2501, and A*3201 (see, e.g., DiBrino, M. et al., *J. Immunol.* 151:5930, 1993; DiBrino, M. et al., *J. Immunol.* 152:620, 1994; Kondo, A. et al., *Immunogenetics* 45:249, 1997). Other allele-specific HLA molecules predicted to be members of the A1 superfamily are shown in Table 137. Peptides binding to each of the individual HLA proteins can be modulated by substitutions at primary and/or secondary anchor positions, preferably choosing respective residues specified for the supermotif.

Primary anchor specificities for allele-specific HLA-A2.1 molecules (see, e.g., Falk et al., *Nature* 351:290-296, 1991; Hunt et al., *Science* 255:1261-1263, 1992; Parker et al., *J. Immunol.* 149:3580-3587, 1992; Ruppert et al., *Cell* 74:929-937, 1993) and cross-reactive binding among HLA-A2 and -A28 molecules have been described. (See, e.g., Fruci et al., *Human Immunol.* 38:187-192, 1993; Tanigaki et al., *Human Immunol.* 39:155-162, 1994; Del Guercio et al., *J. Immunol.* 154:685-693, 1995; Kast et al., *J. Immunol.* 152:3904-3912, 1994 for reviews of relevant data.) These primary anchor residues define the HLA-A2 supermotif; which presence in peptide ligands corresponds to the ability to bind several different HLA-A2 and -A28 molecules. The HLA-A2 supermotif comprises peptide ligands with L, I, V, M, A, T, or Q as a primary anchor residue at position 2 and L, I, V, M, A, or T as a primary anchor residue at the C-terminal position of the epitope.

The corresponding family of HLA molecules (i.e., the HLA-A2 supertype that binds these peptides) is comprised of at least: A*0201, A*0202, A*0203, A*0204, A*0205, A*0206, A*0207, A*0209, A*0214, A*6802, and A*6901. Other allele-specific HLA molecules predicted to be members of the A2 superfamily are shown in Table 137. As explained in detail below, binding to each of the individual allele-specific HLA molecules can be modulated by substitutions at the primary anchor and/or secondary anchor positions, preferably choosing respective residues specified for the supermotif.

The HLA-A3 supermotif is characterized by the presence in peptide ligands of A, L, I, V, M, S, or, T as a primary anchor at position 2, and a positively charged residue, R or K, at the C-terminal position of the epitope, e.g., in position 9 of 9-mers (see, e.g., Sidney et al., *Hum. Immunol.* 45:79, 1996). Exemplary members of the corresponding family of HLA molecules (the HLA-A3 supertype) that bind the A3 supermotif include at least A*0301, A*1101, A*3101, A*3301, and A*6801. Other allele-specific HLA molecules predicted to be members of the A3 supertype are shown in Table 1. As explained in detail below, peptide binding to each of the individual allele-specific HLA proteins can be modulated by substitutions of amino acids at the primary and/or secondary anchor positions of the peptide, preferably choosing respective residues specified for the supermotif.

The HLA-A24 supermotif is characterized by the presence in peptide ligands of an aromatic (F, W, or Y) or hydrophobic aliphatic (L, I, V, M, or T) residue as a primary anchor in position 2, and Y, F, W, L, I, or M as primary anchor at the C-terminal position of the epitope (see, e.g., Sette and Sidney, *Immunogenetics*, in press, 1999). The corresponding family of HLA molecules that bind to the A24 supermotif (i.e., the A24 supertype) includes at least A*2402, A*3001, and A*2301. Other allele-specific HLA molecules predicted to be members of the A24 supertype are shown in Table 137. Peptide binding to each of the allele-specific HLA molecules can be modulated by substitutions at primary and/or secondary anchor positions, preferably choosing respective residues specified for the supermotif.

The HLA-B7 supermotif is characterized by peptides bearing proline in position 2 as a primary anchor, and a hydrophobic or aliphatic amino acid (L, I, V, M, A, F, W, or Y) as the primary anchor at the C-terminal position of the epitope. The corresponding family of HLA molecules that bind the B7 supermotif (i.e., the HLA-B7 supertype) is comprised of at least twenty six HLA-B proteins including: B*0702, B*0703, B*0704, B*0705, B*1508, B*3501, B*3502, B*3503, B*3504, B*3505, B*3506, B*3507, B*3508, B*5101, B*5102, B*5103, B*5104, B*5105, B*5301, B*5401, B*5501, B*5502, B*5601, B*5602, B*6701, and B*7801 (see, e.g., Sidney, et al., *J. Immunol.* 154:247, 1995; Barber, et al., *Curr. Biol.* 5:179, 1995; Hill, et al., *Nature* 360:434, 1992; Rammensee, et al., *Immunogenetics* 41:178, 1995 for reviews of relevant data). Other allele-specific HLA molecules predicted to be members of the B7 supertype are shown in Table 137. As explained in detail below, peptide binding to each of the individual allele-specific HLA proteins can be modulated by substitutions at the primary and/or secondary anchor positions of the peptide, preferably choosing respective residues specified for the supermotif.

The HLA-B27 supermotif is characterized by the presence in peptide ligands of a positively charged (R, H, or K) residue as a primary anchor at position 2, and a hydrophobic (F, Y, L, W, M, I, A, or V) residue as a primary anchor at the C-terminal position of the epitope (see, e.g., Sidney and Sette, *Immunogenetics*, in press, 1999). Exemplary members of the corresponding family of HLA molecules that bind to the B27 supermotif (i.e., the B27 supertype) include at least B*1401, B*1402, B*1509, B*2702, B*2703, B*2704, B*2705, B*2706, B*3801, B*3901, B*3902, and B*7301. Other allele-specific HLA molecules predicted to be members of the B27 supertype are shown in Table 137. Peptide binding to each of the allele-specific HLA molecules can be modulated by substitutions at primary and/or secondary anchor positions, preferably choosing respective residues specified for the supermotif.

The HLA-B44 supermotif is characterized by the presence in peptide ligands of negatively charged (D or E) residues as a primary anchor in position 2, and hydrophobic residues (F, W, Y, L, I, M, V, or A) as a primary anchor at the C-terminal position of the epitope (see, e.g., Sidney et al., *Immunol. Today* 17:261, 1996). Exemplary members of the corresponding family of HLA molecules that bind to the B44 supermotif (i.e., the B44 supertype) include at least: B*1801, B*1802, B*3701, B*4001, B*4002, B*4006, B*4402, B*4403, and B*4006. Peptide binding to each of the allele-specific HLA molecules can be modulated by substitutions at primary and/or secondary anchor positions; preferably choosing respective residues specified for the supermotif.

The HLA-B58 supermotif is characterized by the presence in peptide ligands of a small aliphatic residue (A, S, or T) as a primary anchor residue at position 2, and an aromatic or hydrophobic residue (F, W, Y, L, I, V, M, or A) as a primary anchor residue at the C-terminal position of the epitope (see, e.g., Sidney and Sette, *Immunogenetics*, in press, 1999 for reviews of relevant data). Exemplary members of the corresponding family of HLA molecules that bind to the B58 supermotif (i.e., the B58 supertype) include at least: B*1516, B*1517, B*5701, B*5702, and B*5801. Other allele-specific HLA molecules predicted to be members of the B58 supertype are shown in Table 137. Peptide binding to each of the allele-specific HLA molecules can be modulated by substitutions at primary and/or secondary anchor positions, preferably choosing respective residues specified for the supermotif.

The HLA-B62 supermotif is characterized by the presence in peptide ligands of the polar aliphatic residue Q or a hydrophobic aliphatic residue (L, V, M, I, or P) as a primary anchor in position 2, and a hydrophobic residue (F, W, Y, M, I, V, L, or A) as a primary anchor at the C-terminal position of the epitope (see, e.g., Sidney and Sette, *Immunogenetics*, in press, 1999). Exemplary members of the corresponding family of HLA molecules that bind to the B62 supermotif (i.e., the B62 supertype) include at least: B*1501, B*1502, B*1513, and B5201. Other allele-specific HLA molecules predicted to be members of the B62 supertype are shown in Table 137

Peptide binding to each of the allele-specific HLA molecules can be modulated by substitutions at primary and/or secondary anchor positions, preferably choosing respective residues specified for the supermotif.

The HLA-A1 motif is characterized by the presence in peptide ligands of T, S, or M as a primary anchor residue at position 2 and the presence of Y as a primary anchor residue at the C-terminal position of the epitope. An alternative allele-specific A1 motif is characterized by a primary anchor residue at position 3 rather than position 2. This motif is characterized by the presence of D, E, A, or S as a primary anchor residue in position 3, and a Y as a primary anchor residue at the C-terminal position of the epitope (see, e.g., DiBrino et al., J. Immunol., 152:620, 1994; Kondo et al., *Immunogenetics* 45:249, 1997; and Kubo et al., *J. Immunol.* 152:3913, 1994 for reviews of relevant data). An HLA-A1 extended motif includes a D residue in position 3 and A, I, L, or F at the C-terminus. Peptide binding to HLA A1 can be modulated by substitutions at primary and/or secondary anchor positions, preferably choosing respective residues specified for the motif. Residues T, S, or M at position 2 and Y at the C-terminal position are a subset of the A1 supermotif primary anchors.

An HLA-A2*0201 motif was characterized by the presence in peptide ligands of L or M as a primary anchor residue in position 2, and L or V as a primary anchor residue at the C-terminal position of a 9-residue peptide (see, e.g., Falk et al., *Nature* 351:290-296, 1991) and was further found to comprise an I at position 2 and I or A at the C-terminal position of a nine amino acid peptide (see, e.g., Hunt et al., Science 255:1261-1263, Mar. 6, 1992; Parker et al., *J. Immunol.* 149:3580-3587, 1992). The A*0201 allele-specific motif has also been defined to additionally comprise V, A, T, or Q as a primary anchor residue at position 2, and M or T as a primary anchor residue at the C-terminal position of the epitope (see, e.g., Kast et al., *J. Immunol.* 152:3904-3912, 1994). Thus, the HLA-A*0201 motif comprises peptide ligands with L, I, V, M, A, T, or Q as primary anchor residues at position 2 and L, I, V, M, A, or T as a primary anchor residue at the C-terminal position of the epitope. The preferred and tolerated residues that characterize the primary anchor positions of the HLA-A*0201 motif are identical to the residues describing the A2 supermotif. (For reviews of relevant data, see, e.g., Del Guercio et al., *J. Immunol.* 154:685-693, 1995; Ruppert et al., *Cell* 74:929-937, 1993; Sidney et al., *Immunol. Today* 17:261-266, 1996; Sette and Sidney, *Curr. Opin. in Immunol.* 10:478-482, 1998). Secondary anchor residues that characterize the A*0201 motif have additionally been defined (see, e.g., Ruppert et al., *Cell* 74:929-937, 1993). Peptide binding to HLA-A*0201 molecules can be modulated by substitutions at primary and/or secondary anchor positions, preferably choosing respective residues specified for the motif.

The HLA-A3 motif is characterized by the presence in peptide ligands of L, M, V, I, S, A, T, F, C, G, or D as a primary anchor residue at position 2, and the presence of K, Y, R, H, F, or A as a primary anchor residue at the C-terminal position of the epitope (see, e.g., DiBrino et al., *Proc. Natl. Acad. Sci USA* 90:1508, 1993; and Kubo et al., *J. Immunol.* 152:3913-3924, 1994). Peptide binding to HLA-A3 can be modulated by substitutions at primary and/or secondary anchor positions, preferably choosing respective residues specified for the motif.

The HLA-A11 motif is characterized by the presence in peptide ligands of V, T, M, L, I, S, A, G, N, C, D, or F as a primary anchor residue in position 2, and K, R, Y, or H as a primary anchor residue at the C-terminal position of the epitope (see, e.g., Zhang et al., *Proc. Natl. Acad. Sci USA* 90:2217-2221, 1993; and Kubo et al., *J. Immunol.* 152:3913-3924, 1994). Peptide binding to HLA-A11 can be modulated by substitutions at primary and/or secondary anchor positions, preferably choosing respective residues specified for the motif.

The HLA-A24 motif is characterized by the presence in peptide ligands of Y, F, W, or M as a primary anchor residue in position 2, and F, L, I, or W as a primary anchor residue at the C-terminal position of the epitope (see, e.g., Kondo et al., *J. Immunol.* 155:4307-4312, 1995; and Kubo et al., *J. Immunol.* 152:3913-3924, 1994). Peptide binding to HLA-A24 molecules can be modulated by substitutions at primary and/or secondary anchor positions; preferably choosing respective residues specified for the motif.

Motifs Indicative of Class II HTL Inducing Peptide Epitope

The primary anchor residues of the HLA class II supermotifs and motifs are delineated below.

HLA DR-1-4-7 Supermotif

Motifs have also been identified for peptides that bind to three common HLA class II allele-specific HLA molecules: HLA DRB1*0401, DRB1*0101, and DRB1*0701 (see, e.g., the review by Southwood et al. *J. Immunology* 160:3363-3373, 1998). Collectively, the common residues from these motifs delineate the HLA DR-1-4-7 supermotif. Peptides that bind to these DR molecules carry a supermotif characterized by a large aromatic or hydrophobic residue (Y, F, W, L, I, V, or M) as a primary anchor residue in position 1, and a small, non-charged residue (S, T, C, A, P, V, I, L, or M) as a primary anchor residue in position 6 of a 9-mer core region. Allele-specific secondary effects and secondary anchors for each of these HLA types have also been identified (Southwood et al., supra). These are set forth in Table 139. Peptide binding to HLA-DRB1*0401, DRB1*0101, and/or DRB1*0701 can be modulated by substitutions at primary and/or secondary anchor positions, preferably choosing respective residues specified for the supermotif.

Two alternative motifs (i.e., submotifs) characterize peptide epitopes that bind to HLA-DR3 molecules (see, e.g., Geluk et al., *J. Immunol.* 152:5742, 1994). In the first motif (submotif DR3A) a large, hydrophobic residue (L, I, V, M, F, or Y) is present in anchor position 1 of a 9-mer core, and D is present as an anchor at position 4, towards the carboxyl terminus of the epitope. As in other class II motifs, core position 1 may or may not occupy the peptide N-terminal position.

The alternative DR3 submotif provides for lack of the large, hydrophobic residue at anchor position 1, and/or lack of the negatively charged or amide-like anchor residue at position 4, by the presence of a positive charge at position 6 towards the carboxyl terminus of the epitope. Thus, for the alternative allele-specific DR3 motif (submotif DR3B): L, I, V, M, F, Y, A, or Y is present at anchor position 1; D, N, Q, E, S, or T is present at anchor position 4; and K, R, or H is present at anchor position 6. Peptide binding to HLA-DR3 can be modulated by substitutions at primary and/or secondary anchor positions, preferably choosing respective residues specified for the motif.

As with HLA class I binding peptides, motifs have also been defined for HLA class II-binding peptides. Several studies have identified an important role for an aromatic or hydrophobic residue (I, L, M, V, F, W, or Y) at position 1 of a 9-mer core region, typically nested within a longer peptide sequence, in the binding of peptide ligands to several HLA-class II alleles (Hammer et al. *Cell* 74:197, (1993); Sette et al. *J. Immunol.* 151:3163-70 (1993); O'Sullivan et al. *J. Immunol.* 147:2663 (1991); and Southwood et al. *J. Immunol.* 160:3363-73 (1998)). A strong role has also been demonstrated for the residue in position 6 of the 9-mer core, where short and/or hydrophobic residues (S, T, C, A, P, V, I, L, or M) are preferred. This position 1-position 6 motif has been described as a DR-supermotif (Southwood et al. *J. Immunol.* 160:3363-3373 (1998)) and has been shown to efficiently identify peptides capable of binding a large set of common HLA-class II alleles.

Peptides binding to class II molecules may also be analyzed with respect to the identification of secondary preferred or deleterious residues. For example, to derive a more detailed DRB1*0401 motif to define secondary residues influencing peptide binding, we employed a strategy similar to that performed with class I peptides. For each peptide analyzed, nine-residue-long core regions were aligned on the basis of the primary class II positions P1 and P6 anchors. Then, the average binding affinity of a peptide carrying a particular residue was calculated for each position, relative to the remainder of the group. Following this method, values showing average relative binding were compiled. These values also present a map of the positive or negative effect of each of the 20 naturally occurring amino acids in DRB1*0401 binding capacity when occupying a particular position relative to the P1-P6 class II motif positions.

Variations in average relative binding of greater than or equal to fourfold or less than or equal to 0.25 were arbitrarily considered significant and indicative of secondary effects of a given residue on HLA-peptide interactions. Most secondary effects were associated with P4, P7, and P9. These positions correspond to secondary anchors engaging shallow pockets on the DR molecule. Similar studies defining secondary residues were also performed for DRB1*0101 and DRB1*0701. The definitions of secondary residues of motifs for DR1, DR4, and DR7 are shown in TABLE 139.

Upon definition of allele-specific secondary effects and secondary anchors, allele-specific algorithms were derived and utilized to identify peptides binding DRB1*0101, DRB1*0401, and DRB*0701. Further experiments, identified a large set of HLA class II molecules, which includes at least the DRB1*0101, DRB1*0401, and DRB*0701, DRB1*1501, DRB1*0901 and DRB1*1302 allelic products recognizing the DR supermotif, and is characterized by largely overlapping peptide binding repertoires.

The data presented above confirm that several common HLA class II types are characterized by largely overlapping peptide binding repertoires. On this basis, in analogy to the case of HLA class I molecules, HLA class II molecules can be grouped in a HLA class II supertype, defined and characterized by similar, or largely overlapping (albeit not identical) peptide binding specificities.

Analogs of HLA class II binding peptides that bear HLA class II motifs may be created in a manner similar to Class I molecules. Peptides bearing motifs may be modified at primary anchor residues to modulate binding affinity, at secondary residues or both primary and secondary residues. Examples may be found in related application U.S. Ser. No. 08/121,101. For example, the $TT_{830-843}$ peptide (QYIKANSKFIGITE (SEQ ID NO:14622) is capable of binding strongly, i.e. with an affinity of between 10-100 nM, to many DR alleles including DR1, DR2, DR5, and DR7. However, the peptide binds 100-1000-fold less well to DR4w4. It was predicted that the lower affinity of $TT_{830-843}$ for DR4w4 correlated with the presence of a positive charge in position 7 ($K_{837}$) in the DR binding motif. Positive charges in position 7 are allowed in the case of DR1 or DR7, but not in the case of DR4w4. For this reason, it was predicted that TT analogs carrying a non-charged residue in position 837 would be good DR4w4 binders. Analysis of the binding characteristics of a peptide analog bearing an S substitution for the charged K residue demonstrated that the analog was capable of binding at much higher affinity to DR4w4 compared to the native peptide, i.e. the $IC_{50}$ of the analog was 13 nM compared to an $IC_{50}$ of 15,000 nM for the native sequence.

The peptides present in the invention can be identified by any suitable method. For example, peptides are conveniently identified using the algorithms of the invention described in the co-pending U.S. patent application Ser. No. 09/894,018. These algorithms are mathematical procedures that produce a score which enables the selection of immunogenic peptides. Typically one uses the algorithmic score with a binding threshold to enable selection of peptides that have a high probability of binding at a certain affinity and will in turn be immunogenic. The algorithm are based upon either the effects on MHC binding of a particular amino acid at a particular position of a peptide or the effects on binding MHC of a particular substitution in a motif containing peptide.

Peptide sequences characterized in molecular binding assays and capture assays have been and can be identified utilizing various technologies. Motif-positive sequences are identified using a customized application created at Epimmune. Sequences are also identified utilizing matrix-based algorithms, and have been used in conjunction with a "power" module that generates a predicted 50% inhibitory concentration (PIC) value. These latter methods are operational on Epimmune's HTML-based Epitope Information System (EIS) database. All of the described methods are viable options in peptide sequence selection for $IC_{50}$ determination using binding assays.

Additional procedures useful in identifying the peptides of the present invention generally follow the methods disclosed in Falk et al., *Nature* 351:290 (1991). Briefly, the methods involve large-scale isolation of MHC class I molecules, typically by immunoprecipitation or affinity chromatography, from the appropriate cell or cell line. Examples of other methods for isolation of the desired MHC molecule equally well known to the artisan include ion exchange chromatography, lectin chromatography, size exclusion, high performance liquid chromatography, and a combination of some or all of the above techniques.

For example, isolation of peptides bound to MHC class I molecules include lowering the culture temperature from 37° C. to 26° C. overnight to destabilize $\beta_2$ microglobulin and stripping the endogenous peptides from the cell using a mild acid treatment. The methods release previously bound peptides into the extracellular environment allowing new exogenous peptides to bind to the empty class I molecules. The cold-temperature incubation method enables exogenous peptides to bind efficiently to the MHC complex, but requires an overnight incubation at 26° C. which may slow the cell's metabolic rate. It is also likely that cells not actively synthesizing MHC molecules (i.e., resting PBMC) would not produce high amounts of empty surface MHC molecules by the cold temperature procedure.

Immunoprecipitation is also used to isolate the desired allele. A number of protocols can be used, depending upon the specificity of the antibodies used. For example, allele-specific mAb reagents can be used for the affinity purification of the HLA-A, HLA-B, and HLA-C molecules. Several mAb reagents for the isolation of HLA-A molecules are available (TABLE 3). Monoclonal antibody BB7.2 is suitable for isolating HLA-A2 molecules. Thus, for each of the targeted HLA-A alleles, reagents are available that may be used for the direct isolation of the HLA-A molecules. Affinity columns prepared with these mAbs using standard techniques are successfully used to purify the respective HLA-A allele products.

In addition to allele-specific mAbs, broadly reactive anti-HLA-A, B, C mAbs, such as W6/32 and B9.12.1, and one anti-HLA-B, C mAb, B1.23.2, could be used in alternative affinity purification protocols as described in patents and patent applications described herein.

The peptides bound to the peptide binding groove of the isolated MHC molecules are typically eluted using acid treatment. Peptides can also be dissociated from MHC molecules by a variety of standard denaturing means, such as, for example, heat, pH, detergents, salts, chaotropic agents, or a combination acid treatment and/or more standard denaturing means.

Peptide fractions are further separated from the MHC molecules by reversed-phase high performance liquid chromatography (HPLC) and sequenced. Peptides can be separated by a variety of other standard means well known to the artisan, including filtration, ultrafiltration, electrophoresis, size chromatography, precipitation with specific antibodies, ion exchange chromatography, isoelectrofocusing, and the like.

Sequencing of the isolated peptides can be performed according to standard techniques such as Edman degradation (Hunkapiller, M. W., et al., *Methods Enzymol.* 91, 399 (1983)). Other methods suitable for sequencing include mass spectrometry sequencing of individual peptides as previously described (Hunt, et al., *Science* 225:1261 (1992)). Amino acid sequencing of bulk heterogeneous peptides (i.e., pooled HPLC fractions) from different MHC molecules typically reveals a characteristic sequence motif for each MHC allele. For assays of peptide-HLA interactions (e.g., quantitative binding assays) cells with defined MHC molecules are useful.

A large number of cells with defined MHC molecules, particularly MHC Class I molecules, are known and readily available. For example, human EBV-transformed B cell lines have been shown to be excellent sources for the preparative isolation of class I and class II MHC molecules. Well-characterized cell lines are available from private and commercial sources, such as American Type Culture Collection ("Catalogue of Cell Lines and Hybridomas," 6th edition (1988) Manassas, Va., U.S.A.); National Institute of General Medical Sciences 1990/1991 Catalog of Cell Lines (NIGMS) Human Genetic Mutant Cell Repository, Camden, N.J.; and ASHI Repository, Brigham and Women's Hospital, 75 Francis Street, Boston, Mass. 02115. TABLE 3 and TABLE 23 list some B cell lines suitable for use as sources for HLA alleles. All of these cell lines can be grown in large batches and are therefore useful for large scale production of MHC molecules. One of skill will recognize that these are merely exemplary cell lines and that many other cell sources can be employed. Similar EBV B cell lines homozygous for HLA-B and HLA-C could serve as sources for HLA-B and HLA-C alleles, respectively. Specific cell lines and antibodies used to determine class II and murine peptides disclosed herein are set forth in TABLES 6 and 7.

The peptides of the invention can be prepared synthetically, or by recombinant DNA technology or from natural sources such as whole viruses or tumors. Although the peptide will preferably be substantially free of other naturally occurring host cell proteins and fragments thereof, in some embodiments the peptides can be synthetically or naturally conjugated to native protein fragments or particles. The peptides of the invention can be prepared in a wide variety of ways. Because of their relatively short size, the peptides can be synthesized in solution or on a solid support in accordance with conventional techniques. Various automatic synthesizers are commercially available and can be used in accordance with known protocols. See, for example, Stewart and Young, *Solid Phase Peptide Synthesis,* 2d. ed., Pierce Chemical Co. (1984), supra.

The capacity to bind MHC molecules is measured in a variety of different ways. One means is a MHC binding assay as described in the related applications, noted above. Other alternatives described in the literature include inhibition of antigen presentation (Sette, et al., *J. Immunol.* 141:3893 (1991), in vitro assembly assays (Townsend, et al., Cell 62:285 (1990), and FACS based assays using mutated cells, such as RMA.S (Melief, et al., *Eur. J. Immunol.* 21:2963 (1991)).

Capture Assay: Unlike the HPLC-based molecular binding assay, noted above, the high throughput screening ("HTS") Capture assay does not utilize a size-exclusion silica column for separation of bound from unbound radioactive marker. Instead, wells of an opaque white 96-well Optiplate (Packard) are coated with 3 μg (100 μl @ 30 μg/ml) of HLA-specific antibody (Ab) that "capture" complexes of radiolabeled MHC and unlabeled peptide transferred from the molecular binding assay plate in 100 μl of 0.05% NP40/PBS. After a 3-hour incubation period, the supernatant is decanted and scintillation fluid (Microscint 20) added. Captured complexes are then measured on a microplate scintillation and luminescence counter (TopCount NXT™; Packard).

Additional assays for determining binding are described in detail, i.e., in PCT publications WO 94/20127 and WO 94/03205. Binding data results are often expressed in terms of $IC_{50}$ value. $IC_{50}$ is the concentration of peptide in a binding assay at which 50% inhibition of binding of a reference peptide occurs. Given the conditions in which the assays are preformed (i.e., limiting MHC proteins and labeled peptide concentrations), these values approximate $K_D$ values. It should be noted that $IC_{50}$ values can change, often dramatically, if the assay conditions are varied, and depending on the particular reagents used (i.e., MHC preparation, etc.). For example, excessive concentrations of MHC molecules will increase the apparent measured $IC_{50}$ of a given ligand. Alternatively, binding is expressed relative to a reference peptide. Although as a particular assay becomes more, or less, sensitive, the $IC_{50}$'s of the peptides tested may change somewhat, the binding relative to the reference peptide will not significantly change. For example, in an assay preformed under conditions such that the $IC_{50}$ of the reference peptide increases 10-fold, the $IC_{50}$ values of the test peptides will also increase approximately 10-fold. Therefore, to avoid ambiguities, the assessment of whether a peptide is a good, intermediate, weak, or negative binder is generally based on its $IC_{50}$, relative to the $IC_{50}$ of a standard peptide.

Binding may also be determined using other assay systems including those using: live cells (i.e., Ceppellini et al., *Nature* 339:392, 1989; Christnick et al., *Nature* 352:67, 1991; Busch et al., *Int. Immunol.* 2:443, 19990; Hill et al., *J. Immunol.* 147:189, 1991; del Guercio et al., *J. Immunol.* 154:685, 1995), cell free systems using detergent lysates (i.e., Cerundolo et al., *J. Immunol.* 21:2069, 1991), immobilized purified MHC (i.e., Hill et al., *J. Immunol.* 152, 2890, 1994; Marshall et al., *J. Immunol.* 152:4946, 1994), ELISA systems (i.e., Reay et al., *EMBO J.* 11:2829, 1992), surface plasmon resonance (i.e., Khilko et al., *J. Biol. Chem.* 268:15425, 1993); high flux soluble phase assays (Hammer et al., *J. Exp. Med.* 180:2353, 1994), and measurement of class I MHC stabilization or assembly (i.e., Ljunggren et al., *Nature* 346:476, 1990; Schumacher et al., *Cell* 62:563, 1990; Townsend et al., *Cell* 62:285, 1990; Parker et al., *J. Immunol.* 149:1896, 1992).

High affinity with respect to HLA class I molecules is defined as binding with an $IC_{50}$, or $K_D$ value, of 50 nM or less; intermediate affinity with respect to HLA class I molecules is defined as binding with an $IC_{50}$ or $K_D$ value of between about 50 and about 500 nM. High affinity with respect to binding to HLA class II molecules is defined as binding with an $IC_{50}$ or $K_D$ value of 100 nM or less; intermediate affinity with respect to binding to HLA class II molecules is defined as binding with an $IC_{50}$ or $K_D$ value of between about 100 and about 1000 nM. These values are as previously defined in the related patents and applications cited above.

The immunogenic peptides can be prepared synthetically, or by recombinant DNA technology or from natural sources such as whole viruses or tumors. Although the peptide will preferably be substantially free of other naturally occurring host cell proteins and fragments thereof, in some embodiments the peptides can be synthetically conjugated to native fragments or particles.

The polypeptides or peptides can be a variety of lengths, either in their neutral (uncharged) forms or in forms which are salts, and either free of modifications such as glycosylation, side chain oxidation, or phosphorylation or containing these modifications, subject to the condition that the modification not destroy the biological activity of the polypeptides as herein described.

Desirably, the peptide will be as small as possible while still maintaining substantially all of the biological activity of the large peptide. In one embodiment, it may be desirable to optimize peptides of the invention to a length of 8, 9, 10 or 11 amino acid residues, commensurate in size with endogenously processed viral peptides or tumor cell peptides that are bound to MHC class I molecules on the cell surface. In another embodiment, it may be desirable to optimize peptides of the invention to about 15 to 20 amino acid residues, commensurate with peptides that are bound to MHC class II molecules on the cell surface.

Peptides having the desired activity may be modified as necessary to provide certain desired attributes, e.g., improved pharmacological characteristics, while increasing or at least retaining substantially all of the biological activity of the unmodified peptide to bind the desired MHC molecule and activate the appropriate T cell. For instance, the peptides may be subject to various changes, such as substitutions, either conservative or non-conservative, where such changes might provide for certain advantages in their use, such as improved MHC binding. By "conservative substitution" is meant replacing an amino acid residue with another which is biologically and/or chemically similar, e.g., one hydrophobic residue for another, or one polar residue for another. The substitutions include combinations such as Gly, Ala; Val, Ile, Leu, Met; Asp, Glu; Asn, Gln; Ser, Thr; Lys, Arg; and Phe, Tyr. The effect of single amino acid substitutions may also be probed using D-amino acids. Such modifications may be made using well known peptide synthesis procedures, as described in e.g., Merrifield, *Science* 232:341-347 (1986), Barany and Merrifield, *The Peptides*, Gross and Meienhofer, eds. (N.Y., Academic Press), pp. 1-284 (1979); and Stewart and Young, *Solid Phase Peptide Synthesis,* (Rockford, Ill., Pierce), 2d Ed. (1984), incorporated by reference herein.

The peptides of the invention can also be modified by extending or decreasing the compound's amino acid sequence, e.g., by the addition or deletion of amino acids. The peptides or analogs of the invention can also be modified by altering the order or composition of certain residues, it being readily appreciated that certain amino acid residues essential for biological activity, e.g., those at critical contact sites or conserved residues, may generally not be altered without an adverse effect on biological activity. The non-critical amino acids need not be limited to those naturally occurring in proteins, such as L-α-amino acids, or their D-isomers, but may include non-natural amino acids as well, such as β-γ-δ-amino acids, as well as many derivatives of L-α-amino acids.

Typically, a series of peptides with single amino acid substitutions are employed to determine the effect of electrostatic charge, hydrophobicity, etc. on binding. For instance, a series of positively charged (e.g., Lys or Arg) or negatively charged (e.g., Glu) amino acid substitutions are made along the length of the peptide revealing different patterns of sensitivity towards various MHC molecules and T cell receptors. In addition, multiple substitutions using small, relatively neutral moieties such as Ala, Gly, Pro, or similar residues may be employed. The substitutions may be homo-oligomers or hetero-oligomers. The number and types of residues which are substituted or added depend on the spacing necessary between essential contact points and certain functional attributes which are sought (e.g., hydrophobicity versus hydrophilicity). Increased binding affinity for an MHC molecule or T cell receptor may also be achieved by such substitutions, compared to the affinity of the parent peptide. In any event, such substitutions should employ amino acid residues or other molecular fragments chosen to avoid, for example, steric and charge interference which might disrupt binding.

Amino acid substitutions are typically of single residues. Substitutions, deletions, insertions or any combination thereof may be combined to arrive at a final peptide. Substitutional variants are those in which at least one residue of a peptide has been removed and a different residue inserted in its place. Such substitutions generally are made in accordance with the following TABLE 72 when it is desired to finely modulate the characteristics of the peptide.

Substantial changes in function (e.g., affinity for MHC molecules or T cell receptors) are made by selecting substitutions that are less conservative than those in TABLE 70, i.e., selecting residues that differ more significantly in their effect on maintaining (a) the structure of the peptide backbone in the area of the substitution, for example as a sheet or helical conformation, (b) the charge or hydrophobicity of the molecule at the target site or (c) the bulk of the side chain. The substitutions which in general are expected to produce the greatest changes in peptide properties will be those in which (a) hydrophilic residue, e.g. seryl, is substituted for (or by) a hydrophobic residue, e.g. leucyl, isoleucyl, phenylalanyl, valyl or alanyl; (b) a residue having an electropositive side chain, e.g., lysl, arginyl, or histidyl, is substituted for (or by) an electronegative residue, e.g. glutamyl or aspartyl; or (c) a residue having a bulky side chain, e.g. phenylalanine, is substituted for (or by) one not having a side chain, e.g., glycine.

The peptides may also comprise isosteres of two or more residues in the immunogenic peptide. An isostere as defined here is a sequence of two or more residues that can be substituted for a second sequence because the steric conformation of the first sequence fits a binding site specific for the second sequence. The term specifically includes peptide backbone modifications well known to those skilled in the art. Such modifications include modifications of the amide nitrogen, the α-carbon, amide carbonyl, complete replacement of the amide bond, extensions, deletions or backbone crosslinks. See, generally, Spatola, *Chemistry and Biochemistry of Amino Acids, peptides and Proteins*, Vol. VII (Weinstein ed., 1983).

Modifications of peptides with various amino acid mimetics or unnatural amino acids are particularly useful in increasing the stability of the peptide in vivo. Stability can be assayed in a number of ways. For instance, peptidases and various biological media, such as human plasma and serum, have been used to test stability. See, e.g., Verhoef et al., *Eur. J. Drug Metab. Pharmacokin.* 11:291-302 (1986). Half life of the peptides of the present invention is conveniently determined using a 25% human serum (v/v) assay. The protocol is generally as follows. Pooled human serum (Type AB, non-heat inactivated) is delipidated by centrifugation before use. The serum is then diluted to 25% with RPMI tissue culture media and used to test peptide stability. At predetermined time intervals a small amount of reaction solution is removed and added to either 6% aqueous trichloracetic acid or ethanol. The cloudy reaction sample is cooled (4° C.) for 15 minutes and then spun to pellet the precipitated serum proteins. The presence of the peptides is then determined by reversed-phase HPLC using stability-specific chromatography conditions.

The peptides of the present invention or analogs thereof which have CTL stimulating activity may be modified to provide desired attributes other than improved serum half life. For instance, the ability of the peptides to induce CTL activity can be enhanced by linkage to a sequence which contains at least one epitope that is capable of inducing a T helper cell response.

Substitutions, deletions, insertions or any combination thereof may be combined to arrive at a final peptide. Substitutional variants are those in which at least one residue of a peptide has been removed and a different residue inserted in its place. Such substitutions generally are made in accordance with the following TABLE 70 when it is desired to finely modulate the characteristics of the peptide.

The peptides may also comprise isosteres of two or more residues in the MHC-binding peptide. An isostere as defined here is a sequence of two or more residues that can be substituted for a second sequence because the steric conformation of the first sequence fits a binding site specific for the second sequence. The term specifically includes peptide backbone modifications well known to those skilled in the art. Such modifications include modifications of the amide nitrogen, the α-carbon, amide carbonyl, complete replacement of the amide bond, extensions, deletions or backbone crosslinks. See, generally, Spatola, *Chemistry and Biochemistry of Amino Acids, Peptides and Proteins*, Vol. VII (Weinstein ed., 1983).

Modifications of peptides with various amino acid mimetics or unnatural amino acids are particularly useful in increasing the stability of the peptide in vivo. Stability can be assayed in a number of ways. For instance, peptidases and various biological media, such as human plasma and serum, have been used to test stability. See, e.g., Verhoef et al., *Eur. J. Drug Metab. Pharmacokin.* 11:291-302 (1986). Half life of the peptides of the present invention is conveniently determined using a 25% human serum (v/v) assay. The protocol is generally as follows. Pooled human serum (Type AB, non-heat inactivated) is delipidated by centrifugation before use. The serum is then diluted to 25% with RPMI tissue culture media and used to test peptide stability. At predetermined time intervals a small amount of reaction solution is removed and added to either 6% aqueous trichloracetic acid or ethanol. The cloudy reaction sample is cooled (4° C.) for 15 minutes and then spun to pellet the precipitated serum proteins. The presence of the peptides is then determined by reversed-phase HPLC using stability-specific chromatography conditions.

Such analogs may also possess improved shelf-life or manufacturing properties. More specifically, non-critical amino acids need not be limited to those naturally occurring in proteins, such as L-α-amino acids, or their D-isomers, but may include non-natural amino acids as well, such as amino acids mimetics, e.g. D- or L-naphylalanine; D- or L-phenylglycine; D- or L-2-thieneylalanine; D- or L-1, -2, 3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluorophenylalanine; D- or L-ρ-biphenylphenylalanine; D- or L-ρ-methoxybiphenylphenylalanine; D- or L-2-indole(alkyl)alanines; and, D- or L-alkylalanines, where the alkyl group can be a substituted or unsubstituted methyl, ethyl, propyl, hexyl, butyl, pentyl, isopropyl, isobutyl, sec-isotyl, iso-pentyl, or a non-acidic amino acids. Aromatic rings of a nonnatural amino acid include, e.g., thiazolyl, thiophenyl, pyrazolyl, benzimidazolyl, naphthyl, furanyl, pyrrolyl, and pyridyl aromatic rings.

Another embodiment for generating effective peptide analogs involves the substitution of residues that have an adverse impact on peptide stability or solubility in, e.g., a liquid environment. This substitution may occur at any position of the peptide epitope. Analogs of the present invention may include peptides containing substitutions to modify the physical property (e.g., stability or solubility) of the resulting peptide. For example, a cysteine (C) can be substituted out in favor of α-amino butyric acid. Due to its chemical nature, cysteine has the propensity to form disulfide bridges and sufficiently alter the peptide structurally so as to reduce binding capacity. Substituting α-amino butyric acid for C not only alleviates this problem, but actually improves binding and crossbinding capability in certain instances (see, e.g., the review by Sette et al., In: *Persistent Viral Infections*, Eds. R. Ahmed and I. Chen, John Wiley & Sons, England, 1999). Substitution of cysteine with α-amino butyric acid may occur at any residue of a peptide epitope, i.e. at either anchor or non-anchor positions.

The binding activity, particularly modification of binding affinity or cross-reactivity among HLA supertype family members, of peptides of the invention can also be altered using analoging, which is described in co-pending U.S. application Ser. No. 09/226,775 filed Jan. 6, 1999. In brief, the analoging strategy utilizes the motifs or supermotifs that correlate with binding to certain HLA molecules. Analog peptides can be created by substituting amino acid residues at primary anchor, secondary anchor, or at primary and secondary anchor positions. Generally, analogs are made for peptides that already bear a motif or supermotif. For a number of the motifs or supermotifs in accordance with the invention, residues are defined which are deleterious to binding to allele-specific HLA molecules or members of HLA supertypes that bind the respective motif or supermotif (see, e.g., Rupert et al. *Cell* 74:929, 1993; Sidney, J. et al., *Hu. Immunol.* 45:79, 1996; and Sidney et al.; Sidney, et al., *J. Immunol.* 154:247, 1995). Accordingly, removal of such residues that are detrimental to binding can be performed in accordance with the present invention. For example, in the case of the A3 supertype, when all peptides that have such deleterious residues are removed from the population of peptides used in the analysis, the incidence of cross-reactivity increased from 22% to 37% (see, e.g., Sidney, J. et al., *Hu. Immunol.* 45:79, 1996).

Thus, one strategy to improve the cross-reactivity of peptides within a given supermotif is simply to delete one or more of the deleterious residues present within a peptide and substitute a small "neutral" residue such as Ala (that may not influence T cell recognition of the peptide). An enhanced likelihood of cross-reactivity is expected if, together with elimination of detrimental residues within a peptide, "preferred" residues associated with high affinity binding to an allele-specific HLA molecule or to multiple HLA molecules within a superfamily are inserted.

To ensure that an analog peptide, when used as a vaccine, actually elicits a CTL response to the native epitope in vivo, the analog peptide may be used to induce T cells in vitro from individuals of the appropriate HLA allele. Thereafter, the immunized cells' capacity to lyse wild type peptide sensitized target cells is evaluated. Alternatively, evaluation of the cells' activity can be evaluated by monitoring IFN release. Each of these cell monitoring strategies evaluate the recognition of the APC by the CTL. It will be desirable to use as antigen presenting cells, typically cells that have been either infected, or transfected with the appropriate genes to establish whether endogenously produced antigen is also recognized by the T cells induced by the analog peptide. It is to be noted that peptide/protein-pulsed dendritic cells can be used to present whole protein antigens for both HLA class I and class II.

Another embodiment of the invention is to create analogs of weak binding peptides, to thereby ensure adequate numbers of cellular binders. Class I binding peptides exhibiting binding affinities of 500-5000 nM, and carrying an acceptable but suboptimal primary anchor residue at one or both positions can be "fixed" by substituting preferred anchor residues in accordance with the respective supertype. The analog peptides can then be tested for binding and/or cross-binding capacity.

Another embodiment of the invention is to create analogs of peptides that are already cross-reactive binders and are vaccine candidates, but which bind weakly to one or more alleles of a supertype. If the cross-reactive binder carries a suboptimal residue (less preferred or deleterious) at a primary or secondary anchor position, the peptide can be analoged by substituting out a deleterious residue and replacing it with a preferred or less preferred one, or by substituting out a less preferred reside and replacing it with a preferred one. The analog peptide can then be tested for cross-binding capacity.

The present invention provides methods for creating analogs of immunogenic peptides, as well as the analogs themselves. Analoging can comprise selection of desired residues at the primary and/or secondary anchor positions, thereby altering the binding affinity and immune modulating properties of the resulting analogs. Examples of modulations that may be achieved using the present invention include preparation of analogs with increased affinity for a particular HLA molecule (e.g., adding by substitution preferred secondary anchor residues specific for the molecule); preparation of analogs with increased cross-reactivity among different alleles (e.g., by substitution at a secondary or primary anchor position with a residue shared by more than one HLA molecule); or by production of a subdominant epitope (e.g., by substitution of residues which increase affinity but are not present on the immunodominant epitope). Peptides bearing epitopes may be modified (e.g., having analogs created thereof) to provide certain desired attributes, e.g., improved pharmacological characteristics, while increasing or at least retaining the ability to bind the desired HLA protein and, e.g., to activate the desired T cell. Moreover, peptides which lack a desired activity can be modified so as to thereby have that activity. In a presently preferred embodiment, a deleterious or non-preferred residue is removed and a preferred residue is substituted, preferred residues having been defined on the basis of a correlation with an increased binding affinity of the peptide that bears that particular motif or supermotif for the HLA molecule to which the peptide is bound.

The peptides can also be modified by extending or decreasing the compound's amino acid sequence, e.g., by the addition or deletion of amino acids; for this embodiment it is generally preferred to add amino acids. If amino acids are added for class I restricted peptides, they are preferably added between the second amino acid from the N terminus and the C terminus (for peptides bearing a motif with primary anchors at position 2 and the C-terminus). For class II restricted peptides, amino acids can generally be added at the termini of the peptide. Peptides, including analogs, of the invention can also be modified by altering the order or composition of certain residues, it being readily appreciated that certain amino acid residues essential for biological activity, e.g., those at anchor positions, or conserved residues, may generally not be altered without an adverse effect on a biological activity. In certain contexts, however, it may be desirable to produce peptides which lead to a biological activity that might otherwise be deemed "adversely affected".

Heteroclitic analog peptides of the invention are particularly useful to induce an immune response against antigens to which a patient's immune system has become tolerant. Tolerance refers to a specific immunologic nonresponsiveness induced by prior exposure to an antigen. Thus, tolerance can be overcome in the patient by identifying a particular class I peptide epitope to which a patient is tolerant, modifying the peptide epitope sequence according to the methods of the invention, and inducing an immune response that cross-reacts against the tolerized epitope (antigen). Overcoming tolerance is particularly desirable, for example, when a patient's immune system is tolerant of a viral or tumor-associated antigen, the latter antigens being often over-expressed self-proteins as a consequence of cell transformation. Heteroclitic analoging is described in co-pending U.S. provisional application No. 60/166,529 filed Nov. 18, 1999 and US provisional application for "Heteroclitic Analogs And Related Methods," Tangri et al., inventors, 60/239,008, filed Oct. 6, 2000.

The peptides of the present invention or analogs thereof which have CTL stimulating activity may be modified to provide desired attributes other than improved serum half life. For instance, the ability of the peptides to induce CTL activity can be enhanced by linkage to a sequence which contains at least one epitope that is capable of inducing a T helper cell response.

In some embodiments, the T helper peptide is one that is recognized by T helper cells in the majority of the population. This can be accomplished by selecting amino acid sequences that bind to many, most, or all of the MHC class II molecules. These are known as "loosely MHC-restricted" T helper sequences. Examples of amino acid sequences that are loosely MHC-restricted include sequences from antigens such as Tetanus toxin at positions 830-843 (QYIKANSKFIGITE (SEQ ID NO:8080)), *Plasmodium falciparum* circumsporozoite (CS) protein at positions 378-398 (DIEKKIAKMEKASSVFNVVNS (SEQ ID NO:14616)), and *Streptococcus* 18 kD protein at positions 1-16 (YGAVDSILGGVATYGAA (SEQ ID NO:8060)). Further examples of amino acid sequences that are recognized by HTL present in a broad segments of the population are sequences that bear the DR supermotif as shown in TABLE 139.

Alternatively, it is possible to prepare synthetic peptides capable of stimulating T helper lymphocytes, in a loosely MHC-restricted fashion, using amino acid sequences not found in nature (see, e.g., PCT publication WO 95/07707). These synthetic compounds, called Pan-DR-binding epitopes or PADRE® molecules (Epimmune, San Diego, Calif.), are designed on the basis of their binding activity to most HLA-DR (human MHC class II) molecules (see, e.g., U.S. Ser. No. 08/121,101 (now abandoned) and related U.S. Ser. No. 08/305,871 (now U.S. Pat. No. 5,736,142)). For instance, a pan-DR-binding epitope peptide having the formula: aKXVWANTLKAAa, where X is either cyclohexylalanine, phenylalanine, or tyrosine, and "a" is either D-alanine or L-alanine, has been found to bind to most HLA-DR alleles, and to stimulate the response of T helper lymphocytes from most individuals, regardless of their HLA type.

Particularly preferred immunogenic peptides/T helper conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues. Alternatively, the CTL peptide may be linked to the T helper peptide without a spacer.

The immunogenic peptide may be linked to the T helper peptide either directly or via a spacer either at the amino or carboxy terminus of the CTL peptide. The amino terminus of either the immunogenic peptide or the T helper peptide may be acylated. The T helper peptides used in the invention can be modified in the same manner as CTL peptides. For instance, they may be modified to include D-amino acids or be conjugated to other molecules such as lipids, proteins, sugars and the like. Exemplary T helper peptides include tetanus toxoid 830-843, influenza 307-319, malaria circumsporozoite 382-398 and 378-389.

In some embodiments it may be desirable to include in the pharmaceutical compositions of the invention at least one component which primes CTL. Lipids have been identified as agents capable of priming CTL in vivo against viral antigens. For example, palmitic acid residues can be attached to the alpha and epsilon amino groups of a Lys residue and then linked, e.g., via one or more linking residues such as Gly, Gly-Gly-, Ser, Ser-Ser, or the like, to an immunogenic peptide. The lipidated peptide can then be injected directly in a micellar form, incorporated into a liposome or emulsified in an adjuvant, e.g., incomplete Freund's adjuvant. In a preferred embodiment a particularly effective immunogen comprises palmitic acid attached to alpha and epsilon amino groups of Lys, which is attached via linkage, e.g., Ser-Ser, to the amino terminus of the immunogenic peptide. Also in a preferred embodiment a particularly effective immunogen comprises palmitic acid attached to alpha and epsilon amino groups of Lys, which is attached via linkage, e.g., Ser-Ser, to the amino terminus of a class I restricted peptide having T cell determinants, such as those peptides described herein as well as other peptides which have been identified as having such determinants.

As another example of lipid priming of CTL responses, *E. coli* lipoproteins, such as tripalmitoyl-S-glycerylcysteinlyseryl-serine ($P_3CSS$) can be used to prime virus specific CTL when covalently attached to an appropriate peptide. See, Deres et al., *Nature* 342:561-564 (1989), incorporated herein by reference. Peptides of the invention can be coupled to $P_3CSS$, for example, and the lipopeptide administered to an individual to specifically prime a CTL response to the target antigen. Further, as the induction of neutralizing antibodies can also be primed with $P_3CSS$ conjugated to a peptide which displays an appropriate epitope, the two compositions can be combined to more effectively elicit both humoral and cell-mediated responses to infection.

In addition, additional amino acids can be added to the termini of a peptide to provide for ease of linking peptides one to another, for coupling to a carrier support, or larger peptide, for modifying the physical or chemical properties of the peptide or oligopeptide, or the like. Amino acids such as tyrosine, cysteine, lysine, glutamic or aspartic acid, or the like, can be introduced at the C- or N-terminus of the peptide or oligopeptide. Modification at the C terminus in some cases may alter binding characteristics of the peptide. In addition, the peptide or oligopeptide sequences can differ from the natural sequence by being modified by terminal-$NH_2$ acylation, e.g., by alkanoyl ($C_1$-$C_{20}$) or thioglycolyl acetylation, terminal-carboxyl amidation, e.g., ammonia, methylamine, etc. In some instances these modifications may provide sites for linking to a support or other molecule.

The peptides of the invention can be prepared in a wide variety of ways. Because of their relatively short size, the peptides can be synthesized in solution or on a solid support in accordance with conventional techniques. Various automatic synthesizers are commercially available and can be used in accordance with known protocols. See, for example, Stewart and Young, *Solid Phase Peptide Synthesis,* 2d. ed., Pierce Chemical Co. (1984), supra.

Another aspect of the present invention is directed to vaccines which comprise an immunogenically effective amount of one or more peptides as described herein. Peptides may be introduced into a host using a variety of delivery vehicles known to those of skill in the art including PLG microspheres with entrapped peptides and virus-like particles. Furthermore, epitopes may be introduced as multiple antigen peptides (MAPs) (see e.g., Mora and Tam, *J. Immunol.* 161:3616-23 (1998)), or as immunostimulating complexes (ISCOMS) (see e.g., Hu et al. *Clin. Exp. Immunol.* 113:235-43 (1998)) as known in the art.

Vaccines that contain an immunogenically effective amount of one or more peptides as described herein are a further embodiment of the invention. Once appropriately immunogenic epitopes have been defined, they can be delivered by various means, herein referred to as "vaccine" compositions. Such vaccine compositions can include, for example, lipopeptides (e.g., Vitiello, A. et al., J: *Clin. Invest.* 95:341, 1995), peptide compositions encapsulated in poly (DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-24: 1998), multiple antigen peptide systems (MAPs) (see e.g., Tam, J. P., *Proc. Nati. Acaa Sci. U.S.A.* 85:5409-5413, 1988; Tam, J. P., *J Immunol. Methods* 196:17-32, 1996), vir delivery vectors (Perkus, M. E. et al., In: *Concepts in vaccine development*, Kaufmann H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. et al., *J Infect. Dis.* 124:148, 1971; Chanda, P. K. et al., *Virology* 175:535, 1990), particles of viral or synthetic origin (e.g., Kofler, N. et al., *J Immunol. Methods.* 192:2~1996; Eldridge, J. H. et al., *Sem. Bematol.* 30:16, 1993; Fa10, L. D., Jr. et al., *Nature Med.* 7:649, 1995), adjuvants (Warren, H. S., Vogel, F. R., and Chedid, L. A. *Annu. Re Immunol.* 4:369, 1986; Gupta, R. K. et al., *Vaccine* 11:293, 1993), liposomes (Reddy, R et al., *J. Immunol.* 148:1585, 1992; Rock, K. L., *Immunol. Today* 17:131, 1996), or, naked or particle absorbed cDNA (Ulmer, J. B. et al., *Science* 259: 1745, 1993; Robinsol H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

Vaccine compositions of the invention include nucleic acid-mediated modalities. DNA or RNA encoding one or more of the peptides of the invention can also be administered to a patient. This approach is described, for instance, in Wolff et. al., *Science* 247: 1465 (1990) as well as U.S. Pat. Nos. 5,580,859; 5,589,466; 5,804,566; 5,739,118; 5,736,524; 5,679,647; WO 98/04720; and in more detail below. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, the peptides of the invention can be expression vectors include attenuated viral hosts, such as vaccinia or fowlpox. This approach involves the use of vaccinia virus, for example, as a vector to express nucleotide sequences that encode the pep tides of the invention. Upon introduction into an acutely or chronically infected host or into a non-infected host, the recombinant vaccinia virus expresses the immunogenic peptide, and thereby elicits a host CTL and/or HTL response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456-460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Furthermore, vaccines in accordance with the invention can encompass one or more of the peptides of the invention. Accordingly, a peptide can be present in a vaccine individually. Alternatively, the peptide can be individually linked to its own carrier; alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition may be a naturally occurring region of an antigen or may be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, CTL responses can be primed by conjugating peptides of the invention to lipids, such as tripalmitoyl-S-glycerylcysteinlyseryl-serine (P3CSS).

Upon immunization with a peptide composition in accordance with the invention, via injection, aerosol, oral, transdermal, transmucosal, intrapleural, intrathecal, or other suitable routes, the immune system of the host responds to the vaccine by producing large amounts of HTLs and/or CTLs specific for the desired antigen. Consequently, the host becomes at least partially immune to later infection, or at least partially resistant to developing an ongoing chronic infection, or derives at least some therapeutic benefit when the antigen was tumor-associated.

In certain embodiments, components that induce T cell responses are combined with components that induce antibody responses to the target antigen of interest. Thus, in certain preferred embodiments of the invention, class I peptide vaccines of the invention are combined with vaccines which induce or facilitate neutralizing antibody responses to the target antigen of interest, particularly to viral envelope antigens. A preferred embodiment of such a composition comprises class I and class II epitopes in accordance with the invention. An alternative embodiment of such a composition comprises a class I epitope in accordance with the invention, along with a PADRE® (Epimmune, San Diego, Calif.) molecule (described, for example, in U.S. Pat. No. 5,736,142).

For therapeutic or immunization purposes, the peptides of the invention can also be expressed by vectors. Examples of expression vectors include attenuated viral hosts, such as vaccinia or fowlpox. This approach involves the use of vaccinia virus as a vector to express nucleotide sequences that encode the peptides of the invention. Upon introduction into an acutely or chronically infected host or into a non-infected host, the recombinant vaccinia virus expresses the immunogenic peptide, and thereby elicits a host CTL response. Vaccinia vectors and methods useful in immunization protocols are described in, e.g., U.S. Pat. No. 4,722,848. Another vector is BCG (Bacille Calmette Guerin). BCG vectors are described in Stover, et al. *Nature* 351:456-60 (1991). A wide variety of other vectors useful for therapeutic administration or immunization of the peptides of the invention, e.g., *Salmonella typhi* vectors, retroviral vectors, adenoviral or adeno-associated viral vectors, and the like will be apparent to those skilled in the art from the description herein.

Alternatively, recombinant DNA technology may be employed wherein a nucleotide sequence which encodes an immunogenic peptide of interest is inserted into an expression vector, transformed or transfected into an appropriate host cell and cultivated under conditions suitable for expression. These procedures are generally known in the art, as described generally in Sambrook et al., *Molecular Cloning, A Laboratory Manual*, Cold Spring Harbor Press, Cold Spring Harbor, N.Y. (1982) (also 1989), which is incorporated herein by reference. Thus, fusion proteins which comprise one or more peptide sequences of the invention can be used to present the appropriate T cell epitope. For example, a coding sequence encoding a peptide of the invention can be provided with appropriate linkers and ligated into expression vectors commonly available in the art, and the vectors used to transform suitable hosts to produce the desired fusion protein. A number of such vectors and suitable host systems are now available. Expression constructs, i.e., minigenes are described in greater detail in the sections below. Such methodologies are also used to present at least one peptide of the invention along with a substance which is not a peptide of the invention.

As the coding sequence for peptides of the length contemplated herein can be synthesized by chemical techniques, for example, using the phosphotriester method of Matteucci et al., *J. Am. Chem. Soc.* 103:3185 (1981), with modification can be made simply by substituting the appropriate base(s) for those encoding the native peptide sequence. The coding sequence can then be provided with appropriate linkers and ligated into expression vectors commonly available in the art, and the vectors used to transform suitable hosts to produce the desired fusion protein. A number of such vectors and suitable host systems are now available. For expression of the fusion proteins, the coding sequence will be provided with operably linked start and stop codons, promoter and terminator regions and usually a replication system to provide an expression vector for expression in the desired cellular host. For example, promoter sequences compatible with bacterial hosts are provided in plasmids containing convenient restriction sites for insertion of the desired coding sequence. The resulting expression vectors are transformed into suitable bacterial hosts. Of course, yeast or mammalian cell hosts may also be used, employing suitable vectors and control sequences.

The peptides of the present invention and pharmaceutical and vaccine compositions thereof are useful for administration to mammals, particularly humans, to treat and/or prevent viral infection and cancer. Examples of diseases which can be treated using the immunogenic peptides of the invention include prostate cancer, hepatitis B, hepatitis C, AIDS, renal carcinoma, cervical carcinoma, lymphoma, CMV and condlyloma acuminatum.

For pharmaceutical compositions, the immunogenic peptides of the invention are administered to an individual already suffering from cancer or infected with the virus of interest. Those in the incubation phase or the acute phase of infection can be treated with the immunogenic peptides separately or in conjunction with other treatments, as appropriate. In therapeutic applications, compositions are administered to a patient in an amount sufficient to elicit an effective CTL response to the virus or tumor antigen and to cure or at least partially arrest symptoms and/or complications. An amount adequate to accomplish this is defined as "therapeutically effective dose" or "unit dose." Amounts effective for this use will depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 1.0 μg to about 5000 μg of peptide for a 70 kg patient, followed by boosting dosages of from about 1.0 μg to about 1000 μg of peptide pursuant to a boosting regimen over weeks to months depending upon the patient's response and condition by measuring specific CTL activity in the patient's blood. In alternative embodiments, generally for humans the dose range for the initial immunization (that is for therapeutic or prophylactic administration) is from about 1.0 μg to about 20,000 μg of peptide for a 70 kg patient, preferably, 100 μg-, 150 μg-, 200 μg-, 250 μg-, 300 μg-, 400 μg-, or 500 μg-20,000 μg, followed by boosting dosages in the same dose range pursuant to a boosting regimen over weeks to months depending upon the patient's response and condition by measuring specific CTL activity in the patient's blood. In embodiments where recombinant nucleic acid administration is used, the administered material is titrated to achieve the appropriate therapeutic response.

It must be kept in mind that the peptides and compositions of the present invention may generally be employed in serious disease states, that is, life-threatening or potentially life threatening situations. In such cases, in view of the minimization of extraneous substances and the relative nontoxic nature of the peptides, it is possible and may be felt desirable by the treating physician to administer substantial excesses of these peptide compositions.

For therapeutic use, administration should begin at the first sign of viral infection or the detection or surgical removal of tumors or shortly after diagnosis in the case of acute infection. This is followed by boosting doses until at least symptoms are substantially abated and for a period thereafter. In chronic infection, loading doses followed by boosting doses may be required.

Treatment of an infected individual with the compositions of the invention may hasten resolution of the infection in acutely infected individuals. For those individuals susceptible (or predisposed) to developing chronic infection the compositions are particularly useful in methods for preventing the evolution from acute to chronic infection. Where the susceptible individuals are identified prior to or during infection, for instance, as described herein, the composition can be targeted to them, minimizing need for administration to a larger population.

The peptide compositions can also be used for the treatment of chronic infection and to stimulate the immune system to eliminate virus-infected cells in carriers. It is important to provide an amount of immuno-potentiating peptide in a formulation and mode of administration sufficient to effectively stimulate a cytotoxic T cell response. Thus, for treatment of chronic infection, a representative dose is in the range of about 1.0 μg to about 5000 μg, preferably about 5 μg to 1000 μg for a 70 kg patient per dose. Immunizing doses followed by boosting doses at established intervals, e.g., from one to four weeks, may be required, possibly for a prolonged period of time to effectively immunize an individual. In the case of chronic infection, administration should continue until at least clinical symptoms or laboratory tests indicate that the viral infection has been eliminated or substantially abated and for a period thereafter.

The pharmaceutical compositions for therapeutic treatment are intended for parenteral, topical, oral or local administration. Preferably, the pharmaceutical compositions are administered parenterally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier. A variety of aqueous carriers may be used, e.g., water, buffered water, 0.8% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc.

A pharmaceutical composition of the invention may comprise one or more T cell stimulatory peptides of the invention. For example, a pharmaceutical composition may comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more T cell stimulatory peptides of the invention. Moreover, a pharmaceutical composition of the invention may comprise one or more T cell stimulatory peptides of the invention in combination with one or more other T cell stimulatory peptides. The concentration of each unique T cell stimulatory peptide of the invention in the pharmaceutical formulations can vary widely, e.g., from less than about 0.001%, about 0.002%, about 0.003%, about 0.004%, about 0.005%, about 0.006%, 0.007%, 0.008%, 0.009%, about 0.01%, about 0.02%, about 0.025%, about 0.03%, about 0.04%, about 0.05%, about 0.06%, about 0.07%, about 0.08%, about 0.09%, about 0.1%, about 0.2%, about 0.3%, about 0.4%, about 0.5%, about 0.6%, about 0.7%, about 0.8%, about 0.9%, about 1%, about 1.1%, about 1.2%, about 1.3%, about 1.4%, about 1.5%, about 1.6%, about 1.7%, about 1.8%, about 1.9%, about 2%, about 3%, about 4%, about 5%, about 6%, about 7%, about 8%, about 9%, about 10%, about 20%, to about 50% or more by weight, and will be selected primarily by fluid volumes, viscosities, etc., in accordance with the particular mode of administration selected. In a preferred embodiment, the concentration of each unique T cell stimulatory peptide of the invention in the pharmaceutical formulations is about 0.001%, about 0.002%, about 0.003%, about 0.004%, about 0.005%, about 0.006%, 0.007%, 0.008%, 0.009%, about 0.01%, about 0.02%, about 0.025%, about 0.03%, about 0.04%, about 0.05%, about 0.06%, about 0.07%, about 0.08%, about 0.09%, about 0.1%, about 0.2%, about 0.3%, about 0.4%, about 0.5%, about 0.6%, about 0.7%, about 0.8%, about 0.9%, about 1% by weight. In a more preferred embodiment, the concentration of each unique T cell stimulatory peptide of the invention in the pharmaceutical formulations is about 0.01%, about 0.02%, about 0.025%, about 0.03%, about 0.04%, about 0.05%, about 0.06%, about 0.07%, about 0.08%, about 0.09%, about 0.1% by weight.

The concentration of CTL stimulatory peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected. A human unit dose form of the peptide composition is typically included in a pharmaceutical composition that comprises a human unit dose of an acceptable carrier, preferably an aqueous carrier, and is administered in a volume of fluid that is known by those of skill in the art to be used for administration of such compositions to humans.

The peptides of the invention may also be administered via liposomes, which serve to target the peptides to a particular tissue, such as lymphoid tissue, or targeted selectively to infected cells, as well as increase the half-life of the peptide composition. Liposomes include emulsions, foams, micelles, insoluble monolayers, liquid crystals, phospholipid dispersions, lamellar layers and the like. In these preparations the peptide to be delivered is incorporated as part of a liposome, alone or in conjunction with a molecule which binds to, e.g., a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the selected therapeutic/immunogenic peptide compositions. Liposomes for use in the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka et al., *Ann. Rev. Biophys. Bioeng.* 9:467 (1980), U.S. Pat. Nos. 4,235,871, 4,501,728, 4,837,028, and 5,019,369, incorporated herein by reference.

For targeting to the immune cells, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant must, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included, as desired, as with, e.g., lecithin for intranasal delivery.

In another aspect the present invention is directed to vaccines which contain as an active ingredient an immunogenically effective amount of an immunogenic peptide as described herein. The peptide(s) may be introduced into a host, including humans, linked to its own carrier or as a homopolymer or heteropolymer of active peptide units. Such a polymer has the advantage of increased immunological reaction and, where different peptides are used to make up the polymer, the additional ability to induce antibodies and/or CTLs that react with different antigenic determinants of the virus or tumor cells. Useful carriers are well known in the art, and include, e.g., thyroglobulin, albumins such as human serum albumin, tetanus toxoid, polyamino acids such as poly (lysine:glutamic acid), influenza, hepatitis B virus core protein, hepatitis B virus recombinant vaccine and the like. The vaccines can also contain a physiologically tolerable (acceptable) diluent such as water, phosphate buffered saline, or saline, and further typically include an adjuvant. Adjuvants such as incomplete Freund's adjuvant, aluminum phosphate, aluminum hydroxide, or alum are materials well known in the art. And, as mentioned above, CTL responses can be primed by conjugating peptides of the invention to lipids, such as P3CSS. Upon immunization with a peptide composition as described herein, via injection, aerosol, oral, transdermal or other route, the immune system of the host responds to the vaccine by producing large amounts of CTLs specific for the desired antigen, and the host becomes at least partially immune to later infection, or resistant to developing chronic infection.

The peptides of the present invention and pharmaceutical and vaccine compositions of the invention are useful for administration to mammals, particularly humans, to treat and/or prevent infections or cancer. Vaccine compositions containing the peptides of the invention are administered to a patient susceptible to or otherwise at risk of viral infection or cancer to elicit an immune response against the antigen and thus enhance the patient's own immune response capabilities. Such an amount is defined to be an "immunogenically effective dose." In this use, the precise amounts again depend on the patient's state of health and weight, the mode of administration, the nature of the formulation, etc., but generally range from about 1.0 μg to about 5000 μg per 70 kilogram patient, more commonly from about 10 μg to about 500 μg mg per 70 kg of body weight.

In some instances it may be desirable to combine the peptide vaccines of the invention with vaccines which induce neutralizing antibody responses to the virus of interest, particularly to viral envelope antigens.

The peptides can be used to treat any number of infectious diseases, such as viral, bacterial, fungal, and parasitic infections. Suitable antigens are disclosed, for instance, in WO 94/20127 and WO 94/03205. Examples of diseases which can be treated using the immunogenic peptides of the invention include neoplastic disease such as prostate cancer, breast cancer, colon cancer, renal carcinoma, cervical carcinoma, and lymphoma; and infectious conditions such as hepatitis B, hepatitis C, AIDS, CMV, tuberculosis, malaria, and condlyloma acuminatum.

As noted herein, the peptides of the invention induce CTL or HTL immune responses when contacted with a CTL or HTL specific to an epitope comprised by the peptide. The manner in which the peptide is contacted with the CTL or HTL is not critical to the invention. For instance, the peptide can be contacted with the CTL or HTL either in vivo or in vitro. If the contacting occurs in vivo, the peptide itself can be administered to the patient or other vehicles, e.g., DNA vectors encoding one or more peptide, viral vectors encoding the peptide(s), liposomes and the like, can be used, as described herein.

For pharmaceutical compositions, the immunogenic peptides, or DNA encoding them, are administered to an individual already suffering from cancer or infected with a pathogen. The peptides or DNA encoding them can be administered individually or as fusions of one or more of the peptide sequences disclosed here. Those in the incubation phase or the acute phase of infection can be treated with the immunogenic peptides separately or in conjunction with other treatments, as appropriate. In therapeutic applications, compositions are administered to a patient in an amount sufficient to elicit an effective CTL or HTL response to the pathogen or tumor antigen and to cure or at least partially arrest or slow symptoms and/or complications. An amount adequate to accomplish this falls within the present definition of "therapeutically effective dose." Amounts effective for this use will depend on, e.g., the particular composition administered, the manner of administration, the stage and severity of the disease being treated, the weight and general state of health of the patient, and the judgment of the prescribing physician. Generally the dosage range for an initial immunization (i.e., therapeutic or prophylactic administration) is from about 1.0 μg to about 5000 μg of peptide for a 70 kg patient, more typically 10 μg to 500 μg, followed by boosting dosages of from about 1.0 μg to about 1000 μg of peptide pursuant to a boosting regimen over weeks to months depending upon the patient's response and condition by measuring specific CTL activity in the patient's blood. The peptides and compositions of the present invention are often employed in serious disease states, that is, life-threatening or potentially life threatening situations. In such cases, upon use of purified compositions of the invention, the relative nontoxic nature of the peptides, it may be felt desirable by the treating physician to administer substantial excesses of these peptide compositions relative to these stated dosage amounts.

For therapeutic use, administration should generally begin at the first diagnosis of infection or cancer. This is followed by boosting doses until at least symptoms are substantially abated and for a period thereafter. In chronic infection, loading doses followed by boosting doses may be required.

Treatment of an infected individual with a peptide or composition of the invention may hasten resolution of the infection in acutely infected individuals. For those individuals susceptible (or predisposed) to developing chronic infection, the compositions are particularly useful in methods for preventing the evolution from acute to chronic infection. Where susceptible individuals are identified prior to or during infection, the composition can be targeted to them, minimizing need for administration to a larger population.

The peptide or compositions in accordance with the invention can also be used for the treatment of chronic infection and to stimulate the immune system to eliminate pathogen-infected cells in, e.g., persons who have not manifested symptoms of disease but act as a disease vector. In this context, it is generally important to provide an amount of immuno-potentiating peptide in a formulation and mode of administration sufficient to effectively stimulate a cytotoxic T cell response. Immunizing doses followed by boosting doses at an interval, e.g., from three weeks to six months, may be required (possibly for a prolonged period of time) to effectively immunize an individual. In the case of chronic infection, administration should continue until at least clinical symptoms or laboratory tests indicate that the viral infection has been eliminated or substantially abated and for a period thereafter. The dosages, routes of administration, and dose schedules are adjusted in accordance with methodologies known in the art.

The pharmaceutical compositions for therapeutic treatment are intended for parenteral, topical, oral or local administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier. A variety of aqueous carriers may be used, e.g., water, buffered water, 0.8% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH-adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant should generally be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included, as desired, as with, e.g., lecithin for intranasal delivery.

In some instances it may be desirable to combine the peptide vaccines of the invention with vaccines which induce neutralizing antibody responses to the virus of interest, particularly to viral envelope antigens.

For therapeutic or immunization purposes, nucleic acids encoding one or more of the peptides of the invention can also be administered to the patient. A number of methods are conveniently used to deliver the nucleic acids to the patient. For instance, the nucleic acid can be delivered directly, as "naked DNA". This approach is described, for instance, in Wolff et. al., *Science* 247: 1465-68 (1990) as well as U.S. Pat. Nos. 5,580,859 and 5,589,466. The nucleic acids can also be administered using ballistic delivery as described, for instance, in U.S. Pat. No. 5,204,253. Particles comprised solely of DNA can be administered. Alternatively, DNA can be adhered to particles, such as gold particles.

The nucleic acids can also be delivered complexed to cationic compounds, such as cationic lipids. Lipid-mediated gene delivery methods are described, for instance, in WO 96/18372; WO 93/24640; Mannino and Gould-Fogerite (1988) *BioTechniques* 6(7): 682-691; Rose U.S. Pat. No. 5,279,833; WO 91/06309; and Felgner et al. (1987) *Proc. Natl. Acad. Sci. USA* 84: 7413-14.

For therapeutic or immunization purposes, the peptides of the invention can also be expressed by attenuated viral hosts, such as vaccinia or fowlpox. This approach involves the use of vaccinia virus as a vector to express nucleotide sequences that encode the peptides of the invention. Upon introduction into an acutely or chronically infected host or into a noninfected host, the recombinant vaccinia virus expresses the immunogenic peptide, and thereby elicits a host CTL response. Vaccinia vectors and methods useful in immunization protocols are described in, e.g., U.S. Pat. No. 4,722,848, incorporated herein by reference. Another vector is BCG (Bacille Calmette Guerin). BCG vectors are described in Stover et al. (*Nature* 351:456-60 (1991)) which is incorporated herein by reference. A wide variety of other vectors useful for therapeutic administration or immunization of the peptides of the invention, e.g., *Salmonella typhi* vectors and the like, will be apparent to those skilled in the art from the description herein.

Nucleic acids encoding one or more of the peptides of the invention can also be administered to the patient. This approach is described, for instance, in Wolff, et. al., *Science,* 247:1465-68 (1990) as well as U.S. Pat. Nos. 5,580,859 and 5,589,466.

A preferred means of administering nucleic acids encoding the peptides of the invention uses minigene constructs encoding multiple epitopes of the invention. To create a DNA sequence encoding the selected CTL epitopes (minigene) for expression in human cells, the amino acid sequences of the epitopes are reverse translated. A human codon usage table is used to guide the codon choice for each amino acid. These epitope-encoding DNA sequences are directly adjoined, creating a continuous polypeptide sequence. To optimize expression and/or immunogenicity, additional elements can be incorporated into the minigene design. Examples of amino acid sequence that could be reverse translated and included in the minigene sequence include: helper T lymphocyte epitopes, a leader (signal) sequence, and an endoplasmic reticulum retention signal. In addition, MHC presentation of CTL epitopes may be improved by including synthetic (e.g. poly-alanine) or naturally-occurring flanking sequences adjacent to the CTL epitopes.

The minigene sequence is converted to DNA by assembling oligonucleotides that encode the plus and minus strands of the minigene. Overlapping oligonucleotides (30-100 bases long) are synthesized, phosphorylated, purified and annealed under appropriate conditions using well known techniques. The ends of the oligonucleotides are joined using T4 DNA ligase. This synthetic minigene, encoding the CTL epitope polypeptide, can then cloned into a desired expression vector.

Standard regulatory sequences well known to those of skill in the art are included in the vector to ensure expression in the target cells. Several vector elements are required: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences can also be considered for increasing minigene expression. It has recently been proposed that immunostimulatory sequences (ISSs or CpGs) play a role in the immunogenicity of DNA vaccines. These sequences could be included in the vector, outside the minigene coding sequence, if found to enhance immunogenicity.

In some embodiments, a bicistronic expression vector, to allow production of the minigene-encoded epitopes and a second protein included to enhance or decrease immunogenicity can be used. Examples of proteins or polypeptides that could beneficially enhance the immune response if co-expressed include cytokines (e.g., IL2, IL12, GM-CSF), cytokine-inducing molecules (e.g., LeIF) or costimulatory molecules. Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-β) may be beneficial in certain diseases.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

Therapeutic quantities of plasmid DNA are produced by fermentation in *E. coli*, followed by purification. Aliquots from the working cell bank are used to inoculate fermentation medium (such as Terrific Broth), and grown to saturation in shaker flasks or a bioreactor according to well known techniques. Plasmid DNA can be purified using standard bioseparation technologies such as solid phase anion-exchange resins supplied by Quiagen. If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). A variety of methods have been described, and new techniques may become available. As noted above, nucleic acids are conveniently formulated with cationic lipids. In addition, glycolipids, fusogenic liposomes, peptides and compounds referred to collectively as protective, interactive, non-condensing (PINC) could also be complexed to purified plasmid DNA to influence variables such as stability, intramuscular dispersion, or trafficking to specific organs or cell types.

The nucleic acids can also be administered using ballistic delivery as described, for instance, in U.S. Pat. No. 5,204,253. Particles comprised solely of DNA can be administered. Alternatively, DNA can be adhered to particles, such as gold particles.

Target cell sensitization can be used as a functional assay for expression and MHC class I presentation of minigene-encoded CTL epitopes. The plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 labeled and used as target cells for epitope-specific CTL lines. Cytolysis, detected by $^{51}$Cr release, indicates production of MHC presentation of minigene-encoded CTL epitopes.

In vivo immunogenicity is a second approach for functional testing of minigene DNA formulations. Transgenic mice expressing appropriate human MHC molecules are immunized with the DNA product. The dose and route of administration are formulation dependent (e.g. IM for DNA in PBS, IP for lipid-complexed DNA). Twenty-one days after immunization, splenocytes are harvested and restimulated for 1 week in the presence of peptides encoding each epitope being tested. These effector cells (CTLs) are assayed for cytolysis of peptide-loaded, chromium-51 labeled target cells using standard techniques. Lysis of target cells sensitized by MHC loading of peptides corresponding to minigene-encoded epitopes demonstrates DNA vaccine function for in vivo induction of CTLs.

An embodiment of a vaccine composition in accordance with the invention comprises ex vivo administration of a cocktail of epitope-bearing peptides to PBMC, or isolated DC therefrom, from the patient's blood. After pulsing the DC with peptides and prior to reinfusion into patients, the DC are washed to remove unbound peptides. In this embodiment, a vaccine comprises peptide-pulsed DCs which present the pulsed peptide epitopes in HLA molecules on their surfaces.

Dendritic cells can also be transfected, e.g., with a mini gene comprising nucleic acid sequences encoding the epitopes in accordance with the invention, in order to elicit immune responses. Vaccine compositions can be created in vitro, following dendritic cell mobilization and harvesting, whereby loading of dendritic cells occurs in vitro.

Transgenic animals of appropriate haplotypes may additionally provide a useful tool in optimizing the in vivo immunogenicity of minigene DNA. In addition, animals such as monkeys having conserved HLA molecules with cross reactivity to CTL epitopes recognized by human MHC molecules can be used to determine human immunogenicity of CTL epitopes (Bertoni, et al., *J. Immunol.* 161:4447-4455 (1998)).

Such in vivo studies are required to address the variables crucial for vaccine development, which are not easily evaluated by in vitro assays, such as route of administration, vaccine formulation, tissue biodistribution, and involvement of primary and secondary lymphoid organs. Because of their simplicity and flexibility, HLA transgenic mice represent an attractive alternative, at least for initial vaccine development studies, compared to more cumbersome and expensive studies in higher animal species, such as nonhuman primates.

Antigenic peptides are used to elicit a CTL response ex vivo, as well. The resulting CTL cells, can be used to treat chronic infections, or tumors in patients that do not respond to other conventional forms of therapy, or will not respond to a therapeutic vaccine peptide or nucleic acid in accordance with the invention. Ex vivo CTL or HTL responses to a particular antigen (infectious or tumor-associated antigen) are induced by incubating in tissue culture the patient's (CTLp), or genetically compatible, CTL or HTL precursor cells together with a source of antigen-presenting cells (APC), such as dendritic cells, and the appropriate immunogenic peptide. After an appropriate incubation time (typically about 7-28 days (1-4 weeks)), in which the precursor cells are activated and matured and expanded into effector cells, the cells are infused back into the patient, where they will destroy their specific target cell (an infected cell or a tumor cell). Transfected dendritic cells may also be used as antigen presenting cells. In order to optimize the in vitro conditions for the generation of specific cytotoxic T cells, the culture of stimulator cells is maintained in an appropriate serum-free medium.

Antigenic peptides may be used to elicit CTL ex vivo, as well. The resulting CTL, can be used to treat chronic infections (viral or bacterial) or tumors in patients that do not respond to other conventional forms of therapy, or will not respond to a peptide vaccine approach of therapy. Ex vivo CTL responses to a particular pathogen (infectious agent or tumor antigen) are induced by incubating in tissue culture the patient's CTL precursor cells (CTLp) together with a source of antigen-presenting cells (APC) and the appropriate immunogenic peptide. After an appropriate incubation time (typically 1-4 weeks), in which the CTLp are activated and mature and expand into effector CTL, the cells are infused back into the patient, where they will destroy their specific target cell (an infected cell or a tumor cell). Transfected dendritic cells are also useful for cellular delivery of antigenic peptides.

The peptides may also find use as diagnostic reagents. For example, a peptide of the invention may be used to determine the susceptibility of a particular individual to a treatment regimen which employs the peptide or related peptides, and thus may be helpful in modifying an existing treatment protocol or in determining a prognosis for an affected individual. In addition, the peptides may also be used to predict which individuals will be at substantial risk for developing chronic infection.

For example, a peptide of the invention may be used in a tetramer staining assay to assess peripheral blood mononuclear cells for the presence of antigen-specific CTLs following exposure to a pathogen or immunogen. The HLA-tetrameric complex is used to directly visualize antigen-specific CTLs (see, e.g., Ogg, et al. *Science* 279:2103-2106, 1998; and Altman, et al. *Science* 174:94-96, 1996) and determine the frequency of the antigen-specific CTL population in a sample of peripheral blood mononuclear cells. A tetramer reagent using a peptide of the invention may be generated as follows: A peptide that binds to an allele-specific HLA molecule or supertype molecule is refolded in the presence of the corresponding HLA heavy chain and $\beta_2$-microglobulin to generate a trimolecular complex. The complex is biotinylated at the carboxyl terminal end of the heavy chain at a site that was previously engineered into the protein. Tetramer formation is then induced by the addition of streptavidin. By means of fluorescently labeled streptavidin, the tetramer can be used to stain antigen-specific cells. The cells may then be identified, for example, by flow cytometry. Such an analysis may be used for diagnostic or prognostic purposes.

In addition, the peptides may also be used to predict which individuals will be at substantial risk for developing chronic infection.

All publications, patents, and patent applications cited in this specification are herein incorporated by reference as if each individual publication, patent or patent application were specifically and individually indicated to be incorporated by reference.

Although the foregoing invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims.

EXAMPLES

The following examples are provided by way of illustration only and not by way of limitation. Those of skill in the art will readily recognize a variety of non-critical parameters that could be changed or modified to yield essentially similar results.

Example 1

Peptide Synthesis

Peptides utilized were synthesized as previously described by Ruppert, J., et al., "Prominent Role of Secondary Anchor Residues in Peptide Binding to HLA-A2.1 Molecules," *Cell,* 74:929-937 (1993) or purchased as crude material from Chiron Mimotopes (Chiron Corp., Australia). Synthesized peptides were typically purified to >95% homogeneity by reverse phase HPLC. Purity of synthesized peptides was determined using analytical reverse-phase HPLC and amino acid analysis, sequencing, and/or mass spectrometry. Lyophilized peptides were resuspended at 4-20 mg/ml in 100% DMSO, then diluted to required concentrations in PBS +0.05% (v/v) NP40 (Fluka Biochemika, Buchs, Switzerland).

Example 2

Class I Antigen Isolation

Class I antigen isolation was carried out as described in the related applications, noted above. Naturally processed peptides were then isolated and sequenced as described there. An allele-specific motif and algorithms were determined and quantitative binding assays were carried out.

Using the motifs identified above for HLA-A2.1 allele amino acid sequences from a number of antigens were analyzed for the presence of these motifs. TABLES 147-148, TABLES 150-151, and TABLES 152-153 provide the results of these searches.

Figure 14:
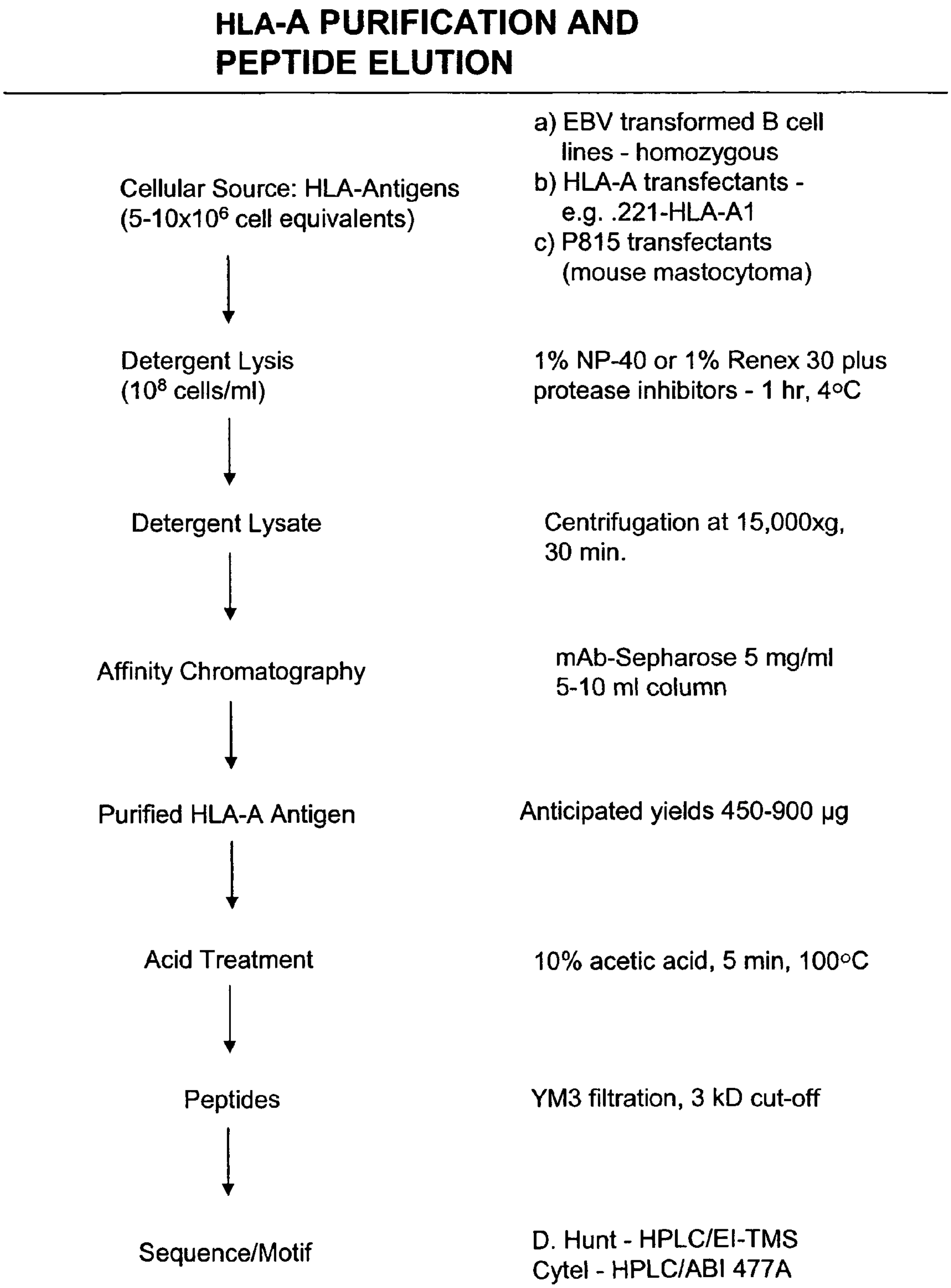
FIG. 14 is a flow diagram of an HLA-A purification scheme.

Isolated MHC molecules were used in a quantitative binding assay to identify the specificity and avidity of peptide-HLA interactions. Purification of HLA-A, HLA-B and HLA-C antigens were carried out by essentially similar methods, using cells and antibodies chosen as appropriate for the desired HLA molecule. A flow diagram of an HLA-A antigen purification scheme is presented in FIG. 14 and FIG. 49. Briefly, the cells bearing the appropriate allele were grown in large batches (6-8 liters yielding ~5×$10^9$ cells), harvested by centrifugation and washed. All cell lines were maintained in RPMI 1640 media (Sigma) supplemented with 10% fetal bovine serum (FBS) and antibiotics.

For large-scale cultures, cells were grown in roller bottle culture in RPMI 1640 with 10% FBS or with 10% horse serum and antibiotics. Cells were harvested by centrifugation at 1500 RPM IEC-CRU5000 centrifuge with 259 rotor and washed three times with phosphate-buffered saline (PBS) (0.01 M $PO_4$, 0.154 M NaCl, pH 7.2). Cells were pelleted and stored at −70° C. or treated with detergent lysing solution to prepare detergent lysates. Cell lysates were prepared by the addition of stock detergent solution [1% NP-40 (Sigma) or Renex 30 (Accurate Chem. Sci. Corp., Westbury, N.Y. 11590), 150 mM NaCl, 50 mM Tris, pH 8.0] to the cell pellets (previously counted) at a ratio of 50-100×$10^6$ cells per ml detergent solution. A cocktail of protease inhibitors was added to the premeasured volume of stock detergent solution immediately prior to the addition to the cell pellet. Addition of the protease inhibitor cocktail produced final concentrations of the following: phenylmethylsulfonyl fluoride (PMSF), 2 mM; aprotinin, 5 μg/ml; leupeptin, 10 μg/ml; pepstatin, 10 μg/ml; iodoacetamide, 100 μM; and EDTA, 3 ng/ml. Cell lysis was allowed to proceed at 4° C. for 1 hour with periodic mixing. Routinely 5-10×$10^9$ cells were lysed in 50-100 ml of detergent solution. The lysate was clarified by centrifugation at 15,000×g for 30 minutes at 4° C. and subsequent passage of the supernatant fraction through a 0.2μ filter unit (Nalgene). Cell lines used for HLA-B and -C isolations are provided in TABLE 23.

The HLA antigen purification was achieved using affinity columns prepared with mAb-conjugated Sepharose beads. For antibody production, cells were grown in RPMI with 10% FBS in large tissue culture flasks (Corning 25160-225). Antibodies were purified from clarified tissue culture medium by ammonium sulfate fractionation followed by affinity chromatography on protein-A-Sepharose (Sigma). Briefly, saturated ammonium sulfate was added slowly with stirring to the tissue culture supernatant to 45% (volume to volume) overnight at 4° C. to precipitate the immunoglobulins. The precipitated proteins were harvested by centrifugation at 10,000×g for 30 minutes. The precipitate was then dissolved in a minimum volume of PBS and transferred to dialysis tubing (Spectro/Por 2, *Mol. wt. cutoff* 12,000-14,000, Spectum Medical Ind.). Dialysis was against PBS (≥20 times the protein solution volume) with 4-6 changes of dialysis buffer over a 24-48 hour period at 4° C. The dialyzed protein solution was clarified by centrifugation (10,000×g for 30 minutes) and the pH of the solution adjusted to pH 8.0 with 1N NaOH. Protein-A-Sepharose (Sigma) was hydrated according to the manufacturer's instructions, and a protein-A-Sepharose column was prepared. A column of 10 ml bed volume typically binds 50-100 mg of mouse IgG.

The protein sample was loaded onto the protein-A-Sepharose column using a peristaltic pump for large loading volumes or by gravity for smaller volumes (<100 ml). The column was washed with several volumes of PBS, and the eluate was monitored at A280 in a spectrophotometer until base line was reached. The bound antibody was eluted using 0.1 M citric acid at suitable pH (adjusted to the appropriate pH with IN NaOH). For mouse IgG-1 pH 6.5 was used for IgG2a pH 4.5 was used and for IgG2b and IgG3 pH 3.0 was used. 2 M Tris base was used to neutralize the eluate. Fractions containing the antibody (monitored by A280) were pooled, dialyzed against PBS and further concentrated using an Amicon Stirred Cell system (Amicon Model 8050 with YM30 membrane). Antibodies were used for affinity purification of HLA-B and HLA-C molecules are provided in TABLE 24.

The HLA antigens were purified using affinity columns prepared with mAb-conjugated Sepharose beads. The affinity columns were prepared by incubating protein-A-Sepharose beads (Sigma) with affinity-purified mAb as described above. Five to 10 mg of mAb per ml of bead is the preferred ratio. The mAb bound beads were washed with borate buffer (borate buffer: 100 mM sodium tetraborate, 154 mM NaCl, pH 8.2) until the washes show A280 at based line. Dimethyl pimelimidate (20 mM) in 200 mM triethanolamine was added to covalently crosslink the bound mAb to the protein-A-Sepharose (Schneider, et al *J. Biol. Chem.* 257:10766 (1982). After incubation for 45 minutes at room temperature on a rotator, the excess crosslinking reagent was removed by washing the beads twice with 10-20 ml of 20 mM ethanolamine, pH 8.2. Between each one the slurry was placed on a rotator for 5 minutes at room temperature. The beads were washed with borate buffer and with PBS plus 0.02% sodium azide.

The cell lysate (5-10×$10^9$ cell equivalents) was then slowly passed over a 5-10 ml affinity column (flow rate of 0.1-0.25 ml per minute) to allow the binding of the antigen to the immobilized antibody. After the lysate was allowed to pass through the column, the column was washed sequentially with 20 column volumes of detergent stock solution plus 0.1% sodium dodecyl sulfate, 20 column volumes of 0.5 M NaCl, 20 mM Tris, pH 8.0, and 10 column volumes of 20 mM Tris, pH 8.0. The HLA antigen bound to the mAb was eluted with a basic buffer solution (50 mM diethylamine in water). As an alternative, acid solutions such as 0.15-0.25 M acetic acid were also used to elute the bound antigen. An aliquot of the eluate (1/50) was removed for protein quantification using either a colorimetric assay (BCA assay, Pierce) or by SDS-PAGE, or both. SDS-PAGE analysis was performed as described by Laemmli (Laemmli, U.K., *Nature* 227:680 (1970)) using known amounts of bovine serum albumin (Sigma) as a protein standard.

Allele specific antibodies were used to purify the specific MHC molecule. In the case of HLA-A2 and HLA-A3 mAbs BB7:2 and GAPA3 were used respectively. An example of SDS PAGE analysis of purified HLA-A3.2 molecules is shown in FIG. 15.

Figure 15:
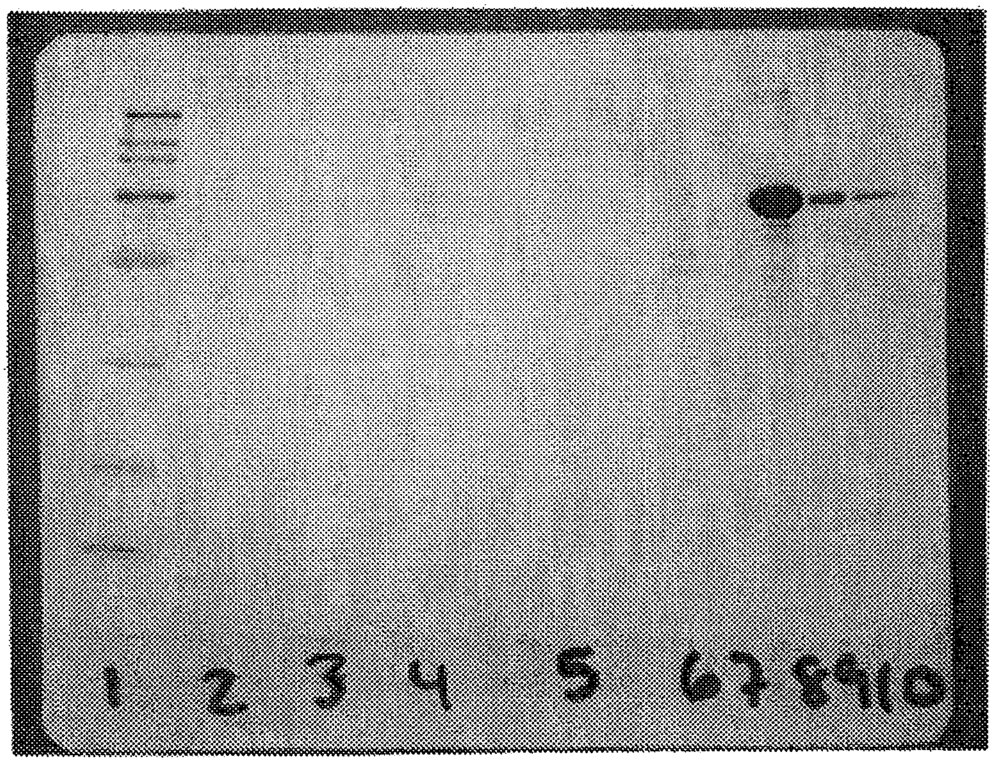
FIG. 15 is an SDS-PAGE analysis of affinity purified. HLA-A3.2 from the cell line EHM using an affinity column prepared with the mAb GAP A3 coupled to protein A-S epharose.

FIG. 15 shows SDS-PAGE (12.5%) analysis of affinity purified HLA-A3. 2 from the cell line EHM. An affinity column (10 ml) was prepared with protein A-sepharose beads coupled to the monoclonal antibody GAPA3 which is specific for HLA-A3. A detergent lysate of $5\times10^9$ cells was passaged over the column and the column was washed extensively. The bound HLA-A3. 2 molecules were eluted from the column with 0.15M acetic acid, 50 ml. One ml of the eluate was removed and lyophilized to concentrate the sample. The sample was taken up to 50 μl with Laemmli sample buffer and 20 μl were loaded in lane 2. Lane 1 contained molecular weight standards: Myosin, 230 kD; β-galactosidase, 116 kD; phosphorylase B, 97.4 kD; bovine serum albumin, 66.2 kD; ovalbumin, 45 kD; carbonic anhydrase, 31 kD; soybean trypsin inhibitor, 21.5 kD; and lysozyme, 14.4 kD. Standard concentrations of bovine serum albumin were run in lanes 8, 10 μg, 9, 3 μg, and 10, μg to aid in the estimation of protein yield. For this particular HLA-A3.2 preparation, the estimated yield was approximately 112 pg.

For HLA-A11, A24.1 and A1, an alternative protocol, was used whereby anti-HIA-B and C monoclonal antibodies were used to deplete HLA-B and C molecules. The remaining HLA-A molecules were subsequently purified using the W6/32 mAb as described below.

Based on the density of class I expression as indicated by the results of immunofluorescent staining analysis, it is anticipated that average yields of class I antigen isolated from the EBV B cell lines will range from 800-1200 pg per $10^{10}$ cell equivalents.

Example 3

An Alternative Class I Purification Protocol

HLA-A2.1 molecules were isolated using the mAb B1.23.2 which detects an epitope expressed by HLA-B and C allele molecules, but not by HLA-A antigens. The mAb, W6/32, detects all human class I molecules, including HLA-A, B and C. As mentioned above, these mAbs react well with the B cell lines serving as sources of HLA-A antigens. The B1.23.2 mAb reacts with the various human B cell lines, but fails to react with a mouse cell line that expresses a transfected HLA-A2.1 protein or a chimeric A2.1 mouse $K^b$ molecule. It does react with the human cell line, CIR (Alexander, J., et al., *Immunogenetics,* 29, 380 C19893), that lacks expression of HLA-A and B molecules, but expresses low levels of. HLA-C molecules. This pattern of reactivity illustrates how the 81.23.2 mAb can be used to deplete the B cell lysates of HLA-B and C molecules.

Affinity columns were prepared using the affinity-purified B1.23.2 and W6/32 mAbs, respectively, as described above. The procedures for the preparation of the affinity columns are essentially identical to the procedures described for the preparation of the allele-specif is mAb columns described above. The B1.23.2 mAb affinity column was used to deplete the detergent lysates of HLA-B and C molecules using the protocol as described above. The cell lysate depleted of HLA-B and C was then passed over a W6/32 mAb affinity column. The MHC molecule that was eluted from this second passage was the A allele product.

This alternative affinity purification is useful for the purification of any HLA-A allele product, and does not rely on the need for allele-specific mAbs. In addition, it could also be used to isolate any class I molecule type from transfected cell lines.

Example 4

MHC Purification

The EBV transformed cell lines JY (A*0201), M7B (A*0202), FUN (A*0203), DAH (A*0205), CLA (A*0206), KNE (A*0207), AP (A*0207), and AMAI (A*6802) were used as the primary source of MHC molecules. Single MHC allele transfected 721.221 lines were also used as sources of A*0202 and A*0207. Cells were maintained in vitro by culture in RPMI 1640 medium (Flow Laboratories, McLean, Va.), supplemented with 2 mM L-glutamine (GIBCO, Grand Island, N.Y.), 100 U (100 μg/ml) penicillin-streptomycin solution (GIBCO), and 10% heat-inactivated FCS (Hazelton Biologics). Large scale cultures were maintained in roller bottles.

HLA molecules were purified from cell lysates (Sidney, J., et al., "The Measurement of MHC/Peptide Interactions by Gel Infiltration," *Curr Prot Immunol* 18.3.1-18.3.19 (1998)). Briefly, cells were lysed at a concentration of $10^8$ cells/ml in 50 mM Tris-HCL, pH 8.5, containing 1% (v/v) NP-40 150 mM NaCl, 5 mM EDTA, and 2 mM PMSF. Lysates were then passed through 0.45 μM filters, cleared of nuclei and debris by centrifugation at 10,000×g for 20 minutes and MHC molecules purified by monoclonal antibody-based affinity chromatography.

For affinity purification, columns of inactivated Sepharose CL4B and Protein A Sepharose were used as pre-columns. Class I molecules were captured by repeated passage over Protein A Sepharose beads conjugated with the anti-HLA (A, B, C) antibody W6/32 (Sidney, J., et al., supra). HLA-A molecules were further purified from HLA-B and -C molecules by passage over a B1.23.2 column. After 2 to 4 passages the W6/32 column was washed with 10-column volumes of 10 mM Tris-HCL, pH 8.0 with 1% (v/v) NP-40, 2-column volumes of PBS, and 2-column volumes of PBS containing 0.4% (w/v) n-octylglucoside. Class I molecules were eluted with 50 mM dimethylamine in 0.15 M NaCl containing 0.4% (w/v) n-octylglucoside, pH 11.5.A 1/26 volume of 2.0 M Tris, pH 6.8, was added to the eluate to reduce the pH to ~8.0. The eluate was then concentrated by centrifugation in Centriprep 30 concentrators at 2000 rpm (Amicon, Beverly, Mass.). Protein purity, concentration, and effectiveness of depletion steps were monitored by SDS-PAGE and BCA assay.

Example 5

Isolation and Sequencing of Naturally Processed Peptides

For the HLA-A preparations derived from the base (50 mM diethylamine) elution protocol, the eluate was immediately neutralized with 1 N acetic acid to pH 7.0-7.5. The neutralized eluate was concentrated to a volume of 1-2 ml in an Amicon stirred cell [Model 8050, with YM3 membranes (Amicon)]. Ten ml of ammonium acetate (0.01 M, pH 8.0) was added to the concentrator to remove the non-volatile salts, and the sample was concentrated to approximately 1 ml. A small sample (1/50) was removed for protein quantitation as described above. The remainder was recovered into a 15 ml polypropylene conical centrifuge tube (Falcon, 2097) (Becton Dickinson). Glacial acetic acid was added to obtain a final concentration of 10% acetic acid. The acidified sample was placed in a boiling water bath for 5 minutes to allow for the dissociation of the bound peptides. The sample was cooled on ice, returned to the concentrator and the filtrate was collected. Additional aliquots of 10% acetic acid (1-2 ml) were added to the concentrator, and this filtrate was pooled with the original filtrate. Finally, 1-2 ml of distilled water was added to the concentrator, and this filtrate was pooled as well.

The retentate contains the bulk of the HLA-A heavy chain and $\hat{a}_2$-microglobulin, while the filtrate contains the naturally processed bound peptides and other components with molecular weights less than about 3000. The pooled filtrate material was lyophilized in order to concentrate the peptide fraction. The sample was then ready for further analysis.

For HPLC (high performance liquid chromatography) separation of the peptide fractions, the lyophilized sample was dissolved in 50 μl of distilled water, or into 0.1% trifluoracetic acid (TFA) (Applied Biosystems) in water and injected to a C18 reverse-phase narrow bore column (Beckman C18 Ultrasphere, 10×250 mm), using a gradient system described by Stone and Williams (Stone, K. L. and Williams K. R., in, Macromolecular Sequencing and Synthesis; Selected Methods and Applications, A. R. Liss, New York, 1988, pp. 7-24. Buffer A was 0.06% TFA in water (Burdick-Jackson) and buffer B was 0.052% TFA in 80% acetonitrile (Burdick-Jackson). The flow rate was 0.250 ml/minute with the following gradient: 0-60 min., 2-37.5% B; 60-95 min., 37.5-75% B; 95-105 min., 75-98% B. The Gilson narrow bore HPLC configuration is particularly useful for this purpose, although other configurations work equally well.

A large number of peaks were detected by absorbance at 214 nm, many of which appear to be of low abundance. Whether a given peak represents a single peptide or a peptide mixture was not determined. Pooled fractions were then sequenced to determine motifs specific for each allele as described below.

Pooled peptide fractions, prepared as described above were analyzed by automated Edman sequencing using the Applied Biosystems Model 477A automated sequencer. The sequencing method is based on the technique developed by Pehr Edman in the 1950s for the sequential degradation of proteins and peptides to determine the sequence of the constituent amino acids.

The protein or peptide to be sequenced was held by a 12-mm diameter porous glass fiber filter disk in a heated, argon-purged reaction chamber. The filter was generally pretreated with BioBrene Plus™ and then cycled through one or more repetitions of the Edman reaction to reduce contaminants and improve the efficiency of subsequent sample sequencing. Following the pre-treatment of the filter, a solution of the sample protein or peptide (10 pmol-5 nmol range) was loaded onto the glass filter and dried. Thus, the sample was left embedded in the film of the pre-treated disk. Covalent attachment of the sample to the filter was usually not necessary because the Edman chemistry utilized relatively apolar solvents, in which proteins and peptides are poorly soluble.

Briefly, the Edman degradation reaction has three steps: coupling, cleavage, and conversion. In coupling step, phenylisothiocyanate (PITC) is added. The PITC reacts quantitatively with the free amino-terminal amino acid of the protein to form the phenylthiocarbamyl-protein in a basic environment. After a period of time for the coupling step, the excess chemicals are extracted and the highly volatile organic acid, trifluoroacetic acid, TFA, is used to cleave the PITC-coupled amino acid residue from the amino terminus of the protein yielding the anilinothiazolinone (ATZ) derivative of the amino acid. The remaining protein/peptide is left with a new amino terminus and is ready for the next Edman cycle. The ATZ amino acid is extracted and transferred to a conversion flask, where upon addition of 25% TFA in water, the ATZ amino acid is converted to the more stable phenylthiohydantoin (PTH) amino acid that can be identified and quantified following automatic injection into the Model 120 PTH Analyzer which uses a microbore C-18 reverse-phase HPLC column for the analysis.

In the present procedures, peptide mixtures were loaded onto the glass filters. Thus, a single amino acid sequence usually does not result. Rather, mixtures of amino acids in different yield are found. When the particular residue is conserved among the peptides being sequenced, increased yield for that amino acid is observed.

Example 6

MHC-Peptide Binding Assays

Quantitative assays to measure the binding of peptides to soluble Class I molecules are based on the inhibition of binding of a radiolabeled standard peptide. These assays were performed as previously described (Sidney, J., et al., supra.). Briefly, 1-10 nM of radiolabeled peptide was co-incubated at room temperature with 1 μM to 1 nM of purified MHC in the presence of 1 μM human $\beta_2$-microglubulin (Scripps Laboratories, San Diego, Calif.) and a cocktail of protease inhibitors. Following a two day incubation, the percent of MHC bound radioactivity was determined by size exclusion gel filtration chromatography using a TSK 2000 column. Alternatively, the percent of MHC bound radioactivity was determined by capturing MHC/peptide complexes on W6/32 antibody coated plates, and determining bound cpm using the TopCount microscintillation counter (Packard Instrument Co., Meriden, Conn.) (Southwood, et al., *Epimmune Technical Report* Epi 063-99).

The radio labeled standard peptide utilized for the A*0201, A*0202, A*0203, A*0205, A*0206, and A*0207 assays was an $F_6$>Y analog of the HBV core 18-27 epitope (sequence FLPSDYFPSV (SEQ ID NO:592)). The average $IC_{50}$ of this peptide for each molecule was 5.0, 4.3, 10, 4.3, 3.7, and 23 nM, respectively. A $C_4$>A analog of HBV pol 646 (sequence FTQAGYPAL (SEQ ID NO:14617)), or MAGE 1 282 (sequence YVIKVSARV (SEQ ID NO:11833)), was utilized as the label for the A*6802 assay. Their $IC_{50}$s for A*6802 were 40 and 8 nM, respectively.

In the case of competitive assays, the concentration of peptide yielding 50% inhibition of the binding of the radiolabeled peptide was calculated. Peptides were initially tested at one or two high doses. The $IC_{50}$ of peptides yielding positive inhibition were then determined in subsequent experiments, in which two to six further dilutions were tested. Under the conditions utilized, where [label]<[MHC] and $IC_{50}$≥[MHC], the measured $IC_{50}$ values are reasonable approximations of the true Kd values. Each competitor peptide was tested in two to four independent experiments. As a positive control, the unlabeled version of the radiolabeled probe was also tested in each experiment.

Example 7

Alternative Binding Assay

Epstein-Ban virus (EBV)-transformed homozygous cell lines, fibroblasts, CIR, or 721.22 transfectants were used as sources of HLA class I molecules. These cells were maintained in vitro by culture in RPMI 1640 medium supplemented with 2 mM L-glutamine (GIBCO, Grand Island, N.Y.), 50 μM 2-ME, 100 μg/ml of streptomycin, 100 U/ml of penicillin (Irvine Scientific) and 10% heat-inactivated FCS (Irvine Scientific, Santa Ana, Calif.). Cells were grown in 225-$cm^2$ tissue culture flasks or, for large-scale cultures, in roller bottle apparatuses. Cells were harvested by centrifugation at 1500 RPM using an IEC-CRU5000 centrifuge with a 259 rotor and washed three times with phosphate-buffered saline (PBS) (0.01 M $PO_4$, 0.154 M NaCl, pH 7.2).

Cells were pelleted and stored at −70° C. or treated with detergent lysing solution to prepare detergent lysates. Cell lysates were prepared by the addition of stock detergent solution [1% NP-40 (Sigma) or Renex 30 (Accurate Chem. Sci. Corp., Westbury, N.Y. 11590), 150 mM NaCl, 50 mM Tris, pH 8.0] to the cell pellets (previously counted) at a ratio of 50-100×$10^6$ cells per ml detergent solution. A cocktail of protease inhibitors was added to the premeasured volume of stock detergent solution immediately prior to the addition to the cell pellet. Addition of the protease inhibitor cocktail produced final concentrations of the following: phenylmethylsulfonyl fluoride (PMSF), 2 mM; aprotinin, 5 μg/ml; leupeptin, 10 μg/ml; pepstatin, 10 μg/ml; iodoacetamide, 100 μM; and EDTA, 3 ng/ml. Cell lysis was allowed to proceed at 4° C. for 1 hour with periodic mixing. Routinely 5-10×$10^9$ cells were lysed in 50-100 ml of detergent solution. The lysate was clarified by centrifugation at 15,000×g for 30 minutes at 4° C. and subsequent passage of the supernatant fraction through a 0.2μ filter unit (Nalgene).

The HLA-A antigen purification was achieved using affinity columns prepared with mAb-conjugated Sepharose beads. For antibody production, cells were grown in RPMI with 10% FBS in large tissue culture flasks (Corning 25160-225). Antibodies were purified from clarified tissue culture medium by ammonium sulfate fractionation followed by affinity chromatography on protein-A-Sepharose (Sigma). Briefly, saturated ammonium sulfate was added slowly with stirring to the tissue culture supernatant to 45% (volume to volume) overnight at 4° C. to precipitate the immunoglobulins. The precipitated proteins were harvested by centrifugation at 10,000×g for 30 minutes. The precipitate was then dissolved in a minimum volume of PBS and transferred to dialysis tubing (Spectro/Por 2, Mol. wt. cutoff 12,000-14,000, Spectum Medical Ind.). Dialysis was against PBS (20 times the protein solution volume) with 4-6 changes of dialysis buffer over a 24-48 hour period at 4° C. The dialyzed protein solution was clarified by centrifugation (10,000×g for 30 minutes) and the pH of the solution adjusted to pH 8.0 with 1N NaOH. Protein-A-Sepharose (Sigma) was hydrated according to the manufacturer's instructions, and a protein-A-Sepharose column was prepared. A column of 10 ml bed volume typically binds 50-100 mg of mouse IgG.

The protein sample was loaded onto the protein-A-Sepharose column using a peristaltic pump for large loading volumes or by gravity for smaller volumes (<100 ml). The column was washed with several volumes of PBS, and the eluate was monitored at A280 in a spectrophotometer until base line was reached. The bound antibody was eluted using 0.1 M citric acid at suitable pH (adjusted to the appropriate pH with 1N NaOH). For mouse IgG-1 pH 6.5 was used for IgG2a pH 4.5 was used and for IgG2b and IgG3 pH 3.0 was used. 2 M Tris base was used to neutralize the eluate. Fractions containing the antibody (monitored by A280) were pooled, dialyzed against PBS and further concentrated using an Amicon Stirred Cell system (Amicon Model 8050 with YM30 membrane). The anti-A2 mAb, BB7.2, was useful for affinity purification.

The HLA-A antigen was purified using affinity columns prepared with mAb-conjugated Sepharose beads. The affinity columns were prepared by incubating protein-A-Sepharose beads (Sigma) with affinity-purified mAb as described above. Five to 10 mg of mAb per ml of bead is the preferred ratio. The mAb bound beads were washed with borate buffer (borate buffer: 100 mM sodium tetraborate, 154 mM NaCl, pH 8.2) until the washes show A280 at based line. Dimethyl pimelimidate (20 mM) in 200 mM triethanolamine was added to covalently crosslink the bound mAb to the protein-A-Sepharose (Schneider, et al., *J. Biol. Chem.* 257:10766 (1982). After incubation for 45 minutes at room temperature on a rotator, the excess crosslinking reagent was removed by washing the beads twice with 10-20 ml of 20 mM ethanolamine, pH 8.2. Between each one the slurry was placed on a rotator for 5 minutes at room temperature. The beads were washed with borate buffer and with PBS plus 0.02% sodium azide.

The cell lysate (5-10×$10^9$ cell equivalents) was then slowly passed over a 5-10 ml affinity column (flow rate of 0.1-0.25 ml per minute) to allow the binding of the antigen to the immobilized antibody. After the lysate was allowed to pass through the column, the column was washed sequentially with 20 column volumes of detergent stock solution plus 0.1% sodium dodecyl sulfate, 20 column volumes of 0.5 M NaCl, 20 mM Tris, pH 8.0, and 10 column volumes of 20 mM Tris, pH 8.0. The HLA-A antigen bound to the mAb was eluted with a basic buffer solution (50 mM dimethylamine in water). As an alternative, acid solutions such as 0.15-0.25 M acetic acid were also used to elute the bound antigen. An aliquot of the eluate (1/50) was removed for protein quantification using either a colorimetric assay (BCA assay, Pierce) or by SDS-PAGE, or both. SDS-PAGE analysis was performed as described by Laemmli (Laemmli, U.K., *Nature* 227:680 (1970)) using known amounts of bovine serum albumin (Sigma) as a protein standard. Allele specific antibodies were used to purify the specific MHC molecule. In the case of HLA-A2, the mAb BB7.2 was used.

A detailed description of the protocol utilized to measure the binding of peptides to Class I HLA molecules has been published (Sette, et al., *Mol. Immunol.* 31:813, 1994; Sidney, et al., in *Current Protocols in Immunology*, Margulies, Ed., John Wiley & Sons, New York, Section 18.3, 1998). Briefly, purified MHC molecules (5 to 500 nM) were incubated with various unlabeled peptide inhibitors and 1-10 nM $^{125}$I-radiolabeled probe peptides for 48 h in PBS containing 0.05% Nonidet P-40 (NP40) (or 20% w/v digitonin for H-2 IA assays) in the presence of a protease inhibitor cocktail. The final concentrations of protease inhibitors (each from CalBioChem, La Jolla, Calif.) were 1 mM PMSF, 1.3 nM 1.10 phenanthroline, 73 μM pepstatin A, 8 mM EDTA, 6 mM N-ethylmaleimide, and 200 μM N alpha-p-tosyl-L-lysine chloromethyl ketone (TLCK). All assays were performed at pH 7.0.

Following incubation, MHC-peptide complexes were separated from free peptide by gel filtration on 7.8 mm×15 cm TSK200 columns (TosoHaas 16215, Montgomeryville, Pa.), eluted at 1.2 mls/min with PBS pH 6.5 containing 0.5% NP40 and 0.1% $NaN_3$. The eluate from the TSK columns was passed through a Beckman 170 radioisotope detector, and radioactivity was plotted and integrated using a Hewlett-Packard 3396A integrator, and the fraction of peptide bound was determined.

Radiolabeled peptides were iodinated using the chloramine-T method. A specific radiolabeled probe peptide was utilized in each assay. Typically, in preliminary experiments, each MHC preparation was titered in the presence of fixed amounts of radiolabeled peptides to determine the concentration of HLA molecules necessary to bind 10-20% of the total radioactivity. All subsequent inhibition and direct binding assays were performed using these HLA concentrations.

Since under these conditions [label]<[HLA] and $IC_{50} \geq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition, i.e. the reference peptide that is included in every binding assay, by the $IC_{50}$ for each tested peptide (typically unlabeled versions of the radiolabeled probe peptide). For database purposes, and inter-experiment comparisons, relative binding values are compiled. These values can subsequently be converted into normalized $IC_{50}$ nM values by dividing the standard historical $IC_{50}$ of the reference peptide by the relative binding of the peptide of interest. This method of data compilation has proven to be the most accurate and consistent for comparing peptides that have been tested on different days, or with different lots of purified MHC.

For example, the standard reference peptide (or positive control) for the HLA-A2.1 binding assays described herein is the peptide having a sequence of FLPSDYFPSV (SEQ ID NO:592), which has an average historical $IC_{50}$ value of 5 nM in multiple, repeated binding assays. This standard value is used to normalize reported $IC_{50}$ values for HLA-A2.1 binding as described herein. Thus, a relative binding value of a test HLA-A2.1 motif-bearing peptide can be converted into a normalized $IC_{50}$ by dividing the standard reference $IC_{50}$ value, i.e., 5 nM, by the relative binding value of the test HLA-A2.1 motif-bearing peptide.

Example 8

Sequence and Binding Analysis

Using the assay described in Example 4, a relative binding value was calculated for each peptide by dividing the $IC_{50}$ of the positive control for inhibition by the $IC_{50}$ for each tested peptide. These values can subsequently be converted back into $IC_{50}$ nM values by dividing the $IC_{50}$ nM of the positive controls for inhibition by the relative binding of the peptide of interest. This method of data compilation has proved to be accurate and consistent for comparing peptides that have been tested on different days or with different lots of purified MHC. Standardized relative binding values also allow the calculation a geometric mean, or average relative binding value (ARB), for all peptides with a particular characteristic (Ruppert, J., et al., "Prominent Role of Secondary Anchor Residues in Peptide Binding to HLA-A2.1 Molecules," *Cell* 74:929-937 (1993); Sidney, J., et al., "Definition of an HLA-A3-Like Supermotif Demonstrates the Overlapping Peptide Binding Repertoires of Common HLA Molecules," *Hum Immunol.* 45:79-93 (1996); Sidney, J., et al., "Specificity and Degeneracy in Peptide Binding to HLA-B7-Like Class I Molecules," *J. Immunol.* 157:3480-3490 (1996); Kondo, A., et al., "Prominent Roles of Secondary Anchor Residues in Peptide Binding to HLA-A24 Human Class I Molecules," *J. Immunol.* 155:4307-4312 (1995); Kondo, A., et al., "Two Distinct HLA-A*0101-Specific Submotifs Illustrate Alternative Peptide Binding Modes," *Immunogenetics* 45:249-258 (1997); Gulukota, K., et al., "Two Complementary Methods for Predicting Peptides Binding Major Histocompatibility Complex Molecules," *J. Mol. Biol.* 267:1258-1267 (1997); Southwood, S., et al., "Several Common HLA-DR Types Share Largely Overlapping Peptide Binding Repertoires," *J. Immunol* 160:3363-3373 (1998)).

Maps of secondary interactions influencing peptide binding to HLA-A2 supertype molecules based on ARB were derived as previously described (Ruppert, J. et al., "Prominent Role of Secondary Anchor Residues in Peptide Binding to HLA-A2.1 Molecules," *Cell* 74:929-937 (1993); Sidney, J., et al., "Definition of an HLA-A3-Like Supermotif Demonstrates the Overlapping Peptide Binding Repertoires of Common HLA Molecules," *Hum Immunol.* 45:79-93 (1996); Sidney, J., et al., "Specificity and Degeneracy in Peptide Binding to HLA-B7-Like Class I Molecules," *J. Immunol.* 157:3480-3490 (1996); Kondo, A., et al., "Prominent Roles of Secondary Anchor Residues in Peptide Binding to HLA-A24 Human Class I Molecules," *J. Immunol.* 155:4307-4312 (1995); Kondo, A., et al., "Two Distinct HLA-A*0101-Specific Submotifs Illustrate Alternative Peptide Binding Modes," *Immunogenetics* 45:249-258 (1997); Gulukota, K., et al., "Two Complementary Methods for Predicting Peptides Binding Major Histocompatibility Complex Molecules," *J. Mol. Biol.* 267:1258-1267 (1997)). Essentially, all peptides of a given size (8, 9, 10 or 11 amino acids) and with at least one tolerated main anchor residue were selected for analysis. The binding capacity of peptides in each size group was analyzed by determining the ARB values for peptides that contain specific amino acid residues in specific positions. For determination of the specificity at main anchor positions ARB values were standardized relative to the ARB of peptides carrying the residue associated with the best binding. For secondary anchor determinations, ARB values were standardized relative to the ARB of the whole peptide set considered. That is, for example, an ARB value was determined for all 9-mer peptides that contain A in position 1, or F in position 7, etc. Because of the rare occurrence of certain amino acids, for some analyses residues were grouped according to individual chemical similarities as previously described (Ruppert, J. et al., supra; Sidney, J., et al., supra; Sidney, J., et al., supra; Kondo, A., et al., supra; Kondo, A., et al., supra; Gulukota, K., et al., supra; Southwood, S., et al., supra).

Frequencies of HLA-A2-Supertype Molecules

To select a panel of A2-supertype molecules representative of the allelic forms most frequent in major ethnic groups, unpublished population typing data from D. Mann and M. Fernandez-Vina were utilized. These data were consistent with published data (Sudo, T., et al., "DNA Typing for HLA Class I Alleles: I. Subsets of HLA-A2 and of -A28," *Hum. Immunol.* 33:163-173 (1992); Ellis, J. M., et al., "Frequencies of HLA-A2 alleles in Five US Population Groups," *Hum. Immunol.* 61:334-340 (2000); Krausa, P., et al., "Genetic Polymorphism Within HLA-A*02: Significant Allelic Variation Revealed in Different Populations," *Tissue Antigens* 45:233-231 (1995) and Imanishi, T., et al., "Allele and Haplotype Frequencies for HLA and Complement Loci in Various Ethnic Groups" Tsuji, K., et al., (eds): *HLA* 1991, Proceedings of the Eleventh International Histo-Compatibility Workshop and Conference, Vol. 1, Oxford University Press, Oxford, pp. 1065-1220 (1992)), and are shown in TABLE 38. For the four major ethnic groups considered, it was apparent that seven HLA alleles represent the vast majority of A2 supertype alleles. Included in this group are A*0201, A*0202, A*0203, A*0205, A*0206, A*0207, and A*6802. Each of these alleles is present in 2% or more of the general population, and also occur with a frequency greater than 5% in at least one major ethnicity. Other alleles are represented with only minor frequencies of 1.3%, or less, in any one major ethnic group. Furthermore, none of the minor alleles are present with a frequency greater than 1% in the general population. Based on these observations, A*0201, A*0202, A*0203, A*0205, A*0206, A*0207, and A*6802 were selected for studies defining peptide binding specificity and cross-reactivity in the A2-supertype.

Main Anchor Positions of A2 Supertype Molecules

Previous studies indicated a largely overlapping peptide binding specificity for a set of Class I molecules designated as the A2-supertype. Here, the main peptide binding specificity of A2-supertype molecules was examined in more detail.

Some of these results have been published previously, and are shown here only for reference purposes (Ruppert, J., et al., supra and Sidney, J., et al., "The HLA-A*0207 Peptide Binding Repertoire is Limited to a Subset of the A*0201 Repetoire," *Hum. Immunol.,* 58:12-20 (1997)).

In a first series of studies, non-conservative lysine (K) substitutions were introduced at every position of two peptides previously noted to bind multiple A2-supertype molecules: 1) the HCV NS3 590 9-mer peptide (sequence YLVAYQATV (SEQ ID NO:3765)), and 2) the HBV core 18 $F_6$>Y 10-mer analog peptide (sequence FLPSDYFPSV (SEQ ID NO:3775)). These peptides were tested for their capacity to bind A*0201, A*0202, A*0203, A*0205, A*0206, A*0207 and A*6802. In TABLE 39 and TABLE 40, binding capacities are expressed as ratios relative to the parent peptide. Peptides whose binding capacities are within 10-fold of the best binder are considered preferred; those whose relative binding capacities are 10-100-fold less than the best binder are considered tolerated. A dash ("-") indicates a relative binding of less than 0.01. In the case of the HCV NS3 590 peptide (TABLE 39), K substitutions at position 2 and the C-terminus resulted in greater than 100-fold reduction in binding to each HLA molecule. Greater than 100-fold decreases in binding were also noted in the context of A*6802 when K was substituted in positions 1 and 5. Reductions in binding capacity in the 10-100-fold range were noted when substitutions were made at several other positions, notably positions 3 and 7. When the 10-mer HBV core 18 $F_6$>Y ligand (TABLE 40) was investigated, greater than 100-fold reductions in binding capacity were again noted when the peptide was substituted at position 2 and the C-terminus. Significant reductions in binding were also observed following substitution at position 7.

Together, these data suggest that A2-supertype molecules bind both 9- and 10-mer peptide ligands via anchor residues in position 2 and at the C-terminus. The presence of an additional primary or secondary anchor towards the middle of the peptide is demonstrated by the fact that the binding of both the 9-mer and 10-mer peptides was usually reduced by substitutions at position 7. Specificity of the Position 2 and C-Terminal Anchor Residues.

Based on these results, the ligand specificity of A2-supertype molecules at position 2 and the C-terminus was analyzed using additional HCV NS3 590 and HBV core 18 $F_6$>Y single substitution analogs, and also single substitution analogs of a poly-alanine peptide (peptide 953.01; sequence ALAKAAAAV (SEQ ID NO:3786)). For these analyses, preferred amino acids for anchor residues were defined as those associated with a binding capacity within 10-fold of the optimal residue. Amino acids whose relative binding capacity was between 0.01 and 0.1 were defined as tolerated, and those associated with a binding capacity less than 0.01 were considered as non-tolerated. In the accompanying tables, a dash ("-") indicates a relative binding of less than 0.01. Binding capacities are expressed as ratios relative to the related analog with the highest binding affinity for each individual molecule.

At position 2 small aliphatic and hydrophobic residues were found to be generally tolerated, while other residues, including large polar, aromatic, and charged residues were typically not well tolerated (TABLE 41, TABLE 42, and TABLE 43). L, I, V, and M were preferred as anchor residues in most (>80%) contexts (TABLE 44). The allele/peptide combinations in Table 44 refer to the number of instances in which a given residue was associated with a relative binding in the 1-0.1 range (preferred) or 0.1-0.01 range (tolerated). A, T, Q, and S were less frequently preferred as anchor residues, but were either preferred or tolerated in >80% of the contexts examined (TABLE 44). None of the other amino acids examined were preferred in any context and only rarely tolerated (residues, but were either preferred or tolerated in >80% of the contexts examined. None of the other amino acids examined were preferred in any context and only rarely tolerated.).

At the C-terminus, V was found to be the optimal residue in the context of all 3 parent peptides for A*0201, A*0206, and A*6802, and in 2 out of 3 cases for A*0203 and A*0205 (TABLE 45, TABLE 46, and TABLE 47). Overall, either V or L was the optimal C-terminal residue for each molecule, regardless of the peptide tested. The allele/peptide combinations in Table 48 refer to the number of instances in which a given residue was associated with a relative binding in the 1-0.1 range (preferred) or 0.1-0.01 range (tolerated). The aliphatic/hydrophobic amino acids V, L, and I were preferred as anchor residues in greater than 66.7% of the MHC-peptide contexts. M, A, and T were tolerated approximately 50% of the time. Other residues examined were either not accepted at all, or were tolerated only rarely.

A Re-Evaluation of the Peptide Binding Specificity of A*0201

The fine specificity of A*0201 binding was investigated in more detail using a database of over 4000 peptides between 8- and 11-residues in length. It was found that over 30% of the peptides bearing L or M in position 2 bound A*0201 with affinities of 500 nM, or better (FIG. 1*a*). Between 5 and 15% of the peptides bearing the aliphatic residues I, V, A, T, and Q bound with $IC_{50}$s of 500 nM, or better. No other residue, including aromatic (F, W, and Y), charged (R, H, K, D, and E), polar (S and N) and small (C, G, and P) residues, was associated with $IC_{50}$s of 500 nM, or better.

Consistent with the single substitution analysis, V was found to be the optimal A*0201 C-terminal anchor residue (FIG. 1*b*). Overall, 31.9% of the peptides with V at the C-terminus were A*0201 binders. I, L, S, C, M, T and A were also tolerated, with 7.1 to 28.6% of the peptides binding with an $IC_{50}$ of 500 nM, or better.

The correlation between peptide length (between 8 and 11 residues) and binding capacity was analyzed next. It was found that 27.6% of the 9-mer peptides bound with $IC_{50}$ of 500 nM, or less, in good agreement with previous estimates (Ruppert, J., et al., supra) (TABLE 49). ARB values are standardized to the peptide set of optimal size and shown for reference purposes.

Longer peptides were also capable of binding, although somewhat less well; 17.8% of 10-mer, and 14.5% of the 11-mer peptides had affinities of 500 nM or better. Finally, it was noted that 8-mer peptides bound A*0201 only rarely, with 3.5% of the peptides having binding capacities better than 500 nM.

The A*0201 peptide binding database was further analyzed to assess the stringency of most frequently (48.7%), and with higher average relative binding capacity than other peptides in the library (TABLE 50). Peptides with one preferred residue and one tolerated residue also bound relatively frequently, in the 17.6 to 28.4% range. Finally, peptides with at least one non-tolerated residue, or with tolerated residues at both main anchor positions, bound only rarely, if at all, with frequencies of binding in the 0-7.1% range. No significant difference was detected in terms of primary anchor preferences as a function of ligand size.

To identify secondary anchor effects, the A*0201 binding capacity of peptides in each size group was further analyzed by determining the ARB values for peptides that contain a particular amino acid residue in a specific, but size dependent, position. The resulting ARB values, by corresponding residue/position pairs, for 8-11-mer sequences are shown in TABLE 51, TABLE 52, TABLE 53, and TABLE 54. All of the peptides in TABLE 51, TABLE 52, TABLE 53, and TABLE 54 had at least 1 preferred and 1 tolerated residue at the main anchor positions. At secondary anchor positions values corresponding to a 3-fold or greater increase in binding capacity are indicated by increased and bolded font. Negative effects, associated with a three-fold decrease in binding affinity, are identified by underlined and italicized font. Also, residues determined to be preferred or tolerated anchors are indicated by bold font. ARB values at the anchor positions were derived from the analyses described in FIG. 5. To allow use of the values shown in this table as coefficients for predictive algorithms, the values for non-tolerated anchor residues have been set to 0.001, equivalent to a 1000-fold reduction in binding capacity, to filter out non-motif peptides.

In TABLE 51, TABLE 52, TABLE 53, and TABLE 54, the results of the analysis of a panel of 93 8-mer peptides, 1389 9-mer peptides, 953 10-mer peptides, and 95 11-mer peptides, respectively, are based on naturally occurring sequences from various viral, bacterial, or pathogen origin. ARB values shown were calculated, for example, as described in Sidney et al., *Human Immunology* 62: 1200 (2001) and Sidney et al., *J. Immunology* 157: 3480 (1996). For 9-mer and 10-mer peptides ARB values were derived for each residue considered individually. For studies of 8-mer and 11-mer peptides (TABLE 51 and TABLE 54, respectively,) ARB values were based on the grouping of chemically similar residues, as described in Ruppert et al., *Cell* 74: 929 (1993). The average geometric binding capacity of the 8-mer, 9-mer, 10-mer, and 11-mer panels was 14420 nM, 1581 nM, 3155 nM, and 3793 nM, respectively.

Summary maps are shown in FIGS. 6A-6D. In most positions, some secondary influence could be detected. The majority (55%) of the negative influences involved the presence of acidic (D and E) or basic (R, H, and K) residues. Proline (P) and large polar residues (Q, and N) were also frequently disruptive. While each particular size was associated with unique preferences, in most instances (79%) preferred residues were aromatic (F, W, or Y) or hydrophobic (L, I, V, or M). Most peptide lengths exhibited a preference for F, Y and M in position 3. Similarly, all peptide sizes shared a preference for aromatic or hydrophobic residues in the C-2 position.

Several distinct preference patterns were also observed for peptides of a given size. For example, 8-mer peptides did not have any preference in either position 1 or position 3 for the hydrophobic or aromatic residues preferred by 9-, 10-, and 11-mer peptides. 11-mer peptides were unique in the preference for G in multiple positions throughout the middle of the peptide.

Main Anchor Specificities of Other A2-Supertype Molecules

In the next set of analyses, the main anchor specificities of A*0202, A*0203, A*0206, and A*6802, four of the most prevalent A2-supertype alleles next to A*0201, was assessed. Peptides in the A2-supertype binding database often reflect selection using an A*0201-based bias, such as the selection of only A*0201 binding peptides, or the selection of peptides scoring high in A*0201 algorithms. As a result, in most cases, peptide binding data for non-A*0201 molecules is available for only peptides with supertype preferred and tolerated residues. Despite this limitation, a database of about 400 peptides was available for study. A database of sufficient size was not available to allow analysis of A*0205 and A*0207, although an analysis of the specificity of A*0207 has been published previously (Sidney, J., et. al., supra).

Analyses of the position 2 specificities are summarized in FIG. 3*a-d*. In general, V, T, A, I, and M were tolerated in the context of each molecule. Allele specific preferences were also noted. In the case of A*0202 Q was the most preferred residue. Other residues (L, I, V, A, T and M) were tolerated, and were roughly equivalent, with ARB in the 0.08-0.30 range. By contrast, A*0203 had a preference for L, M and Q. Residues V, A, I and T were associated with lower overall binding affinities. A third pattern was noted for A*0206, where Q, V, I, A, and T were all well tolerated with ARB values between 0.47 and 1.0, while L and M were less well tolerated. Finally, for A*6802 V and T were the optimal residues, with ARB >0.45. A was also preferred, but with a lower ARB (0.13). Significant decreases in binding were seen with I and M, which had ARB between 0.050 and 0.020. L and Q were not tolerated, with ARB <0.010.

At the C-terminus, I, V, L, A, M and T were tolerated by all A2-supertype molecules tested, with ARB >0.060 (FIGS. 4*a-d*). I and V were the two residues most preferred by each allele; V was the optimal residue for A*0203, A*0206, and A*6802. L was typically the next most preferred residue. T, A, and M were usually associated with lower ARB values.

In conclusion, the position 2 and C-terminal anchor residues preferred or tolerated by A*0201 were also well tolerated by other A2-supertype molecules. While each allele had a somewhat unique pattern of preferences at position 2, the patterns of preferences exhibited by each allele at the C-terminus were fairly similar.

Secondary Influences on Peptide Binding to A2-Supertype Molecules

The same library of peptide ligands was analyzed to determine the ligand size preferences of A*0202, A*0203, A*0206, and A*6802. Fore each allele, ARB values are standardized to the peptide set of optimal size. We found that for each molecule 9-11 mer peptides were well tolerated, with ARB >0.36 (TABLE 55, TABLE 56, TABLE 57, and TABLE 58). For A*0203, A*0206, and A*6802, 9-mer peptides were optimal, but 10-mers were optimal in the case of A*0202. For all alleles, 8-mer peptides were much less well tolerated, with ARB in each case <0.11.3

The influence of secondary anchor residues on the capacity of peptides to bind A*0202, A*0203, A*0206, and A*6802 was examined next. The number of peptides available only allowed analysis of 9- and 10-mer ligands. The ARB values for 9-mer and 10-mer peptides as a function of the presence of a particular residue in a specific position are shown in TABLES 59-66, and summary maps in FIG. 9, FIG. 10, FIG. 11, and FIG. 12. As noted above, positive and negative effects are defined as associated with three-fold or greater increases or decreases in binding affinity, respectively.

In TABLE 59 and TABLE 60, a panel of 268 9-mer peptides and a panel of 120 10-mer peptides, respectively, were tested for binding to the A*0202 allele. In TABLE 61 and TABLE 62, a panel of 272 9-mer peptides and a panel of 122 10-mer peptides, respectively, were tested for binding to the A*0203 allele. In TABLE 63 and TABLE 64, a panel of 268 9-mer peptides and a panel of 120 10-mer peptides, respectively, were tested for binding to the A*0206 allele. In TABLE 65 and TABLE 66, a panel of 268 9-mer peptides and a panel of 120 10-mer peptides, respectively, were tested for binding to the A*6802 allele. All peptides were based on naturally occurring sequences from various viral, bacterial, or pathogen origin and had at least 1 preferred and 1 tolerated residue at the main anchor positions. ARB values are based on the grouping of chemically similar residues, generally as described in Ruppert et al., *Cell* 74: 929 (1993), for example. At secondary anchor positions values corresponding to a 3-fold or greater increase in binding capacity are indicated by bolded and increased font. Negative effects, associated with a three-fold decrease in binding affinity, are indicated by underlined and italicized font. Also, residues determined to be preferred or tolerated anchors are indicated by bold font. To allow use of the values shown in this table as coefficients for predictive algorithms, the values for non-tolerated anchor residues were set to 0.001, equivalent to a 1000-fold reduction in binding capacity, to filter out non-motif peptides. The average geometric binding capacity of each panel in TABLE 59, TABLE 60, TABLE 61, TABLE 62, TABLE 63, TABLE 64, TABLE 65, and TABLE 66 was 401 nM, 342 nM, 85 nM, 95 nM, 387 nM, 643 nM, 838 nM, and 1055 nM, respectively.

In general, deleterious effects were frequently (35%) associated with charged residues (D, E, R, H, or K). An additional 35% of the deleterious influences could be attributed to G or P. Positive influences were relatively evenly attributed to basic (R, H, K), acid (D, E), hydrophobic (F, W, Y, L, I, V, M) or small (A, P) residues.

While each molecule had a distinctive pattern of preferences and aversions, some common trends could be noted in the case of 10-mer peptides. For example, for all molecules Q and N were preferred in position 1, and R, H, and K were preferred in position 8. D, E, and G were uniformly deleterious for 10-mer peptides in position 3. Consensus preferences or aversions were not noted for 9-mer peptides.

In summary, the data in this section describe detailed motifs for 9- and 10-mer peptides binding to A*0202, A*0203, A*0206, and A*6802. Each motif is characterized by specific features associated with good, or poor, binding peptides.

A Consensus A2-Supermotif

How well A*0201 binders also bound to other A2-supertype molecules was assessed next. It was found that peptides that bound A*0201 with good affinity ($IC_{50}$<500 nM) frequently bound other A2-supertype molecules (TABLE 67). Between 36.1 and 73.6% of A*0201 binding peptides bound other A2-supertype molecules. Analysis of A2-supertype degeneracy as a function of A*0201 affinity also yielded interesting results. The motifs described above for A2 supertype molecules are very similar and largely overlapping. In this respect, a consensus motif can be identified that incorporates features commonly shared by the molecule-specific motifs (FIG. 9). The consensus motif specifies the presence of hydrophobic and aliphatic residues in position 2 of peptide ligands. At this position, V, L and M are preferred, while T, Q, A, and I are all tolerated. On the basis of the preference rank of each residue in the context of each A2-supertype molecule, V is the most preferred residue. At the C-terminus the consensus motif specifies the presence of hydrophobic and aliphatic residues L, I, V, M, A, and T. V is most frequently the optimal residue, while L and I are also considered preferred, typically being the next most optimal residues. M, A, and T are considered as tolerated residues.

The secondary anchor maps for A*0201, A*0202, A*0203, A*0206, and A*6802 were utilized to derive a supertype consensus secondary anchor motif for 9- and 10-mer peptides (FIG. 9). Residues considered as preferred for 3 or more A2-supertype molecules, without being deleterious for any molecule, were considered as preferred for the supertype consensus motif. Conversely, residues identified as deleterious for 3 or more molecules were designated as deleterious in the consensus motif. The consensus motif overlaps significantly with the detailed A*0201 motif, and includes a preference for aromatic residues in position 1 and/or 3, and a shared aversion for charged residues in position 3.

Correlation Between a*0201 Binding Affinity and A2-Supertype Cross-Reactivity

Because of the dominance in four major ethnicities of A*0201 compared with other A2 supertype alleles (see, e.g., TABLE 38), it was of interest to determine how well A*0201 binders also bound to other A2-supertype molecules. It was found that peptides that bound A*0201 with good affinity ($IC_{50}$<500 nM) frequently bound other A2-supertype molecules (TABLE 67). Between 36.1 and 73.6% of A*0201 binding peptides bound other A2-supertype molecules. Analysis of A2-supertype degeneracy as a function of A*0201 affinity also yielded interesting results. 72.8% of the peptides that bound A*0201 with $IC_{50}$<500 nM bound 3 or more A2-supertype molecules (TABLE 68). As a general rule, the higher the binding affinity of a peptide for A*0201, the higher the likelihood that the peptide would also bind 3 or more supertype molecules. Over 96% of the peptides that bound A*0201 with affinities of 20 nM or better also bound 3 or more A2-supertype molecules. By contrast, A2-supermotif peptides that did not bind A*0201 with affinities better than 500 nM only rarely (10%) bound 3 or more A2 supermotif molecules, and never bound 4 or more molecules.

In summary, this analysis of the cross-reactive binding of peptides to A*0201 and other A2-supertype molecules confirms the fact that this family of HLA molecules recognizes similar structural features in their peptide ligands. It has also been shown that A*0201 binding affinity correlates with the propensity to bind multiple A2-supertype alleles.

Analysis.

The results of this analysis allow for the detailed definition of the properties of peptides that bind to HLA-A*0201 and other A2-supertype molecules. The A2-supertype molecules share not only largely overlapping peptide binding specificity, but also significantly overlapping peptide binding repertoires. Specific features of peptide ligands associated with degenerate A2-supertype binding capacity were identified which provide a logical explanation for the supertype relationship.

In a previous study the peptide binding specificity of A*0201 was analyzed, and a detailed motif, including the identification of secondary anchor features, was constructed. In the present analyses, performed with a 10-fold larger database, we confirmed that data and extended the analysis to include 8- and 11-mer peptides. Overall, the specificity of A*0201 for 8- and 11-mer peptides was largely similar to that for 9- and 10-mer peptides. For example, regardless of peptide size, the majority of negative influences on binding capacity were associated with the presence of charged residues in secondary anchor positions, while the majority of positive influences were associated with the presence of hydrophobic residues. The definition of detailed motifs for 8- and 11-mer peptides should allow for a more complete identification of epitopes. Identification of A*0201 binders has been greatly facilitated by the use of the algorithms based on ARB values. In the present analyses a substantially larger database was used than previously available, allowing for a refinement of algorithm coefficients. Because the newer coefficients are based on a significantly larger data set, they are statistically more accurate and should afford more efficient and precise prediction of epitopes. Indeed, recent analysis has shown that a revised A*0201 9-mer polynomial algorithm based on a larger data set is more accurate than both an older algorithm based on a small data set, and neural network prediction methodologies. In addition to increasing the accuracy of epitope prediction (Ruppert, J., et al., supra; Sidney, J., et al., supra; Kondo, A., et al., supra; Gulukota, K., et al., supra; Parker, K. C., et al., "Sequence Motifs Important for Peptide Binding to the Human MHC Class I Molecule, HLA-A2," *J. Immunol.* 149:3580-3587 (1992) and Milik, M., et al., "Application of an Artificial Neural Network to Predict Specific Class I MHC Binding Peptide Sequences," *Nature* (*Biotech*) 16:753-756 (1998)), detailed peptide binding motifs defining both primary and secondary anchor positions allow for the rational design of optimized ligands. For example, natural sequences carrying sub-optimal residues at primary and/or secondary positions can be identified. The sub-optimal residues may be replaced with optimal anchors, generating epitopes with increased binding affinity (Sidney, J., et al., supra; Pogue, R. R., et al., "Amino-Terminal Alteration of the HLA-A*0201-Restricted Human Immunodeficiency Virus Pol Peptide Increases Complex Stability and in Vitro Immunogenicity," *Proc. Nat'l. Acad. Sci., USA,* 92:8166-8170 (1995) and Bakker, A. B., et al., "Analogues of CTL epitopes With Improved MHC Class-I Binding Capacity Elicit Anti-Melanoma CTL Recognizing the Wide-Type Epitope," *Int. J. Cancer,* 70:302-309 (1997)). Following this type of modification, wild type peptides that were unable to elicit responses, or were poor immunogens, may become highly immunogenic Pogue, R. R., et al., supra; Bakker, A. B., et al., supra; Parkhurst, M. R., "Improved Induction of Melanoma-Reactive CTL With Peptides From the Melanoma Antigen gp100 Modified at HLA-A*0201-Binding Peptides," *J. Immunol.* 157:2539-2548 (1996); Rosenberg, S. A., et al., "Immunologic and Therapeutic Evaluation of a Synthetic Peptide Vaccine for the Treatment of Patients With Metastatic Melanoma," *Nature* (Med) 4:321-327 (1998); Sarobe, P., et al., "Enhanced in vitro Potency and in vivo Immunogenicity of a CTL Epitope From Hepatitis C Virus Core Protein Following Amino Acid Replacement at Secondary HLA-A2.1 binding positions," *J. Clin. Invest.* 102:1239-1248 (1998) and Ahlers, J. D., et al., "Enhanced Immunogenicity of HIV-1 Vaccine Construct by Modification of the Native Peptide Sequence," *Proc. Nat'l Acad. Sci*., USA, 94:10856-10861 (1997)). The CTL induced by such analog peptides have been shown to be capable, in most instances, of recognizing target cells expressing wild type antigen sequences. This phenomenon is likely to reflect less stringent epitope binding requirements for target cell recognition compared to that needed for stimulation of naïve T-cells to induce differentiation into effectors (Cho, B. K., et al., "Functional Differences Between Memory and Naive CD8 T Cells," *Proc. Nat'l. Acad. Sci.* USA 96:2976-2981 (1999); Sykulev, Y., et al., "Evidence That A Single Peptide—MHC Complex On A Target Cell Can Elicit Acytolytic T Cell Response," *Immunity* 4:565-571 (1996)). Thus, the detailed motifs described herein will facilitate not only in the identification of naturally occurring CTL epitopes, but also in the design of engineered epitopes with increased binding capacity and/or immunogenic characteristics.

The peptide binding specificity for other A2-supertype molecules was also investigated using single substitution analog peptides and peptide libraries. In agreement with previous reports (del Guercio, M-F, et al., "Binding of a Peptide Antigen to Multiple HLA Alleles Allows Definition of an A2-Like Supertype," *J. Immunol.* 154:685-693 (1995) and (Sidney, J., et al., "Practical, Biochemical and Evolutionary Implications of the Discovery of HLA Class I Supermotifs," *Immunol Today* 17:261-266 (1996)); see also reports filed for NIH-NIAID contract NO1-AI-45241), we found that the primary anchor motifs of A2-supertype molecules were remarkably similar. The use of peptide libraries allowed detailed characterization of the secondary anchor preferences and aversions of each molecule. It was shown that, while each A2-supertype molecule had a unique specificity, a supermotif based on consensus patterns could be identified. Because the supermotif describes features of peptide ligands that are shared amongst A2-supertype molecules, it is expected to allow the efficient identification of highly cross-reactive peptides, and indicate appropriate strategies for anchor fixing, allowing modulation of the supertype degeneracy of peptide ligands. A further result of the present analysis was the derivation of coefficients that could be utilized in algorithms for predicting peptide binding to A*0202, A*0203, A*0206, and A*6802.

As HLA A*0201 is by far the most prevalent A2-supertype allele, both in the general population and within major ethnic groups, the peptide screening strategy that was utilized focused first on the identification of A*0201 binders. It was determined that over 70% of the peptides that bind to A*0201 also bind to at least 2 additional A2-supertype molecules, and that the propensity to bind other A2-supertype alleles correlated with A*0201 binding affinity.

In conclusion, the data described herein provide formal demonstration of the shared peptide binding specificity of a group of HLA-A molecules designated as the A2-supertype. Not only do these molecules recognize similar features at primary and secondary anchor positions of their peptide ligands, they also share largely overlapping peptide binding repertoires. The demonstration that these molecules share largely overlapping repertoires has a significant implication for the design of potential vaccine constructs. Indeed, the concept that A2-supertype cross-reactivity at the peptide binding level may be of immunological relevance has been demonstrated in a number of studies, in both infectious disease (Khanna R., et al., "Identification of Cytotoxic T-Cell Epitopes Within Epstein-Barr Virus (EBV) Oncogene Latent Membrane Protein 1 (LMP1): Evidence for HLA A2 Supertype-Restricted Immune Recognition of EBV-Infected Cells by LMP1-Specific Cytotoxic T lymphocytes," *Eur J Immunol,* 28:451-458 (1998); Bertoletti, A., et al., "Molecular Features of the Hepatitis B Virus Nucleocapsid T-Cell Epitope 18-27: Interaction With HLA An T-Cell Receptor," *Hepatology* 26:1027-1034 (1997); Livingston, B. D., et al., "Immunization With the HBV Core 18-27 Epitope Elicits CTL Responses in Humans Expressing Different HLA-A2 Supertype Molecules," *Hum Immunol* 60:1013-1017, (1999); Bertoni, R., et al., "Human Histocompatibility Leukocyte Antigen-Binding Supermotifs Predict Broadly Cross-Reactive Cytotoxic T Lymphocyte Responses in Patients With Acute Hepatitis," *J Clin Invest* 100:503-513 (1997); and Doolan, D. L., et al., "Degenerate Cytotoxic T-Cell Epitopes from *P. falciparum* Restricted by Multiple HLA-A and HLA-B Supertype Alleles," *Immunity* 7:97-112 (1997)) and cancer (Fleischhauer, K., et al., "Multiple HLA-A Alleles Can Present an Immunodominant Peptide of the Human Melanoma Antigen Melan-A/MART-1 To A Peptide-Specific HLA-A*0201+Cytotoxic Cell Line," *J Immunol,* 157: 787-797 (1996); Rivoltini, L., et al., "Binding and Presentation of Peptides Derived From Melanoma Antigens MART-1 and Glycoprotein-100 by HLA-A2 Subtypes: Implications for Peptide-Based Immunotherapy," *J Immunol* 156:3882-3891 (1996); Kawashima, I., "The Multi-Epitope Approach for Immunotherapy for Cancer: Identification of Several CTL Epitopes from Various Tumor-Associated Antigens Expressed on Solid Epithelial Tumors," *Hum Immunol* 59:1-14 (1998)) settings.

Example 9

Peptide Composition for Prophylactic Uses

Vaccine compositions of the present invention are used to prevent infection or treat cancer in persons. For example, a polyepitopic peptide epitope composition containing multiple CTL and HTL epitopes is administered to individuals at risk for HCV infection. The composition is provided as a single lipidated polypeptide that encompasses multiple epitopes. The vaccine is administered in an aqueous carrier comprised of Freund's Incomplete Adjuvant. The dose of peptide for the initial immunization is from about 1 to about 50,000 μg for a 70 kg patient administered in a human dose volume. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against HCV infection.

Alternatively, the polyepitopic peptide composition can be administered as a nucleic acid in accordance with methodologies known in the art and disclosed herein.

Example 10

Definition of an A3.2 Specific Motif

There is some ambiguity in the international nomenclature of A3 alleles. The A3.2 allele herein is expressed by cell lines EHM, HO301, and GM3107. This particular subtype is currently referred to as the 3.2 allele (Yang, in *Immunobiology of HLA*, Vol. 1, Dupont ed., Springer-Verlag, New York pp. 43-44 and 54-55, 1989), or the product of the A*0301 gene (its sequence corresponds to the one published by Strachan, et al., *EMBO J.,* 3:887 (1984), and has been verified by direct cloning and sequencing of the A3 gene found in EHM cell line. The HLA-A3.2 encoded by the A*0301 gene referred to in this document is the commonly expressed HLA-A3 allelic form.

In one case using MAT cells, pooled peptide fractions prepared as described in Example 3 above were obtained from HLA-A3.2 homozygous cell lines, for example, CM3107. The pooled fractions were HPLC fractions corresponding to 7% to 19% $CH_3CN$. For this class I molecule, this region of the chromatogram was most abundant in peptides. Data from independent experiments were averaged as described below.

The amino acid sequence analyses from four independent experiments were analyzed and the results are shown in TABLE 73. For each position except the first, the data were analyzed by modifying the method described by Falk et al. to allow for comparison of experiments from different HLA types. This modified procedure yielded quantitative yet standardized values while allowing the averaging of data from different experiments involving the same HLA type.

The raw sequenator data was converted to a simple matrix of 10 rows (each representing one Edman degradation cycle) and 16 columns (each representing one of the twenty amino acids; W, C, R and H were eliminated for technical reasons. The data corresponding to the first row (first cycle) was not considered further because, this cycle is usually heavily contaminated by free amino acids.). The values of each row were summed to yield a total pmoles value for that particular cycle. For each row, values for each amino acid were then divided by the corresponding total yield value, to determine what fraction of the total signal is attributable to each amino acid at each cycle. By doing so, an "Absolute Frequency" table was generated. This absolute frequency table allows correction for the declining yields of each cycle.

The retentate contains the bulk of the HLA-A heavy chain and β2-microglobulin, while the filtrate contains the naturally processed bound peptides and other components with molecular weights less than about 3000. The pooled filtrate material was lyophilized in order to concentrate the peptide fraction. The sample was then ready for further analysis.

For HPLC (high performance liquid chromatography) separation of the peptide fractions, the lyophilized sample was dissolved in 50 μl of distilled water, or into 0.1% trifluoracetic acid (TFA) (Applied Biosystems) in water and injected into a C18 reverse-phase narrow bore column (Beckman C18 Ultrasphere, 10×250 mm), using a gradient system described by Stone and Williams (Stone, K. L. and Williams K. R., in, Macromolecular Sequencing and Synthesis; Selected Methods and Applications, A. R. Liss, New York, 1988, pp. 7-24). Buffer A was 0.06% TFA in water (Burdick-Jackson) and buffer B was 0.052% TFA in 80% acetonitrile (Burdick-Jackson). The flow rate was 0.250 ml/minute with the following gradient: 0-60 min., 2-37.5% B; 60-95 min., 37.5-75% B; 95-105 min., 75-98% B. The Gilson narrow bore HPLC configuration is particularly useful for this purpose, although other configurations work equally well.

Figure 16:
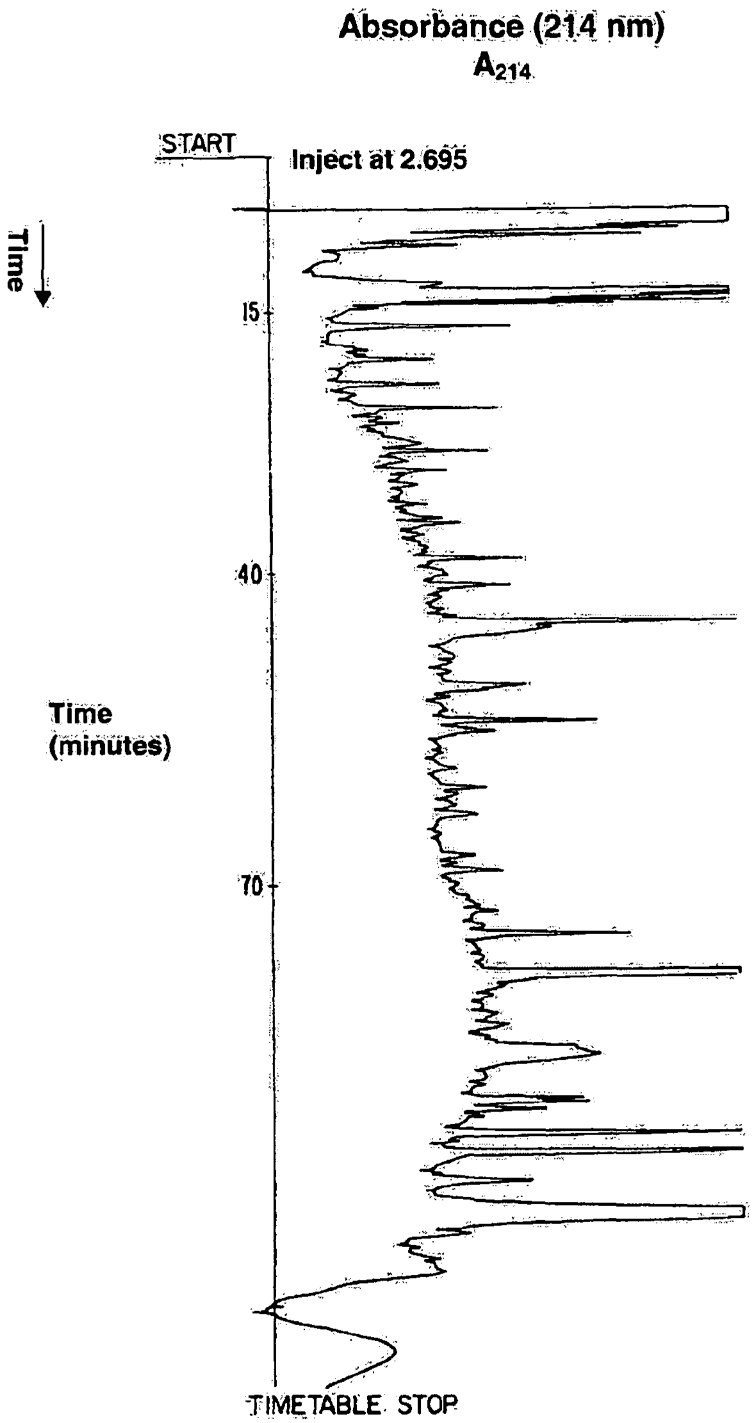
FIG. 16 shows reverse phase high performance liquid chromatography (RP-HPLC) separation of HLA-A3 acid eluted 20 peptides.

A large number of peaks were detected by absorbance at 214 nm, many of which appear to be of low abundance (FIG. 16). Whether a given peak represents a single peptide or a peptide mixture was not determined. Pooled fractions were then sequenced to determine motifs specific for each allele as described below.

Pooled peptide fractions, prepared as described above were analyzed by automated Edman sequencing using the Applied Biosystems Model 477A automated sequencer. The sequencing method is based on the technique developed by Pehr Edman in the 1950s for the sequential degradation of proteins and peptides to determine the sequence of the constituent amino acids.

The protein or peptide to be sequenced was held by a 12-mm diameter porous glass fiber filter disk in a heated, argon-purged reaction chamber. The filter was generally pretreated with BioBrene Plus™ and then cycled through one or more repetitions of the Edman reaction to reduce contaminants and improve the efficiency of subsequent sample sequencing. Following the pretreatment of the filter, a solution of the sample protein or peptide (10 pmol-5 nmol range) was loaded onto the glass filter and dried. Thus, the sample was left embedded in the film of the pretreated disk. Covalent attachment of the sample to the filter was usually not necessary because the Edman chemistry utilized relatively apolar solvents, in which proteins and peptides are poorly soluble.

Starting from the absolute frequency table, a "relative frequency" table was then generated to allow comparisons among different amino acids. To do so the data from each column was summed, and then averaged. Then, each value was divided next by the average column value to obtain relative frequency values. These values quantitate, in a standardized manner, increases and decreases per cycle, for each of the different sixteen amino acid types. Tables generated from data from different experiments can thus be added together to generate average relative frequency values (and their standard deviations). All standard deviations can then be averaged, to estimate a standard deviation value applicable to the samples from each table. Any particular value exceeding 1.00 by more than two standard deviations is considered to correspond to a significant increase.

The results of the foregoing analysis for HLA-A3.2 were as follows: at position 2, a 2.2-fold increase in valine (V) with lesser increases (1.5-1-7) for structurally similar residues leucine (L) and methionine. My. At position 3, tyrosine (Y) and aspartic acid (0) showed increases in frequency. At position 7 isoleucine (I) was increased, and at position 8 asparagine (N), and glutamine (Q) were increased. At positions 9 and 10, lysine (K) was increased more than 2-fold over the expected random yield.

Cysteine was not modified and thus not detected tryptophan coeluted with diphenylurea, and in some experiments, PTH-arginine coeluted with the major derivative of PTH-threonine. Therefore, cysteine and tryptophan are not detectable and arginine is detected only in the absence of threonine.

Previously described MHC structures showed instances of critically conserved residues at position 2 (or 3) and at the C terminus (either position 9 or 10}. These residues are referred to as "conserved" residues. The modified data analysis of this invention considered the conserved positions at the N and C terminals.

Thus, the HLA-A3.2 motif should have position two occupied by V, L or M, a length of 9 or 10 amino acids, and C-terminal position occupied by K.

Example 11

Definition of an A2.1. Specific Motif

In one case, pooled peptide fractions prepared as described in Examples above were obtained from HLA-A2.1 homozygous cell lines, for example, JY. The pooled fractions were HPLC fractions corresponding to 7% to 45% $CH_3CN$. For this class I molecule, this region of the chromatogram was most abundant in peptides. Data from independent experiments were averaged as described below.

The amino acid sequence analyses from four independent experiments were analyzed and the results are shown in TABLE 148 and TABLE 149. For each position except the first, the data were analyzed by modifying the method described by Falk et al., supra, to allow for comparison of experiments from different HLA types. This modified procedure yielded quantitative yet standardized values while allowing the averaging of data from different experiments involving the same HLA type.

The raw sequenator data was converted to a simple matrix of 10 rows (each representing one Edman degradation cycle) and 16 columns (each representing one of the twenty amino acids; W, C, R and H were eliminated for technical reasons. The data corresponding to the first row (first cycle) was not considered further because, this cycle is usually heavily contaminated by free amino acids.). The values of each row were summed to yield a total pmoles value for that particular cycle. For each row, values for each amino acid were then divided by the corresponding total yield value, to determine what fraction of the total signal is attributable to each amino acid at each cycle. By doing so, an "Absolute Frequency" table was generated. This absolute frequency table allows correction for the declining yields of each cycle.

Starting from the absolute frequency table, a "relative frequency" table was then generated to allow comparisons among different amino acids. To do so the data from each column was summed, and then averaged. Then, each value was divided next by the average column value to obtain relative frequency values. These values quantitate, in a standardized manner, increases and decreases per cycle, for each of the different sixteen amino acid types. Tables generated from data from different experiments can thus be added together to generate average relative frequency values (and their standard deviations). All standard deviations can then be averaged, to estimate a standard deviation value applicable to the samples from each table. Any particular value exceeding 1.00 by more than two standard deviations is considered to correspond to a significant increase.

Example 12

HLA-A2.1. Binding Motif and Algorithm

The structural requirements for peptide binding to A2.1 have been defined for both, 9-mer and 10-mer peptides. Two approaches have been used. The first approach referred to as the "poly-A approach" uses a panel of single amino acid substitutions of a 9-mer prototype poly-A binder (ALAKAAAAV (SEQ ID NO:3786)) that is tested for A2.1 binding using the methods of Example 4 above to examine the degree of degeneracy of the anchor-positions and the possible influence of non-anchor positions on A2.1 binding.

The second approach, the "Motif-Library approach", uses a large library of peptides selected from sequences of potential target molecules of viral and tumor origin and tested for A2.1 binding using the methods in Example 4 above. The frequencies by which different amino-acids occurred at each position in good binders and non-binders were analysed to further define the role of non-anchor positions in 9-mers and 10-mers.

A2.1 Binding of Peptide 9-Mers

Poly a Approach.

A poly-A 9-mer peptide, containing the A2.1 motif L (Leu) in position 2 and V (Val) in position 9 was chosen as a prototype binder. A K (Lys) residue was included in position 4 to increase solubility. A panel of 91 single amino-acid substitution analogues of the prototype parental 9-mer was synthesized and tested for A2.1 binding (TABLES 150 and 151). Shaded areas mark analogs with a greater than 10-fold reduction in binding capacity relative to the parental peptide. A reduction in binding greater than 100-fold is indicated by hyphenation.

Anchor-Positions 2 and 9 in Poly-A Analogs.

The effect of single-amino-acid substitutions at the anchor positions 2 and 9 was examined first. Most substitutions in these positions had profound detrimental effects on binding capacity, thus confirming their role for binding. More specifically, in position 2 only L and M bound within a 10-fold range ("preferred residues"). Residues with similar characteristics, such as I, V, A, and T were tolerated, but bound 10 to 100-fold less strongly than the parental peptide. All the remaining substitutions (residues S, N, D, F, C, K, G, and P) were not tolerated and decreased binding by more than 100-fold. Comparably stringent requirements were observed for position 9, where V, L and I were preferred and A and M are tolerated, while the residues T, C, N, F, and Y virtually abolished binding. According to this set of peptides, an optimal 2-9 motif could be defined with L, M in position 2 and V, I, or L in position 9.

Non-Anchor Positions 1 and 3-8 in Poly-A Analogs

All non-anchor positions were more permissive to different substitutions than the anchor-positions 2 and 9, i.e most residues were tolerated. Significant decreases in binding were observed for some substitutions in distinct positions. More specifically, in position 1 a negative charge (residues D and E) or a P greatly reduced the binding capacity. Most substitutions were tolerated in position 3 with the exception of the residue K. Significant decreases were also seen in position 6 upon introduction of either a negative charge (D, E) or a positively charged residue (R). A summary of these effects by different single amino acid substitutions is given in TABLES 152 and 153.

The Motif-Library Approach.

To further evaluate the importance of non-anchor positions for binding, peptides of potential target molecules of viral and tumor origin were scanned for the presence of sequences containing optimal 2-9 anchor motifs. A set of 161 peptides containing a L or M in position 2 and a V, L or I in position 9 was selected, synthesized and tested for binding (see Example 6). Only 11.8% of these peptides bind with high affinity (ratio ≥0.10; 22.4% were intermediate binders (ratio ≥0.1). As many as 36% were weak binders (ratio <0.01-0.0001), and 31% were non-binders (ratio <0.0001). The high number of non-binders containing optimal anchor-motifs indicates that in this set of peptides positions other than the 2-9 anchors influence A2.1 binding capacity. Appendix 1 sets forth all of the peptides having the 2-9 motif used for this analysis and the binding data for those peptides.

To define the influence on non-anchor positions more specifically, the frequency of occurrence of each amino acid in each of the non-anchor positions was calculated for the good and intermediate binders on one hand and non-binders on the other hand. Amino acids of similar chemical characteristic were grouped together. Weak binders were not considered for the following analysis. The frequency of occurrence of each amino acid in each of the non-anchor positions was calculated for the good binders and non-binders (TABLE 154).

Several striking trends become apparent. For example in position 1, only 3.6% of the A2.1 binders and as much as 35% of the non-binders carried a negative charge (residues D and E). This observation correlates well with previous findings in the set of poly-A analogs, where a D or E substitution greatly affected binding. Similarly, the residue P was 8 times more frequent in non-binders than in good binders. Conversely, the frequencies of aromatic residues (Y, F, W) were greatly increased in A2.1 binders as compared to non-binders.

Following this approach, amino acids of similar structural characteristics were grouped together. Then, the frequency of each amino acid group in each position was calculated for binders versus non-binders (TABLE 155). Finally, the frequency in the binders group was divided by the frequency in the non-binders to obtain a "frequency ratio". This ratio indicates whether a given amino-acid or group of residues occurs in a given position preferentially in good binders (ratio >1) or in non-binders (ratio <1).

Different Residues Influence A2.1 Binding.

In order to analyse the most striking influences of certain residues on A2.1 binding, a threshold level was set for the ratios described in TABLE 155. Residues showing a more than 4-fold greater frequency in good binders were regarded as preferred residues (+). Residues showing a 4-fold lower frequency in A2.1 binders than in non-binders were regarded as disfavored residues (−). Following this approach, residues showing the most prominent positive or negative effects on binding are listed in TABLE 156.

This table identifies the amino acid groups which influence binding most significantly in each of the non-anchor positions. In general, the most negative effects were observed with charged amino acids. In position 1, negatively, charged amino acids were not observed in good binders, i.e., those amino acids were negative binding residues at position 1. The opposite was true for position 6 where only basic amino acids were detrimental for binding i.e., were negative binding residues. Moreover, both acidic and basic amino acids were not observed in A2.1 binders in positions 3 and 7. A greater than 4-fold increased frequency of non-binders was found when P was in position 1.

Aromatic residues were in general favored in several of the non-anchor positions, particularly in positions 1, 3, and 5. Small residues like S, T, and C were favored in position 4 and A was favored in position 7.

An Improved A2.1 9-Mer Motif.

The data described above was used to derive a stringent A2.1 motif. This motif is based in significant part on the effects of the non-anchor positions 1 and 3-8. The uneven distribution of amino acids at different positions is reflective of specific dominant negative binding effects of certain residues, mainly charged ones, on binding affinity. A series of rules were derived to identify appropriate anchor residues in positions 2 and 9 and negative binding residues at positions 1 and 3-8 to enable selection of a high affinity binding immunogenic peptide. These rules are summarized in TABLE 157.

To validate the motif defined above and shown in TABLE 157 published sequences of peptides that have been naturally processed and presented by A2.1 molecules were analysed (TABLE 158). Only 9-mer peptides containing the 2-9 anchor residues were considered.

When the frequencies of these peptides were analysed, it was found that in general they followed the rules summarized in TABLE 157. More specifically, neither acidic amino acids nor P were found in position 1. Only one acidic amino acid and no basic amino acids were found in position 3. Positions 6 and 7 showed no charged residues. Acidic amino acids, however, were frequently found in position 8, where they are tolerated, according to our definition of the A2.1 motif. The analysis of the sequences of naturally processed peptides therefore reveals that >90% of the peptides followed the defined rules for a complete motif.

Thus the data confirms a role of positions other than the anchor positions 2 and 9 for A2.1 binding. Most of the deleterious effects on binding are induced by charged amino acids in non-anchor positions, i.e. negative binding residues occupying positions 1, 3, 6 or 7.

A2.1 Binding of Peptide 10-Mers

The "Motif-Library" Approach. Previous data clearly indicated that 10-mers can also bind to HLA molecules even if with a somewhat lower affinity than 9-mers. For this reason we expanded our analysis to 10-mer peptides.

Therefore, a "Motif-Library" set of 170 peptide 10-mers containing optimal motif-combinations was selected from known target molecule sequences of viral and tumor origin and analysed as described above for 9-mers. In this set we found 5.9% good binders, 17.1% intermediate binders, 41.2% weak binders and 35.9% non-binders. The actual sequences, origin and binding capacities of this set of peptides are included as TABLE 182. This set of 10-mers was used to determine a) the rules for 10-mer peptide binding to A2.1, b) the similarities or differences to rules defined for 9-mers, and c) if an insertion point can be identified that would allow for a superimposable common motif for 9-mers and 10-mers.

Amino-acid frequencies and frequency ratios for the various amino-acid groups for each position were generated for 10-mer peptides as described above for 9-mer peptides and are also shown in TABLE 159 and TABLE 160, respectively for grouped residues.

A summary of preferred versus disfavored residues and of the rules derived for the 10-mers in a manner analogous to that used for 9-mers, is also listed in TABLE 161 and TABLE 162, respectively.

When the frequency-ratios of different amino-acid groups in binders and non-binders at different positions were analysed and compared to the corresponding ratios for the 9-mers, both striking similarities and significant differences emerged (TABLES 163 and 164). At the N-terminus and the C-termini of 9-mers and 10-mers, similarities predominate. In position 1 for example, in 10-mers again the P residue and acidic amino acids were not tolerated. In addition at position 1 in 10-mers aromatic residues were frequently observed in A2.1 binders. In position 3, acidic amino acids were frequently associated with poor binding capacity in both 9-mers and 10-mers. Interestingly, however, while in position 3 aromatic residues were preferred in 9-mers, aliphatic residues (L, V, I, M) were preferred in 10-mers.

At the C-terminus of the peptides, basic amino acids are not favored in position 7, and both acidic and basic amino acids are not favored in position 8 for 10-mers. This is in striking agreement with the observation that the same pattern was found in 9-mers at positions 6 and 7. Interestingly, again the favored residues differ between two peptides sizes. Aromatic (Y, F, W) or aliphatic (L, V, I, M) residues were preferred in 10-mers at position 8, while the A residue was preferred by 9-mers in the corresponding position 7.

By contrast, in the center of the peptide no similarities of frequency preferences were observed at positions 4, 5, and 6 in 10-mers and positions 4 and 5 in the 9-mers.

Most interestingly, among the residues most favored in the center of the tested peptides were G in position 4 and 6, P in position 5 was not observed in binders. All of these residues are known to dramatically influence the overall secondary structure of peptides, and in particular would be predicted to strongly influence the propensity of a 10-mer to adopt a "kinked" or "bulged" conformation.

Charged residues are predominantly deleterious for binding and are frequently observed in non-binders of 9-mers and 10-mers.

However, favored residues are different for 9-mers and 10-mers. Glycine is favored while Proline is disfavored in the center of 10-mer peptides but this is not the case for 9-mers.

These data establish the existence of an "insertion area" spanning two positions (4, 5) in 9-mers and 3 positions (4, 5, 6) in 10-mers. This insertion area is a more permissive region where few residue similarities are observed between the 9-mer and 10-mer antigenic peptides. Furthermore, in addition to the highly conserved anchor positions 2 and 9, there are "anchor areas" for unfavored residues in positions 1 and 3 at the N-terminus for both 9-mer and 10-mer and positions 7-10 or 6-9 at the C-terminus for 10-mers and 9-mers, respectively.

Example 13

Algorithm to Predict Binding of 9-Mer Peptides to HLA-A2.1

Within the population of potential A2.1 binding peptides identified by the 2,9 motif, as shown in the previous example, only a few peptides are actually good or intermediate binders and thus potentially immunogenic. It is apparent from the data previously described that the residues present in positions other than 2 and 9 can influence, often profoundly, the binding affinity of a peptide. For example, acidic residues at position 1 for A2.1 peptides do not appear to be tolerated. Therefore, a more exact predictor of binding could be generated by taking into account the effects of different residues at each position of a peptide sequence, in addition to positions 2 and 9.

More specifically, we have utilized the data bank obtained during the screening of our collection of A2.1 motif containing 9-mer peptides to develop an algorithm which assigns a score for each amino acid, at each position along a peptide. The score for each residue is taken as the ratio of the frequency of that residue in good and intermediate binders to the frequency of occurrence of that residue in non-binders.

Figure 45:
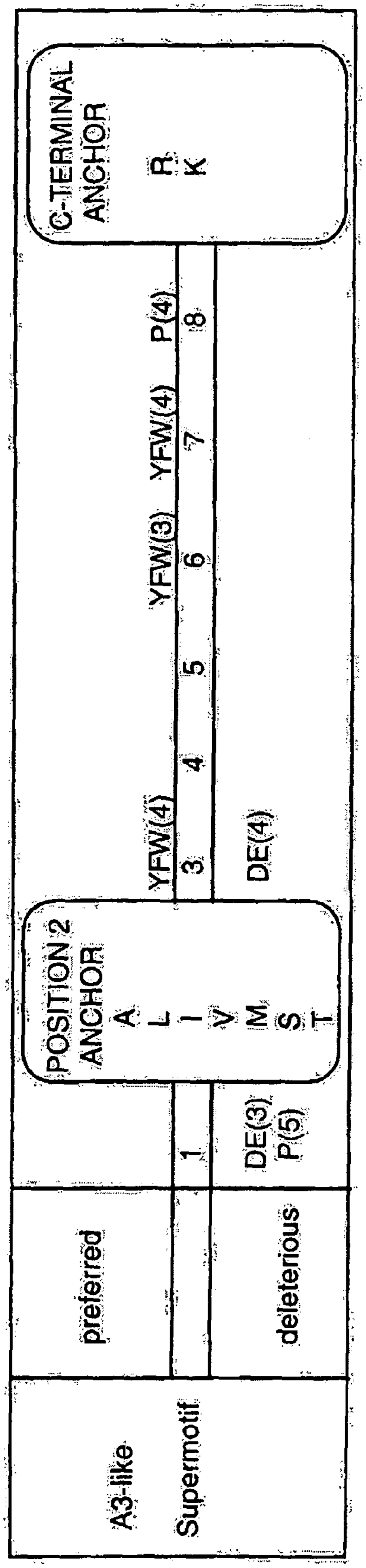
FIG. 45 shows the A3 supermotif. Numbers in parenthesis indicate the number of molecules for which the residue or residue group was preferred or deleterious.

In the present "Grouped Ratio" algorithm residues have been grouped by similarity. This avoids the problem encountered with some rare residues, such as tryptophan, where there are too few occurrences to obtain a statistically significant ratio. TABLES 165 and 166 is a listing of scores obtained by grouping for each of the twenty amino acids by position for 9-mer peptides containing perfect 2/9 motifs. A peptide is scored in the "Grouped Ratio" algorithm as a product of the scores of each of its residues. In the case of positions other than 2 and 9, the scores have been derived using a set of peptides which contain only preferred residues in positions 2 and 9. To enable us to extend our "Grouped Ratio" algorithm. to peptides which may have residues other than the preferred ones at 2 and 9, scores for 2 and 9 have been derived from a set of peptides which are single amino acid substitutions at positions 2 and 9. FIG. 45 shows a scattergram of the log of relative binding plotted against "Grouped Ratio" algorithm score for our collection of 9-mer peptides from the previous example.

The present "Grouped Ratio" algorithm can be used to predict a population of peptides with the highest occurrence of good binders. If one were to rely, for example, solely on a 2(L,M) and 9(V) motif for predicting A2.1 binding 9-mer peptides, it would have been predicted that all 160 peptides in our database would be good binders. In fact, as has already been described, only 12% of these peptides would be described as good binders and only 22% as intermediate binders; 66% of the peptides predicted by such a 2,9 motif are either weak or non-binding peptides. In contrast, using the "Grouped Ratio" algorithm described above, and selecting a score of 1.0 as threshold, 41 peptides were selected. Of this set, 27% are good binders, and 49% are intermediate, while only 20% are weak and 5% are non-binders (TABLE 167).

The present example of an algorithm has used the ratio of binders/non-binders to measure the impact of a particular residue at each position of a peptide. It is immediately apparent to one of ordinary skill that there are alternative ways of creating a similar algorithm.

Figure 46B:
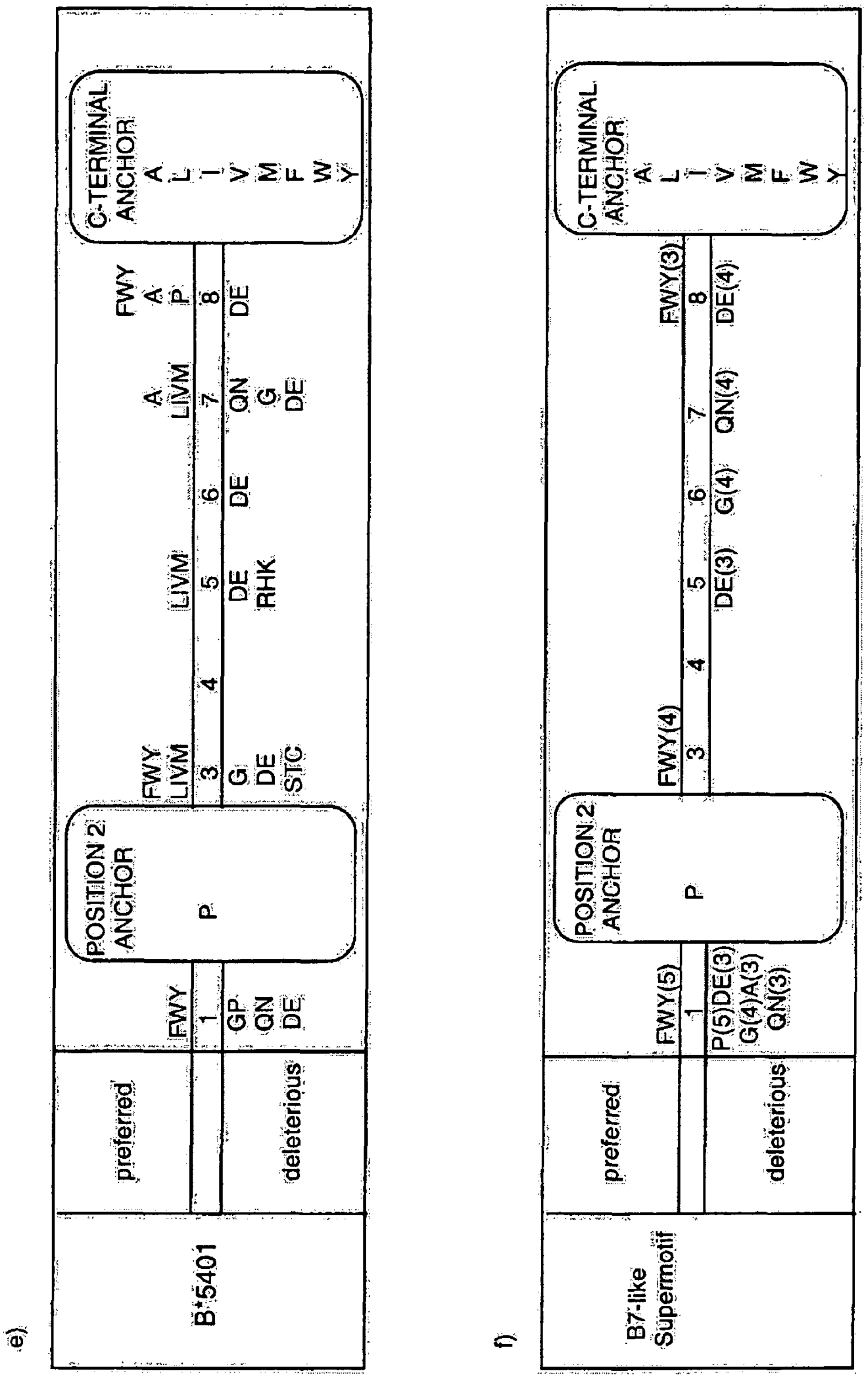

An algorithm using the average binding affinity of all the peptides with a certain amino acid (or amino acid type) at a certain position has the advantage of including all of the peptides in the analysis, and not just good/intermediate binders and non-binders. Moreover, it gives a more quantitative measure of affinity than the simpler "Grouped Ratio" algorithm. We have created such an algorithm by calculating for each amino acid, by position, the average log of binding when that particular residue occurs in our set of 160 2,9 motif containing peptides. These values are shown in TABLE 168. The algorithm score for a peptide is then taken as the sum of the scores by position for each residues. FIG. 46 shows a scattergram of the log of relative binding against the average "Log of Binding" algorithm score. TABLE 167 shows the ability of the two algorithms to predict peptide binding at various levels, as a function of the cut-off score used. The ability of a 2,9 motif to predict binding in the same peptide set is also shown for reference purposes. It is clear from this comparison that both algorithms of this invention have a greater ability to predict populations with higher frequencies of good binders than a 2,9 motif alone. Differences between the "Grouped Ratio" algorithm and the "Log of Binding" algorithm are small in the set of peptides analyzed here, but do suggest that the "Log of Binding" algorithm is a better, if only slightly, predictor than the "Grouped Ratio" algorithm.

The log of binding algorithm was further revised in two ways. First, poly-alanine (poly-A) data were incorporated into the algorithms at the anchor positions for residues included in the expanded motifs where data obtained by screening a large library of peptides were not available. Second, an "anchor requirement screening filter" was incorporated into the algorithm. The poly-A approach is described in detail, above. The "anchor requirement screening filter" refers to the way in which residues are scored at the anchor positions, thereby providing the ability to screen out peptides which do not have preferred or tolerated residues in the anchor positions. This is accomplished by assigning a score for unacceptable residues at the anchor positions which are so high as to preclude any peptide which contains them from achieving an overall score which would allow it to be considered as a potential binder.

The results for 9-mers and 10-mers are presented in TABLE 177 and TABLE 178, below. In these tables, values are group values as follows: A; G; P; D,E; R,H,K; L,I,V,M; F,Y,W; S,T,C; and Q,N, except where noted in the tables.

Example 14

Use of an Algorithm to Predict Binding of 10-Mer Peptides to HLA-A2.1

Using the methods described in the proceeding example, an analogous set of algorithms has been developed for predicting the binding of 10-mer peptides. TABLE 169 shows the scores used in a "Grouped Ratio" algorithm, and TABLE 170 shows the "Log of Binding" algorithm scores, for 10-mer peptides. TABLE 171 shows a comparison of the application of the two different algorithmic methods for selecting binding peptides. FIG. 47 and FIG. 48 show, respectively, scattergrams of a set of 10-mer peptides containing preferred residues in positions 2 and 10 as scored by the "Grouped Ratio" and "Log of Binding" algorithms.

Example 15

Binding of A2.1 Algorithm Predicted Peptides

The results of Examples 6 and 7 indicate that an algorithm can be used to select peptides that bind to HLA-A2.1 sufficiently to have a high probability of being immunogenic.

To test this result, we tested our algorithm on a large (over 1300) non-redundant, independent set of peptides derived from various sources. After scoring this set with our algorithm, we selected 41 peptides (TABLE 171) for synthesis, and tested them for A2.1 binding. This set of peptides was comprised of 21 peptides with high algorithm scores, and 20 peptides with low algorithm scores.

The binding data and categorization profile are shown in TABLE 172 and TABLE 173 respectively. The correlation between binding and algorithm score was 0.69. It is immediately apparent from TABLE 173 the striking difference between peptides with high algorithm scores, and those with low algorithm scores. Respectively, 76% of the high scorers and none of the low scorers were either good or intermediate binders. This data demonstrates the utility of the algorithm of this invention.

Example 16

HLA A2.1 Allele-Specific Motif and HLA A2 Supermotif Binding

We have also derived further information on the structural requirements of A2.1 binding. To do this we first sought to determine the degree of permissiveness of anchor positions 2 and 9. For this purpose, a panel of analogs bearing single substitutions at either position 2 or 9 of a model poly (A) 9-mer peptide containing the previously reported A2.1 motif L in position 2 and V in position 9 (Ruppert, et al, *Cell* 74:929-937 (1993) was synthesized, and its binding capacity measured. Thirteen different analogs were synthesized for both anchor positions 2 and 9.

The present invention also encompasses analogs of peptides bearing the A2.1 allele-specific motif and the A2 supermotif. Analog peptides can have amino acid substitution at primary and/or secondary anchor positions of the A2.1 allele-specific motif or of the A2 supermotif. The complete structural requirements of peptide binding to the HLA A2.1 allele-specific motif are disclosed for the first time herein. This information was developed by determining the degree of permissiveness for amino acids at primary anchor positions 2 and 9. For this purpose, a panel of analogs bearing single substitutions at either position 2 or 9 of a model poly (A) 9-mer peptide containing the previously reported A2.1 motif, L in position 2 and V in position 9 (Ruppert, et al, *Cell* 74:929 (1993) was synthesized, and the peptides' binding capacity measured. Thirteen different analogs were synthesized for both anchor positions 2 and 9.

In good agreement with the previously reported A2.1 motif allele-specific, the peptides carrying L or M in position 2 were the best binders. Decreases in binding capacity (10- to 100-fold) were apparent even with relatively conservative substitutions such as isoleucine (I), valine (V), alanine (A), and threonine (T). Similar data (not shown) were found for glutamine (Q) at positions 2. More radical changes (i.e., residues D, K, F, C, P, G, N, and S) completely abolished binding capacity. Similar results were obtained at position 9, where only conservative substitutions such as L and I bound within 10-fold of the unsubstituted model poly A A2.1 peptide. Analogs carrying A or M substitutions also bound, but less strongly (10- to 100-fold decrease). Finally, all other substitutions tested (C, N, F, S, G, P, and R) were associated with complete loss of A2.1 binding capacity. Thus, based on these data and in good agreement with previous studies (Falk et al. *Nature* 351:290 (1991) and Hunt et al. *Science* 255:1261 91992)), an A2.1 allele motif is now defined as set forth in Tables 137 and 138. Thus, based on these data and in good agreement with previous studies (19-20), a "canonical" A2.1 motif could be identified as L or M in position 2 and L. V. or I in position 9.

Analogs to peptides bearing an HLA A2.1 allele-specific motif may be created based on the substitution of specific residues at primary anchor positions. For example, analog peptides with an enhanced binding affinity for HLA A2.1 molecules may be engineered by substituting preferred residues for tolerated residues at primary anchor positions. Examples of such substitutions and the effects on A2.1 binding are shown in TABLE 147. For this study, a set of 25 HLA A2.1 peptides of different relative binding values was selected. For each of the peptides a substitution of one, or in some instances both, primary anchor positions was made. In the case of the position 2 primary anchor residue, the analog peptide was made with a leucine or methionine substitution. For the C-terminal primary anchor position, a valine residue was substituted in the analogued peptide. In all single substitution analogued peptides, improved HLA A2.1 binding was observed. Significant improvement in binding was also observed in several peptides that contained substitutions at both primary anchor positions. These results indicate that it is possible to improve the binding of a peptide that bears tolerated or less preferred primary anchor residues by substitution with preferred or optimal amino acid residues.

TABLE 147. Binding activities of analogs of A2.1 motif-bearing peptides. The “(a)” indicates an analogued peptide. Relative binding to A2.1 HLA molecules is shown in the last column. Binding is expressed as a ratio of binding of the test peptide relative to a standard peptide. A higher value for the analog relative to the native sequence indicates an increase in binding affinity of the analog relative to the native sequence. The standard A2.1 peptide (FLPSDYFPSV (SEQ ID NO:592)) binds to A2.1 molecules with an $IC_{50}$ of 5.0. The ratio is converted to $IC_{50}$ by dividing the $IC_{50}$ of the standard peptide, i.e. 5.0, by the ratio shown in the table.

Development of the HLA-A2 Supertype.

Direct HLA binding assays with radiolabeled peptides and mammalian cells which express HLA class I molecules, such as EBV-transformed B cell lines and PHA-activated blasts have been developed. Significant binding of the radiolabeled probe could be obtained if the target cells were preincubated overnight at 26° C. in the presence of β2-microglobulin. Under these conditions, up to a few percent of the HLA molecules expressed by either cell type could be bound by the labeled peptides. With these assays, the degree of cross-reactivity of the A*0201-restricted hepatitis B virus core 18-27 peptide with other A2 subtypes was examined. It was determined that this peptide epitope also bound the A*0202, A*0205, and A*0206 but not A*0207 allele-specific HLA molecules.

Inhibition experiments with panels of synthetic peptide analogs underlined the similar ligand specificities of the HLA-A*0201, A*0202, and A*0205 alleles. Furthermore, analysis of the polymorphic residues that help form the polymorphic B and F pockets of various HLA alleles allowed prediction of binding of the hepatitis B virus core 18-27 epitope to two other HLA alleles (HLA-A*6802 and A*6901). The B and F pockets are the pockets on the HLA molecules that come into contact with positions 2 and the C-terminus of a peptide, respectively. Thus, it appears that a family of at least six different HLA-A molecules (A*0201, A*0202, A*0205, A*0206, A*6802, A*6901) collectively defined as the A2 supertype, share overlapping ligand specificities. Furthermore, use of purified HLA molecules in binding assays have demonstrated that A*0203 and A*0207 are also properly included in the A2 supertype.

Therefore, based on these results for the HLA A2.1 allele-specific motif, findings are extrapolated to the HLA A2 supermotif. The A2 supertype binding of any peptide which carries a “non-canonical” (but still acceptable) residue in position 2 or 9 (or 10) (for example A, T, or Q in 2; or L, A, M or T in 9 or 10) is increased by creating an analog which replaces the acceptable residue with a more “canonical” or preferred anchor. For example, the FHV Env 2181 peptide with sequence (LWVTVYYGV (SEQ ID NO:14623)) bind A2.1 with a IC50% of 12,500 nM, while the position 2 anchor substituted analog LMVTVYYGV (SEQ ID NO:12210) binds with IC50% of 3.3 nM. The HBVc 18-27 naturally occurring sequence FLPSDFFPSI (SEQ ID NO:12022) binds A2.1 with IC50% 22 nM, but its C-terminal anchor substituted $V_{lo}$ variant binds A2.1 with a Kd of 2.5 nM. For example, the HBV pol 538 peptide (YMDDVVLGA (SEQ ID NO:12043)) binds A2.1 with an $IC_{50}$ of 200 nM, while an analog containing a V substitution at position 9 binds with an $IC_{50}$ of 5.1 nM. Other examples of fixed anchor peptides are shown in TABLE 145. Some of the fixed peptides were tested for their ability to induct CTL responses. For example, the HIV Env 2181 peptide and the HBV pol 721 peptides were tested in primary CTL assays (21), and found to be positive. Positive CTL recognition data exists also for the HBV 18-27 and HBV pol 538 peptides.

The binding activity of a peptide that does not bear a motif, but that is selected on the basis of similarity to a known peptide epitope that has the ability to bind an HLA molecule, may also be modulated. Such a peptide may be engineered to enhance binding to HLA molecules by substituting primary anchor residues, as designated for the particular motif, for non-anchor residues such that a motif-bearing peptide is created. For example, the HIV Env 2181 peptide with sequence (LWVTVYYGV (SEQ ID NO:14623)), which does not bear an A2.1 motif or A2 supermotif primary anchor residue at position 2, binds A2.1 with an $IC_{50}$ of 12,500 nM, while the position 2 anchor substituted analog LMVTVYYGV (SEQ ID NO:12210) binds with an $IC_{50}$ of 3.3 nM.

Analogoued peptides may also be tested for their ability to induce CTL responses. For example, the analog HIV Env 2181 peptide was tested in primary CTL assays, and found to be positive (Wentworth et al. *Molec. Immunol.* 32: 603-612 91995)). Positive CTL recognition data also exist for the HBV pol 538 peptide.

The A2 supermotif may also be used to create substituted analogs, enhancing the binding affinity of such a peptide for several members of the A2 supertype. An example of how such analoguing was accomplished was demonstrated with the peptide HPV 16 EF.86-93 TLGIVCPI (SEQ ID NO:12084) and its analog TLGIVXPI (SEQ ID NO:14624) (where X stands for cc amino butyric acid). The binding patterns of these two peptides for A2 alleles, i.e., for the A2 supertype, was then tested. It was found that the X substitution greatly increased binding affinity for all A2 alleles, resulting in a more useful peptide, characterized by increased binding capacity and broader crossreactivity than its original parent sequence. Furthermore, the peptide was more stable and less subject to oxidation. Subsequent experiments utilizing A2/$K^b$ transgenic mice demonstrated that CTLs induced by the X-substituted peptide were fully crossreactive with the wild type sequence, and that the X peptide, as a result of its higher binding affinity, was a more potent immunogen.

In conclusion, from the data shown herein, analogs are created of A2.1 peptides (9-mers or 10-mers) at primary and/or secondary residues. Such analogs exhibit higher binding affinity by substituting out “negative” or neutral residues from a native sequence, and inserting either neutral or preferred residues. These peptides are understood to have unique immunological properties in that they, while still crossreactive with the wild type sequences, may not be subject to tolerance, deletion or suppressive mechanisms, which serve to inactivate a CTL response to the wild type sequence, present as a result of cancer or infection.

Determination of Secondary Residues and an Extended A2.1 Motif for 9-Mer and 10-Mer Peptides.

Analysis of 9-Mer Peptide Binding to HLA A2.1 Molecules.

Data have revealed a prominent role for residues that are not primary anchors in determining binding capacity of 9-mer peptides for A*0201. The results of these analyses are described in Ruppert et al., *Cell* 74:929 (1993). Accordingly, the frequency of a given amino acid group in A2.1 binding peptides was divided by the frequency of nonbinding peptides to obtain a frequency ratio. This ratio indicates whether a residue occurs at a given position preferentially in binding (ratio >1) or nonbinding peptides (ratio <1). To facilitate the analysis, a threshold level was set for the ratios, such that residues present at more than 4-fold greater frequency in binding peptides compared with nonbinding peptides were regarded as favored or preferred residues, and residues present at less than 4-fold lower frequency in binding peptides than in nonbinding peptides were regarded as unfavored or deleterious residues. Following this approach, groups of residues showing prominent associations as having favored or unfavored binding, respectively, were identified.

In general, the most detrimental effects were observed with charged amino acids. At position 1, both P and acidic (E and D) residues were infrequent in A2.1-binding peptides. At position 6, basic (H, R, and K) residues were associated with nonbinding peptides, whereas both acidic and basic residues were infrequent in good binding peptides at positions 3 and 7. Conversely, aromatic residues were associated with high affinity binding in positions 1, 3, and 5. Furthermore, residues with OH- or SH-containing side chains, such as S, T, or C, were favored at position 4, while A was favored in position 7 and P in position 8. In conclusion, these frequency analyses allowed for the definition of an extended A2.1 motif that takes into account the impact of secondary anchor positions (other than primary anchor positions 2 and C-terminus) for peptide binding to HLA A2.1 molecules. The extended A2.1 9-mer motif is set forth in TABLE 138.

Analysis of 10-Mer Peptide Binding to HLA A2.1 Molecules.

The same approach described above for 9-mer peptides was also used to analyze the data obtained with a set of 10-mer peptides. At the N- and C-termini of the peptides, the pattern observed was rather similar to the one observed with 9-mers. For instance, in the 10-mer set, as in the case of the 9-mer peptides, position 1 was characterized by an increased frequency of aromatic residues in the binder set, while negative charges and P were again associated with poor binding. Again at position 3, amino acids with negative charge were associated with poor binding. Interestingly, at this position, aliphatic (rather than aromatic) residues were associated with high affinity binding. At the C-termini of the peptides, certain similarities were also observed. In the 10-mer, the penultimate residue at position 9 (corresponding to position 8 in the 9-mer) was quite permissive, with only basic residues being found more frequently in nonbinding peptides. Similar to the situation at position 7 in the 9-mer, neither positive nor negative charges were tolerated in the antepenultimate position 8 of the 10-mers. Also, position 7 did not favor positive residues in the 10-mers, as previously observed for position 6 in the 9-mers. In comparison to what was observed at position 3 (for both 9-mers and 10-mers), the residues associated with good binding were, however, different. Aromatic and hydrophobic residues were frequent in high affinity binders at position 8 (as opposed to only A being frequent at position 7 in the 9-mers).

Finally, a rather distinctive pattern was observed in the middle of the peptide. At position 4, G was favored in high affinity binding peptides, while both A and positive charges were very frequent in nonbinding peptides. P, in position 5, was completely absent in peptides that bind to HLA A2.1 molecules. It is noteworthy that none of the trends observed in positions 4 and 5 in the 10-mer set have any counterpart in position 3 or 4 in the 9-mer set.

In summary, an extended motif has been generated for A2.1 binding 10-mer peptides, following a strategy similar to the one described for 9-mer peptides above. The extended A2.1 10-mer motif is set forth in TABLE 138. Both important differences and striking similarities were noted in comparing the 9-mer and 10-mer sets at these nonanchor positions.

Example 17

HLA Class I A3 Supertype Binding

This example provides supermotif data useful for the preparation of analogs of supermotif-bearing peptides as well as for determination of native sequences with particular properties. The supermotif data were derived by calculating at each non-anchor position along the peptide sequence the average relative binding capacity of peptides carrying each of the 20 common amino acids, grouped according to individual chemical similarities.

A-3 Supermotif

HLA Class I Protein Purification.

The following Epstein-Barr virus (EBV)-transformed homozygous cell lines were used as sources of class I molecules: GM3107 (A3, B7; Human Genetic Mutant Repository); BVR (A11, B35.3, Cw4; Human Genetic Mutant Repository); SPACH (A31, B62, Cw1/3; ASHI Repository Collection); and LWAGS (A*3301, B14, Cw8; ASHI Repository Collection) (Bodmer, et al., *Hum. Immunol.* 43:149 (1995)). A C1R transfectant characterized by Dr. Walter Storkus (University of Pittsburgh) was used for the isolation of A*6801. Cell lines were maintained as previously described (Sidney, et al., *J. Immunol.* 154:247 (1995); Sette, et al., *Mol. Immunol.* 31:813 (1994)).

Cell lysates were prepared and HLA class I molecules purified as previously described (Sidney, et al., *J. Immunol.* 154:247 (1995); Sette, et al., *Mol. Immunol.* 31:813 (1994)). Briefly, cells were lysed at a concentration of $10^8$ cells/ml in 50 mM Tris-HCl, pH 8.5, containing 1% Nonidet P-40 (Fluka Biochemika, Buchs, Switzerland), 150 mM NaCl, 5 mM EDTA, and 2 mM PMSF. The lysates were passed through 0.45 μM filters and cleared of nuclei and debris by centrifugation at 10,000 g for 20 minutes. HLA proteins were then purified by affinity chromatography. Columns of inactivated Sepharose CL 4B and Protein A Sepharose were used as precolumns. The cell lysate was depleted of HLA-B and HLA-C proteins by repeated passage over Protein A Sepharose beads conjugated with the anti-HLA(B,C) antibody B1.23.2 (Rebai, et al., *Tissue Antigens* 22:107 (1983)). Typically two to four passages were required for effective depletion. Subsequently, the anti HLA(A,B,C) antibody W6/32 (Barnstable, et al., *Cell* 14:9 (1978)) was used to capture HLA-A molecules. Protein purity, concentration, and effectiveness of depletion steps were monitored by sodium dodecyl sulfate-polyacrylamide gel electrophoresis (SDS-PAGE).

Binding Assays.

Quantitative assays for the binding of peptides to soluble class I molecules on the basis of the inhibition of binding of a radiolabeled standard probe peptide to detergent solubilized HLA molecules were performed as previously described (Kubo, et al., *J. Immunol.* 152:3913 (1994); Kast, et al., *J. Immunol.* 152:3904 (1994); Sidney, et al., *J. Immunol.* 154:247 (1995); Sette, et al., *Mol. Immunol.* 31:813 (1994); Ruppert, et al., *Cell* 74:929 (1993)). Briefly, 1-10 nM of radiolabeled probe peptide, iodinated by the Chloramine-T method (Greenwood, et al., *Biochem. J.* 89:114 (1963)), was co-incubated at room temperature with various amounts of HLA in the presence of 1 μM human $\beta_2$-microglobulin (Scripps Laboratories, San Diego, Calif., USA) and a cocktail of protease inhibitors. At the end of a two day incubation period, the percent of HLA-bound radioactivity was determined by size exclusion gel filtration chromatography on a TSK 2000 column.

The A3CON1 peptide (sequence KVFPYALINK (SEQ ID NO:14625)) (Kubo, et al., *J. Immunol.* 152:3913 (1994)) was used as the radiolabeled probe for the A3, A11, A31, and A*6801 assays. A T7Y analog of HBVc 141-151 (sequence STLPETYVVRR (SEQ ID NO:14626)) (Missale, et al., *J. Exp. Med.* 177:751 (1993)) was used as the radiolabeled probe for the A*3301 assay. In the case of competitive assays, the concentration of peptide yielding 50% inhibition of the binding of the radiolabeled probe peptide ($IC_{50}$) was calculated. Peptides were usually tested at one or two high doses, and the $IC_{50}$ of peptides yielding positive inhibition were determined in subsequent experiments, in which two to six further dilutions were tested, as necessary. HLA concentrations yielding approximately 15% binding of the radiolabled probe peptide were used for all competitive inhibition assays. Under these conditions the concentration of the labeled peptide is less than the concentration of the HLA molecule and the $IC_{50}$ is less than the concentration of the HLA molecule, accordingly the measured $IC_{50}$s are reasonable approximations of the true $K_D$ values. Each competitor peptide was tested in two to four completely independent experiments. As a positive control, in each experiment, the unlabeled version of the relevant radiolabeled probe was tested and its $IC_{50}$ measured. The average $IC_{50}$s of A3CON1 for the A3, A11, A31, and A*6801 assays were 11, 6, 18, and 8 nM, respectively. The average $IC_{50}$ of the HBVc 141-151 peptide in the A*3301 assay was 29 nM.

Definition of secondary anchor positions for five HLA-A3 supertype alleles (A3, A11, A31, A3301, A6801).

A modification of the procedure used by Ruppert, et al., *Cell* 74:929 (1993) to define A*0201 secondary anchor motifs was utilized. Briefly, HLA-specific secondary anchor position motifs were defined by assessing the effect on HLA binding of the 20 commonly occurring amino acids at each non-primary anchor position of 9-mer sequences. Assessment was made by calculating the average relative binding values for each position-amino acid combination (e.g., position 1, alanine; position 2, alanine, etc.). To overcome problems with the low occurrence of certain amino acids, some residues were grouped as previously described (Ruppert, et al., *Cell* 74:929 (1993)). Residue types associated at a particular position with average binding capacities fourfold higher or lower than the overall average binding capacity of a 200-peptide set were considered to be associated with good or poor binding capacity, respectively.

Peptide Synthesis.

Peptides were either synthesized as previously described (Ruppert, et al., *Cell* 74:929 (1993)), or purchased as crude material from Chiron Mimotopes (Chiron Corp., Australia). Peptides that were synthesized were purified to >95% homogeneity by reversed-phase high-pressure liquid chromatography (HPLC). The purity of these synthetic peptides was assayed on an analytical reversed-phase column and their composition ascertained by amino acid analysis, sequencing, and/or mass spectrometry analysis.

Structural Analysis of the Peptide-Binding Pockets of Various HLA A3 Supertype molecules.

Previous studies indicated that the HLA molecules A3, A11, and A*6801 are associated with specificity for ligands carrying small or hydrophobic residues in position 2, and positively charged C-termini (Kubo, et al., *J. Immunol.* 152:3913 (1994); Guo, et al., *Nature* 360:364 (1994); Falk, et al., *Immunogenetics* 40:238 (1994); Dibrino, et al., *J. Immunol.* 151:5930 (1993); DiBrino, et al., *Proc. Nat'l Acad. Sci. USA* 90:1508 (1993); Zhang, et al., *Proc. Nat'l Acad. Sci. USA* 90:2217 (1993); Sette, et al., *Mol. Immunol.* 31:813 (1994)).

The side chains of the residue in position 2 and at the C-termini of antigenic peptides are known to contact the residues forming the B and F pockets of HLA class I molecules (Madden, et al., *Cell* 75:693 (1993); Saper, et al., *J. Mol. Biol.* 219:277 (1991)), the residues of the HLA molecule that form these polymorphic pockets were tabulated for various putative HLA class I A3 supertype molecules. It was found that the HLA types which are known to recognize peptides with small or hydrophobic residues in position 2 (e.g., A*0101, A*0201, A*0301, A*1101, A*6801, and A*6802), and HLA types which recognize positively charged residues at the C-terminus (e.g., A*0301, A*1101, A*6801, and B*2705) of their peptide ligands shared certain key structural features. In particular, for HLA molecules that bind peptides that have small and hydrophobic residues at position 2, it was found that the HLA molecule carried aliphatic residues (M or V) at positions 45 and 67, and potential hydrogen-bond-forming residues such as N and K, or H and Q at positions 66 and 70, respectively. All of these HLA molecules also carried a Y residue at position 99. In contrast, class I A3 supertype molecules that exhibited different binding specificities differed in one or more of these positions. Similarly, only class I molecules that prefer positively charged C-termini carried D, T, L, and D at positions 77, 80, 81, and 116, respectively.

In short, this analysis established that a set of HLA class I molecules (A3, A11, and A*6801), designated as the A3 supertype, share binding repertoires for peptides comprising a motif characterized by small or hydrophobic residues in position 2 and positively charged residues at their C-terminal positions, and share certain key structural features in their B and F pockets. The A3 supertype molecules bind to peptides having a corresponding motif designated as the A3 supermotif.

Analysis of other class I HLA molecules for which motifs were unknown, revealed that A*3101, A*3301, A*3401, A*6601, and A*7401 also shared these same consensus sequences in their B and F pockets. Accordingly, these molecules were also designated to be part of the A3 supertype. Falk, et al., *Immunogenetics* 40:238 (1994) subsequently verified that A31 and A33 are indeed characterized by a repertoire for peptides with an A3 peptide motif.

A3 Molecules Exhibit Overlapping Primary Anchor Specificities.

To compare the range of motifs recognized by some of the most frequent A3 HLA molecules (A3, A11, A31, A*3301, and A*6801), more detailed molecular analysis of the main anchor residues (position 2 and C-terminal) of the peptides bound by these molecules was undertaken. A3- and A11-specific peptide-binding assays measuring the capacity of unlabeled synthetic peptides to inhibit the binding of a radiolabeled peptide to affinity-purified HLA class I molecules have been previously described (Kubo, et al., *J. Immunol.* 152:3913 (1994); Kast, et al., *J. Immunol.* 152:3904 (1994); Sette, et al., *Mol. Immunol.* 31:813 (1994)). Binding assays specific for A31, A*3301, and A*6801 were developed using similar approaches (Kubo, et al., *J. Immunol.* 152:3913 (1994); Kast, et al., *J. Immunol.* 152:3904 (1994); del Guercio, et al., *J. Immunol.* 154:685 (1995); Sidney, et al., *J. Immunol.* 154:247 (1995); Sette, et al., *Mol. Immunol.* 31:813 (1994); Ruppert, et al., *Cell* 74:929 (1993)).

Primary anchor specificities of peptides bound by the A3 supertype HLA molecules were subsequently explored by preparing a panel of peptides carrying substitutions at position 2 or 9, 9 being the C terminus, of a prototype poly-alanine 9-mer peptide AXAAAAAAX (SEQ ID NO:14627). These peptides were tested to evaluate their inhibitory capacity for A3, A11, A31, A*3301, and A*6801. Inhibitory capacity was determined by detecting whether the binding of a labeled probe was inhibited in the presence of a peptide from the panel. Each HLA molecule expressed individual preferences, but in the majority of instances, significant peptide binding was obtained when the peptide's position 2 was occupied by either A, I, L, M, S, T, or V, and the C-terminus was either R or K. These data were found to be in good agreement with pool sequencing data previously generated (Kubo, et al., *J. Immunol.* 152:3913 (1994); Falk, et al., *Immunogenetics* 40:238 (1994); Dibrino, et al., *J. Immunol.* 151:5930 (1993); DiBrino, et al., *Proc. Nat'l Acad. Sci. USA* 90:1508 (1993)), and also extended in the cases of A31, A*3301, and A*6801, the definition of the primary anchor motifs.

In conclusion, these data indicate that a primary anchor supermotif for the A3 supertype is defined as A, I, L, M, S, T, or V in position 2, and either R or K at the C-terminus.

A3 Supertype Molecules Share Overlapping Peptide-Binding Repertoires.

The extent to which peptides which have the A3 supermotif exhibit cross-reactivity binding amongst the HLA A3 supertype molecules was examined. A set of 200 naturally occurring 9-mer peptide sequences carrying residues A, I, L, M, S, T, or V in position 2 and K or R in the C terminus (i.e., peptides with an A3 supermotif) was assembled. Other than the constraint that each possible anchor combination be represented in proportion to the natural frequency of the individual amino acids, the peptides comprising the set were randomly selected from viral and tumor antigen sequences. When each peptide was tested for its capacity to bind purified A3, A11, A31, A*3301, and A*6801 HLA molecules, it was apparent that a unique binding pattern was associated with each allelic type. For example, some peptides were rather selective, binding only one class I type, whereas certain other peptides cross-reacted rather extensively, binding four or five of the molecules tested.

It was found that, in general, about 10% (5%-16%) of the peptide-HLA combinations were associated with good binding ($IC_{50}$50 nM), and about 17% (11%-24%) with intermediate binding ($IC_{50}$ 50-500 nM) to any given allele. These frequencies of high and intermediate binding are similar to those previously noted for A*0201 pool-sequencing motif-containing peptides (Ruppert, et al., *Cell* 74:929 (1993)).

Most notable, however, was the relatively high degree of cross-reactivity observed. Of the 127 peptides that were capable of binding to at least one A3 molecule, 43 of them (34%) bound three or more of the A3 supertype molecules. Four peptides bound all five of the A3 molecules tested. In contrast, in a set of 39 peptides which were tested for binding to five unrelated class I molecules (A*0101, A3, A24, and B7), only three (8%) bound to two molecules, and none bound to three or more molecules. The peptides identified as high or intermediate binders for at least four of the five A3 molecules tested are listed in Table 141. In Table 141, good or intermediate binding capacities are defined as $IC_{50}$500 nM, and are highlighted by shading. Taken together, these data demonstrate significant overlap in the binding repertoires of the A3 supertype molecules, and validate the A3 primary anchor supermotif. From the set of peptides used in this evaluation, 10 additional peptides binding with high or intermediate affinity to at least four of the five A3 molecules tested were identified (see, TABLE 141 and below).

The peptides identified as high or intermediate binders for at least four of the five A3 molecules tested are listed in TABLE 141. In TABLE 141, good or intermediate binding capacities are defined as $IC_{50} \leq 500$ nM, and are highlighted by shading.

Taken together, these data demonstrate significant overlap in the binding repertoires of the A3 supertype molecules, and validate the A3 primary anchor supermotif. From the set of peptides used in this evaluation, 10 additional peptides binding with high or intermediate affinity to at least four of the five A3 molecules tested were identified (see, TABLE 141 and below).

Secondary Anchor Residues which Confer Additional Properties to A3 Supermotif-Bearing Peptide Ligands.

As stated above, although the overlap in the binding repertoires of A3 supertype molecules is significant, each A3 HLA molecule also retains a substantial degree of binding specificity. To understand the basis of the observed cross-reactivities, an extended supermotif that defines molecules having the A3 supermotif primary anchors and further specificities at other positions was defined. The amino acid patterns determined at these non-primary anchor positions are designated as secondary anchor positions.

First, refined motifs for each of the A3-like alleles analyzed herein (A3, A11, 30 A31, A*3301, and A*6801), outlining secondary anchor-binding specificities, were derived as described in the Materials and Methods. This approach is similar to the one previously used to define a refined A*0201 motif (Ruppert, et al., Cell 74:929 (1993)). The motifs were derived by calculating at each nonanchor position along the peptide sequence the average relative binding capacity of peptides carrying each of the 20 common amino acids, grouped according to individual chemical similarities. Representative of the data generated by this procedure, the values calculated for A3 are shown in TABLE 140. Following this as an example, 21 different peptides were tested which possessed an aromatic residue (F, W, Y) in position 3 of their sequence. These peptides had an average relative binding capacity to A3 31.7-fold higher than the overall average of the 200-peptide set. By analogy to what was previously described in the case of A*0201, preferred and deleterious residues were defined as residues associated with average binding capacities that were fourfold greater than or fourfold less than, respectively, the overall average. Accordingly, aromatic residues in position 3 were considered "preferred" residues for A3 binding.

The extended A3 supermotif including both primary and secondary anchor positions is referred to as an extended A3 supermotif and is employed to identify molecules in a native sequence that possess certain desired properties. Alternatively, the secondary anchors of the supermotif are employed to develop analogs of peptides that possess residues in accordance with the definition of the primary A3 supermotif.

The A3 supermotif including both primary and secondary anchor positions is referred to as the extended A3 supermotif, and is employed to identify molecules in a native sequence that possess certain desired properties. Alternatively, the secondary anchors of the supermotif are employed to develop analogs of peptides that possess residues in accordance with the definition of the primary A3 supermotif.

Of course, analogs can also be prepared by utilizing the primary supermotif. For example, native peptide sequences that fall within the primary A3 supermotif can be analogued by substitution of another supermotif defined amino acid at a position where another supermotif defined primary anchor amino acid existed in the native sequence. Although presently less preferred, an analog of a native sequence that does not fall within the definition of the primary supermotif is prepared. Accordingly, one or more amino acids within the definition of the primary supermotif is substituted for one or more amino acids of the native sequence which do not fit the supermotif.

Accordingly, extended motifs for each of the A3 supertype alleles analyzed herein (A3, A11, A31, A*3301, and A*6801) were derived as described in accordance with the methodology used to define the supermotif for the primary anchor residues. This approach was similar to the one previously used to define an extended A*0201 motif (Ruppert, et al., *Cell* 74:929 (1993)). The extended motifs were derived by calculating at each nonanchor position along the peptide sequence, the average relative binding capacity of peptides carrying each of the 20 common amino acids, grouped according to individual chemical similarities. Representative of the data generated by this procedure, the values calculated for A3 supertype alleles are shown in TABLE 143.

For example, 21 different peptides were tested which possessed an aromatic residue (F, W, Y) in position 3 of their sequence. These peptides had an average relative binding capacity to A3 31.7-fold higher than the overall average of the 200-peptide set. By analogy to what was previously described in the case of A*0201, preferred and deleterious residues were defined as residues associated with average binding capacities that were four-fold greater than or four-fold less than, respectively, the overall average. Accordingly, aromatic residues in position 3 were considered "preferred" residues for A3 binding. A similar analysis was performed for each allele (A3, A11, A31, A*3301) and was used to derive maps of allele-specific secondary anchor requirements for each position. See TABLE 143.

Figure 39:
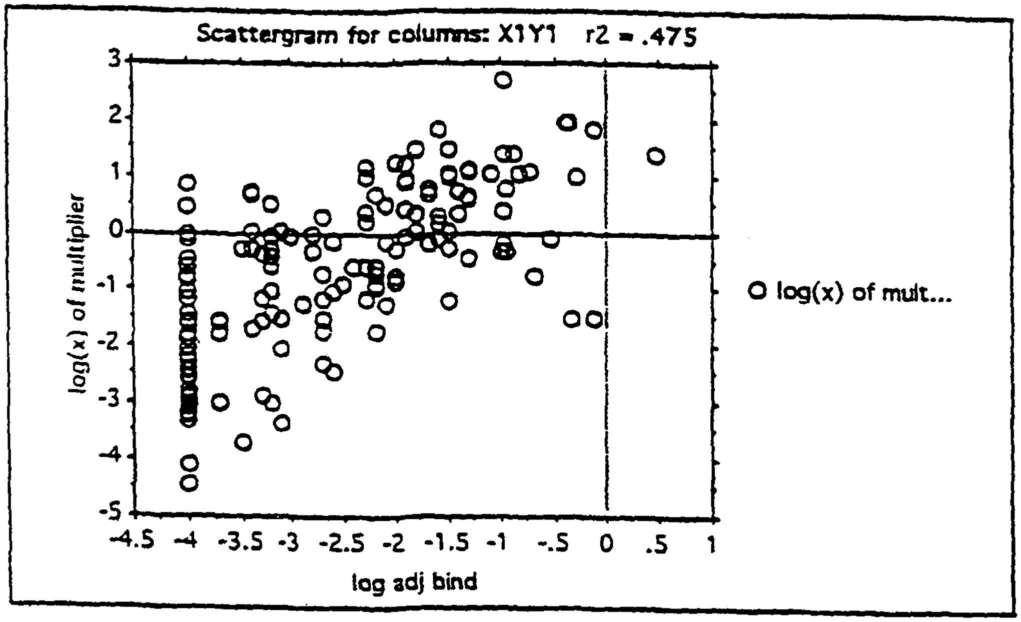
FIG. 39 shows a scattergram of the log of relative binding plotted against the "Grouped Ratio" algorithm for 9 mer peptides.

Summaries of the extended motifs obtained for peptides which binds to each HLA protein of the A3 supertype examined are shown in FIG. 39.

As depicted in FIG. 39, each protein exhibited its own unique secondary anchor requirements. For example, positively charged residues (R, H, K) at position 4 were preferred by the A3 allele, but not by any other A3 supertype molecule. Similarly at position 8, glycine (G) was associated with poor binding capacity only for A11, whereas negative charges (D, E) were deleterious only for A31. Besides these types of unique protein-specific features, certain residues were associated with either poor or good binding in a majority of the molecules of the A3 supertype. For example, proline (P) in position 1 was deleterious for all five of the A3 supertype molecules tested. Aromatic residues (F, W, Y) in position 7 and proline in position 8 were preferred by four of the five molecules tested (FIG. 39).

A similar analysis was performed for each allele (A3, A11, A31, A*3301) and was used to derive maps of allele-specific secondary anchor requirements for each position (TABLE 140). Summaries of the modified motifs obtained for each allele of the A3-like supertype examined are shown in FIG. 39. Each molecule exhibited its own unique secondary anchor requirements. For example, positively charged residues (R, H, K) at position 4 were preferred by A3, but not by any other A3-like molecule. Similarly at position 8, glycine (G) was associated with poor binding capacity only for A11, whereas negative charges (D, E) were deleterious only for A31. Besides these types of unique allele-specific features, certain residues were associated with either poor or good binding in a majority of the molecules of the A3 supertype. For example, proline (P) in position 1 was deleterious for all five of the A3-like molecules tested. Aromatic residues (F, W, Y) in position 7 and proline in position 8 were preferred by four of the five molecules tested (FIG. 39).

Figure 40:
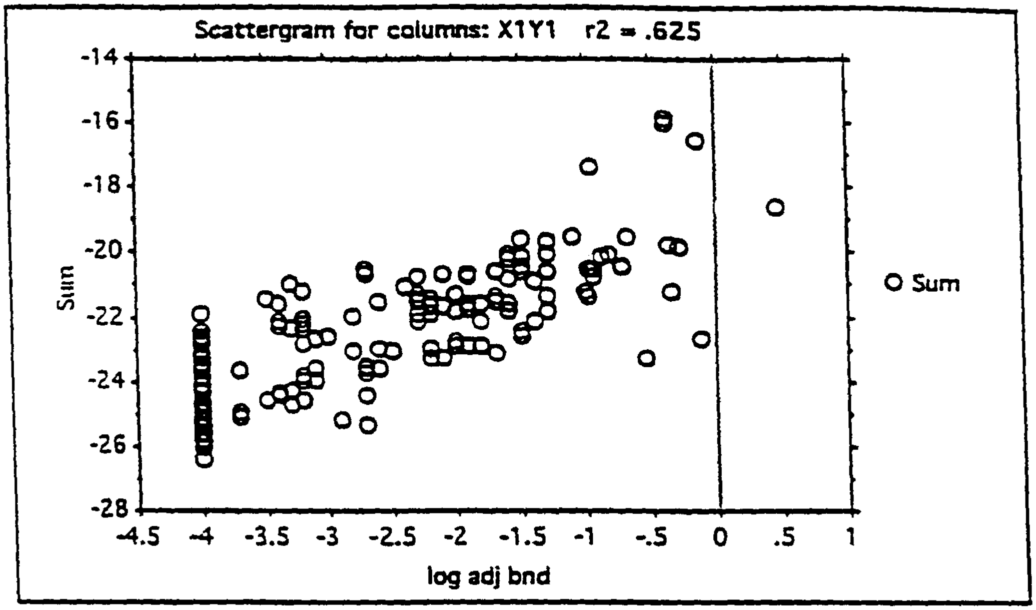
FIG. 40 shows a scattergram of the log of relative binding plotted against the average "Log of Binding" algorithm score for 9 mer peptides.

On the basis of the various individual extended motifs, an extended A3 supermotif was constructed. Residues deleterious for at least three of the five alleles considered were defined as "deleterious residues" in the supermotif. Conversely, residues preferred by at least three of the five alleles considered, but also not deleterious for any allele, were defined as "preferred residues." The extended A3 supermotif derived following this approach is shown in FIG. 40.

Efficacy of the A3-Extended Supermotif in Predicting Highly Cross-Reactive Peptides.

To test the validity of the extended A3 supermotif defined above, an additional set of 108 peptides not previously included in the analysis of supermotifs was tested for binding to HLA molecules encoded by A3, A11, A31, A*3301, and A*6801 alleles. This set included 30 peptides which had at least one preferred supermotif residue and no supermotif deleterious residues, 43 peptides with at least one supermotif deleterious residue (supermotif negative), and 35 peptides with neither supermotif preferred nor deleterious residues (supermotif neutral).

Of the 30 supermotif positive peptides, 27 (90%) bound to two or more molecules within the A3 supertype and 16 (53%) bound to three or more molecules. By contrast, 18 (51%) of 35 extended supermotif neutral peptides bound two or more A3 types, and eight (23%) bound three or more molecules. Finally, the supermotif negative peptides were much less capable of binding multiple alleles, with six (14%) peptides binding two A3 supertype molecules, and no peptides binding three or more molecules.

These results are qualitatively similar to those obtained when the original set of peptides used to define the primary anchor residues in the supermotifs was subjected to the same type of analysis, and are in striking contrast with the level of cross-reactivity observed in the case of the previously mentioned binding of a control set of peptides to unrelated HLA proteins, in which only a few peptides (8%) bound to a protein other than their intended original protein.

Calculation of Phenotypic Frequencies of HLA Supertypes in Various Ethnic Backgrounds and Projected Population Coverage.

Gene frequencies for each HLA allele were calculated from antigen or allele frequencies in accordance with principles in the art (see e.g. Imanishi, et al., *Proc. of the Eleventh International Histocompatibility Workshop and Conference, Vol.* 1, Tokyo, Oxford University Press (1992) and Fernandez-Viña, et al., *Hum. Immunol.* 33:163 (1992)) utilizing the binomial distribution formula:

$$gf=1-(\mathrm{SQRT}(1-af))$$

(Tiwari, et al., *The HLA complex*, In HLA AND DISEASE ASSOCIATES, NY, Springer-Verlag (1985)).

To obtain overall phenotypic frequencies, cumulative gene frequencies were calculated and the cumulative antigen frequencies derived by the use of the inverse formula:

$$af=1-(1-Cgf)^2$$

As discussed below, where frequency data was not available at the level of DNA typing, correspondence to the serologically defined antigen frequencies was assumed. To obtain total population coverage no linkage disequilibrium was assumed and only alleles confirmed as belonging to each of the supertypes were included (minimal estimates). Estimates of total coverage achieved by interloci combinations were made by adding to the A coverage the proportion of the non-A covered population that could be expected to be covered by the B alleles considered (e.g., total=A+B*(1−A)).

Confirmed members of the A3 supertype are A3, A11, A31, A*3301, and A*6801. Although the A3 supertype may potentially include A32, A66, and A*7401, these alleles were not included in overall frequency calculations.

High Phenotypic Frequencies of HLA Supertypes are Conserved in all Major Ethnic Groups.

Thus, to evaluate HLA supertypes in general, and the A3 supertype in particular, the incidence of various HLA class I alleles or antigens was examined. To date, much of the available HLA-A and -B population data are based on serologic typing. These data do not have resolution at the level of alleles as defined by DNA sequences, and thus do not distinguish between subtypes. However, comparison of the peptide-binding specificities of subtypes, either through peptide-binding studies (del Guercio, et al., *J. Immunol.* 154:685 (1995); Tanigaki, et al., *Hum. Immunol.* 39:155 (1994)), pool sequencing analysis (Fleischer, et al., *Tissue Antigens* 44:311 (1994); Rötzschke, et al., *Eur. J. Immunol.* 22:2453 (1992)), or analysis of pocket structure based on primary sequence, suggest that in most instances subtypes will have very similar, if not identical, peptide main anchor specificities. Thus in the following analysis, if population data at the DNA subtype level were not available, but either binding data, published motifs, or sequence analysis suggested that subtypes will have overlapping peptide binding specificities, a one-to-one correspondence between subtype alleles and the serologically defined antigens was assumed.

When the incidence of the various A3 supertype alleles or antigens in different ethnic backgrounds was examined, it became apparent that while the frequency of each individual allele or antigen can vary drastically between ethnic groups (Imanishi, et al., *Proceedings of the Eleventh International Histocompatibility Workshop and Conference, Vol.* 1, Tokyo, Oxford University Press (1992)), the cumulative frequency of the five A3 supertype alleles, viewed collectively, is remarkably constant (between 37% to 53% depending on the ethnic population studied). For example, the individual A3 allele is common in Caucasians, African-Americans, and Hispanics, but almost absent in Japanese. Conversely, the A31 allele is frequent in Japanese but rare in Caucasians and African-Americans. By contrast, in each of the five populations examined, the A3 HLA supertype was present in at least 37%, and as high as 53%, of the individuals.

Notably, the existence of an A3 HLA supertype is not an isolated incident, as the existence of A2 (del Guercio, et al., *J. Immunol.* 154:685 (1995)) and B7 (Sidney, et al., *J. Immunol.* 154:247 (1995)) supertypes are reported. These additional supertypes are also very prominent, with remarkably constant cumulative frequencies (in the 40% to 60% range) amongst different ethnic backgrounds. These supertypes are discussed in greater detail in the following Examples. In fact, at the gene level, at least one half of the total copies of HLA-A or -B genes in existence appear to belong to one or another of these three HLA supertypes.

As pointed out in the Background section, the existence of an A3 HLA supertype is not an isolated incident, as the A2 supertype (del Guercio, et al., *J. Immunol.* 154:685 (1995)) and B7 supertype (Sidney, et al., *J. Immunol.* 154:247 (1995)) are reported. These A2 and B7 supertypes are also very prominent, with remarkably constant cumulative frequencies (in the 40% to 60% range) amongst different ethnic backgrounds. In fact, at the gene level, at least one half of the total copies of HLA-A or -B genes in existence appear to belong to one or another of these three HLA supertypes.

T Cell Recognition of Supermotif Peptides when Bound by HLA Molecules.

To better gauge the biologic relevance of these observations, we investigated whether supertype cross-reactive peptides are recognized by CTLs, when the peptides are bound by various supertype molecules. Two peptides have been reported as being recognized by CTLs in the context of more than one A3 supertype allele [see, e.g., Missale, et al, *J. Exp. Med.* 177:751 (1993); Koenig, et al, *J Immunol* 145:127 (1990); Culmann, et al, *J. Immunol* 146:1560 (1991)] (see Table 145). Using a method for in vitro induction of primary CTLs [Wentworth, et al, *Mol. Immunol.* 32:603 (1995)] we observed several instances in which peptides can be recognized in the context of both A3 and A11 [P. Wentworth and A. Sette, unpublished observations] (see TABLE 145). We tested the A3 supermotif epitopes for binding capacity to A3 supertype molecules, and noted relatively high levels of degeneracy.

Of the seven epitopes listed in TABLE 145, only one was a nonamer that could be analyzed for the extended supermotif proposed in FIG. 40 (the secondary anchors are presently understood to be unique to a given epitope length). The sole nonamer peptide was supermotif positive, and bound three of five A3-like molecules. Nonetheless, it is important to note that each of the epitopes in TABLE 145 conformed to the A3-like supertype primary anchor specifications.

Identification of A3 Supermotif-Bearing Epitopes in a Peptide Antigen.

A native protein sequence, e.g., a tumor-associated antigen, an infectious organism or a donated tissue, is screened to identify sequences that bear the A3 supermotif. In a presently preferred embodiment, the native sequence is screened using computer-based programs; such programs are written in accordance with procedures known in the art based on the A3 supermotif definition disclosed herein. The information gleaned from this analysis is used directly to evaluate the status of the native peptide, or may be utilized to subsequently generate the peptide epitope.

The information gleaned from analysis of a native peptide can be used directly to ascertain a number of characteristics. The characteristics to be ascertained will depend, as appreciated by one of ordinary skill in the art, on the type of native peptide. For example, a donor tissue for potential transplantation into a patient who bears an HLA allele of the A3 supertype can be screened to identify the prevalence of A3 supermotif epitopes in a target antigen that has been observed to be immunogenic post-transplantation; if alternative donor tissues are available, the tissue having the lowest prevalence of A3 supermotif epitopes would be chosen based on this parameter. If an infectious organism has more than one strain, an A3 epitope can be located in one strain, and then other strains of the same organism can be evaluated to determine the conservancy of that epitope throughout the strains. A given infectious organism can be evaluated sequentially; e.g., an epitope from a viral organism can be evaluated in an initial screening, and its presence tracked over time to determine if that epitope is being mutated. If a therapeutic response has been directed to the epitope this mutagenic phenomenon is referred to as viral escape and methods of identification of epitopes can be used to track this phenomenon. If a therapeutic composition is designed to be directed to an epitope, non-diseased tissues from the potential recipient can be biopsied and evaluated to determine whether the composition has potential for inducing as adverse autoimmune-type response in the recipient. Furthermore, upon identification of an epitope in a native peptide, that epitope sequence can be evaluated in accordance with the analoging disclosures presented herein and in applications from which priority is claimed.

Upon identification of an epitope in a native peptide, that epitope can be synthesized by any number of procedures in the art. The epitope can be synthesized directly, such as by chemical means, or indirectly such as by use of nucleic acids that encode the epitope. The synthesized epitope can be used to induce a therapeutic or prophylactic immune response in a recipient.

Selection of A3 Supertype Epitopes for Inclusion in a Disease-Specific Vaccine.

This example illustrates the procedure for the selection of A3 peptide epitopes for a vaccine composition of the invention.

The following principles are utilized when selecting an array of epitopes from a particular disease-related antigen, whether the epitopes are discrete in a composition, are embedded or overlapping in a native sequence, and/or to be encoded by a minigene. Such embodiments are used to create a vaccine to prophylax or treat the disease in patients who bear an HLA allele from the A3 supertype. Each of the following principles are balanced in order to make the selection.

1.) Epitopes are selected which, upon administration, mimic immune responses that have been observed to be correlated with disease clearance. For HLA Class I this includes, as an example, 3-4 epitopes that come from at least one antigen of a disease causing organism or cancer-associated antigen. In other words, this comports with a scenario where it has been observed that in patients who spontaneously clear the disease, that they had generated an immune response to at least 3 epitopes on at least one disease antigen. For HLA Class II a similar rationale is employed; again 3-4 epitopes are selected from at least one disease antigen.

2.) Epitopes are selected that have the requisite binding affinity established to be correlated with immunogenicity: for HLA Class I an $IC_{50}$ of 500 nM or less, or for Class II an $IC_{50}$ of 1000 nM or less.

3.) In this example A3 epitopes are employed that provide population coverage among patients who bear an A3 supertype allele. The following example discusses selection of epitopes to achieve even broader coverage.

4.) When selecting epitopes for disease-related antigens it can be preferable to select native epitopes; although not always the case a patient may have developed tolerance to tumor-associated antigens, whereby analogs of native epitopes may be useful, analogs are also useful for infectious disease antigens.

Therefore, of relevance as a vaccine, particularly for infectious disease vaccines, are epitopes referred to as "nested epitopes." Nested epitopes occur where at least two epitopes overlap in a given peptide sequence. A peptide comprising "transcendent nested epitopes" is a peptide that has both HLA class I and HLA class II epitopes in it.

When providing nested epitopes, a sequence that has the greatest number of epitopes per provided sequence is provided. A correlate to this principle is to avoid providing a peptide that is any longer than the amino terminus of the amino-terminal epitope and the carboxyl terminus of the carboxyl-terminal epitope in the peptide. When providing a longer peptide sequence, such as a sequence comprising nested epitopes, the sequence is screened in order to insure that it does not have pathological or other deleterious biological properties.

5.) When creating a minigene, as disclosed in greater detail in other Examples, an objective is to generate the smallest peptide possible that encompasses the epitopes of interest. The principles employed are similar, if not the same as those employed when selecting a peptide comprising nested epitopes. Thus, upon determination of the nucleic acid sequence to be provided as a minigene, the peptide encoded thereby is analyzed to determine whether any "junctional epitopes" have been created. A junctional epitope is an actual binding epitope, as predicted, e.g., by motif analysis. Junctional epitopes are to be avoided because the recipient may generate an immune response to that epitope, i.e., an epitope not found in the native disease-related antigen. Of particular concern is a junctional epitope that is a "dominant epitope." A dominant epitope may lead to such a zealous response that immune responses to other epitopes are diminished or suppressed.

A vaccine composition comprised of selected peptides, when administered, is safe, efficacious, and elicits an immune response similar in magnitude of an immune response that clears an acute HBV infection.

Selection of A3 Supertype Epitopes and Additional HLA Epitopes, to Achieve Broadened Population Coverage in a Disease-Specific Vaccine.

This example exemplifies the procedures to use to prepare a vaccine that covers a patient population that bears an A3 supertype as well as one or more patient population(s) that bear another HLA type or HLA supertype. To select such an array of epitope, a protocol such as set forth in Example 14 is employed, with the exception of a variation at parameter 3.) of that example.

In order to achieve population coverage beyond a population that bears A3 supertype alleles, A3 supermotif peptides along with peptides that bear another supermotif, or a sufficient array of allele-specific motif bearing peptides, are selected to give broadened population coverage. For example, epitopes are selected to provide at least 80% population coverage. A Monte Carlo analysis, a statistical evaluation known in the art, is employed to assess population coverage. Upon combining epitopes from, e.g., several supertypes a vaccine directed to a disease has more than 98% population coverage for 5 prevalent worldwide ethnic groups.

A Polyepitopic Vaccine Composition Derived from a Disease-Associated Peptide Antigen.

A native protein sequence, e.g., a tumor associated antigen or an infectious organism, is screened, preferably using computer programs defined to identify the presence of epitopes bearing the A3 supermotif, and optionally epitope(s) bearing one or more HLA class I and/or class II supermotif or motif, to identify "relatively short" regions of the polyprotein that comprise multiple epitopes. This relatively short sequence that contains multiple distinct, even overlapping, epitopes is selected and used to generate a minigene construct or for peptide synthesis. The minigene construct is engineered to express the peptide, which corresponds to the native protein sequence. The "relatively short" peptide is less than 100 amino acids in length, preferably less than 75 amino acids in length, and more preferably less than 50 amino acids in length. The protein sequence of the vaccine composition is selected because it has maximal number of epitopes contained within the sequence. As noted herein, epitope motifs may be overlapping (i.e., frame shifted relative to one another) with frame shifted overlapping epitopes, e.g. two 9-mer epitopes can be present in a 10 amino acid peptide. Such a vaccine composition is administered for therapeutic or prophylactic purposes.

The vaccine composition will preferably include, for example, three CTL epitopes, at least one of which is an A3 supermotif epitope, and at least one HTL epitope from the source antigen. This polyepitopic native sequence is administered either as a peptide or as a nucleic acid sequence which encodes the peptide. Alternatively, an analog can be made of this native sequence.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment directs the immune response to sequences that are present in native HBV antigens. Lastly, the embodiment provides an economy of scale when producing nucleic acid vaccine compositions.

Related to this embodiment, computer programs are used which identify, in a target sequence, the greatest number of epitopes per sequence length.

Polyepitopic Vaccine Compositions Directed to Multiple Diseases.

Peptide epitopes bearing the A3 supermotif from a first disease-related source are used in conjunction with A3 supermotif-bearing peptide epitopes from target antigens related to one or more other diseases, to create a vaccine composition that is used to prevent or treat a first disease as well as at least one other disease. Examples of infectious diseases include, but are not limited to, HIV, HBV, HCV, and HPV; examples of cancer-related antigens are CEA, HER2, MAGE and p53.

In a preferred embodiment, not only are two or more diseases targeted, but epitope(s) that bear the A3 supermotif and at least one other motif are comprised by the composition. In this preferred embodiment, the composition is used to treat multiple diseases across a genetically diverse HLA patient population.

For example, a polyepitopic peptide composition comprising multiple CTL and HTL epitopes that target greater than 98% of the population may be created for administration to individuals at risk for both HBV and HIV infection. The composition can be provided as a single polypeptide that incorporates the multiple epitopes from the various disease-associated sources.

Use of Peptides to Evaluate an Immune Response.

Peptides of the invention may be used to analyze an immune response for the presence of specific CTL populations corresponding to HBV from patients whom possess an HLA allele in the A3 supertype. Such an analysis may be performed as described by Ogg et al., *Science* 279:2103-2106, 1998. In the following example, peptides in accordance with the invention are used as a reagent for diagnostic or prognostic purposes, not as an immunogen.

In this example highly sensitive human leukocyte antigen tetrameric complexes ("tetramers") may be used for a cross-sectional analysis of, for example, HBV Env-specific CTL frequencies from untreated HLA A3 supertype-positive individuals at different stages of infection using an HBV Env peptide containing an A2.1 extended motif. Tetrameric complexes are synthesized as described (Musey et al., *N. Engl. J. Med.* 337:1267, 1997). Briefly, purified heavy chain from an HLA molecule from the A3 supertype, and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

Approximately one million PBMCs are centrifuged at 300 g for 5 minutes and resuspended in 50 ul of cold phosphate-buffered saline. Tri-color analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A3 supertype-negative individuals and A3 supertype-positive uninfected donors. The percentage of cells stained with the tetramer is then determined by flow cytometry. The results indicate the number of cells in the PBMC sample that contain epitope-restricted CTLs, thereby readily indicating the stage of infection with HBV or the status of exposure to HBV or to a vaccine that elicits a protective response.

Use of Peptide Epitopes to Evaluate Recall Responses.

The peptide epitopes of the invention are used as reagents to evaluate T cell responses such as acute or recall responses, in patients whom bear an allele from the HLA A3 supertype. Such an analysis may be performed on patients who have recovered from infection, who are chronically infected with the disease, or who have been vaccinated with a disease-protective vaccine.

For example to evaluate HBV immune status, the class I restricted CTL response of persons at risk for HBV infection who have been vaccinated may be analyzed. The vaccine may be any HBV vaccine. PBMC are collected from vaccinated individuals and HLA typed. Appropriate peptide reagents that are both highly conserved and, bear the A3 supermotif to provide cross-reactivity with multiple HLA A3 supertype family members are then used for analysis of samples derived from individuals who bear the HLA supertype.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 μg/ml), and Hepes (10 mM) containing 10% heat-inactivated human AB serum (complete RPMI) and plated using microculture formats. Synthetic peptide is added at 10 μg/ml to each well and recombinant HBc Ag is added at 1 μg/ml to each well as a source of T cell help during the first week of stimulation.

In the microculture format, $4 \times 10^5$ PBMC are stimulated with peptide in 8 replicate cultures in 96-well round bottom plate in 100 μl/well of complete RPMI. On days 3 and 10, 100 ml of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}Cr$ release, based on comparison with uninfected control subjects as previously described (Rehermann, et al., *Nature Med.* 2:1104,1108, 1996; Rehermann et al., *J. Clin. Invest.* 97:1655-65, 1996; and Rehermann et al. *J. Clin. Invest.* 98:1432-40, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-78, 1992).

Cytotoxicity assays are performed in the following manner. Target cells consist of either allogeneic HLA-matched or autologous EBV-transformed B lymphoblastoid cell line that are incubated overnight with synthetic peptide at 10 μM and labeled with 100 μCi of $^{51}Cr$ (Amersham Corp., Arlington Heights, Ill.) for 1 hour after which they are washed four times with HBSS. Cytolytic activity is determined in a standard 4-h, split well $^{51}Cr$ release assay using U-bottomed 96 well plates containing 3,000 targets/well. Stimulated PBMC are tested at E/T ratios of 20-50:1 on day 14. Percent cytotoxicity is determined from the formula: 100×[(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis will indicate to what extent HLA-restricted CTL populations have been stimulated with the vaccine. Of course, this protocol can also be used to monitor prior HBV exposure.

The above examples are provided to illustrate the invention but not to limit its scope. For example, the human terminology for the Major Histocompatibility Complex, namely HLA, is used throughout this document. It is to be appreciated that these principles can be extended to other species as well. Moreover, peptide epitopes have been disclosed in the related application U.S. Ser. No. 08/820,360, which was previously incorporated by reference. Thus, other variants of the invention will be readily apparent to one of ordinary skill in the art and are encompassed by the appended claims. All publications, patents, and patent application cited herein are hereby incorporated by reference for all purposes.

HLA Binding of Supermotifs and Extended Supermotifs.

The A3 supertype restricted epitopes were tested for binding capacity to A3 supertype molecules, and relatively high levels of cross-reactivity were noted. Of the seven epitopes listed in TABLE 145, only one was a nonamer that could be analyzed for the supermotif proposed in FIG. 40. This peptide was supermotif positive, and bound three of five A3 molecules. Nonetheless, it is important that each of the epitopes conformed to the A3 supertype primary anchor specificities.

The phenomena of HLA super types may be related to optimal exploitation of the peptide specificity of human transporter associated with antigen processing (TAP) molecules (Androlewicz, et al., *Proc. Nat'l Acad. Sci. USA* 90:9130 (1993); Androlewicz, et al., *Immunity* 1:7 (1994); van Endert, et al., *Immunity* 1:491 (1994); Heemels, et al., *Immunity* 1:775 (1994); Momburg, et al., *Curr. Opin. Immunol.* 6:32 (1994); Neefjes, et al., *Science* 261:769 (1993)). The TAP molecules have been shown to preferentially transport peptides with certain sequence features such as hydrophobic, aromatic, or positively charged C-termini.

Recent studies, performed by van Endert and associates, in collaboration with the present inventors, evaluated the relative affinities for TAP of a large collection of peptides, and have described an extended TAP binding motif (Van Endert et al. *J. Exp. Med.* 182:1883 (1995)) Strikingly, this tap motif contains many of the structural features associated with the A3 extended supermotif, such as the preference for aromatic residues at positions 3 and 7 of nonamer peptides and the absence of negatively charged residues at positions 1 and 3, and P at position 1.

HLA A3 Supertype Findings

The data from this Example demonstrate that products from at least five different HLA alleles (A3, A11, A31, A*3301, and A*6801), and likely at least three others (A*3401, A*6601, and A*7401) predicted on the basis of pocket analysis (data not shown), are properly grouped into a single functional HLA A3 supertype. This determination was made on the basis of a number of observations. As a group, these molecules: (a) share certain key structural features within their peptide-binding regions; (b) have similar preferences for the primary anchor residues in the peptides they bind, i.e., a primary supermotif present in the peptides bound by the HLA molecules of the superfamily; and (c) share largely overlapping binding repertoires. Knowledge of the A3 supermotif allows for identification of a cross-reactive peptide for a source, and allows for production of peptide analogs by substituting at primary anchor positions to alter the binding properties of the peptides.

Furthermore, by examining the binding activity of a large panel of peptides bearing the primary A3 supermotif, an extended A3 supermotif was defined. This extended supermotif was based on a detailed map of the secondary anchor requirements for binding to molecules of the A3 supertype. The extended supermotif allows for the efficient prediction of cross-reactive binding of peptides to alleles of the A3 supertype by screening the native sequence of a particular antigen. This extended supermotif is also used to select analog options for peptides which bear amino acids defined by the primary supermotif.

The discovery of the individual residues of the secondary anchor motif disclosed herein represents a significant contribution to the understanding of peptide binding to class I molecules. These secondary anchor maps were derived using peptides of homogeneous size. Thus, the preference determinations at each of the secondary positions may be more accurate than those derived from the sequencing of pools of naturally processed peptides. Also, the motifs defined herein allow the determination of residues which have deleterious or other types of effects on peptide binding.

The definition of primary and secondary anchor specificities for the A3 supertype provides guidance for modulating the binding activity of peptides that bind to members of the A3 supertype family. This information may be used to generate highly cross-reactive epitopes by identifying residues within a native peptide sequence that can be analogued to increase greater binding cross-reactivity within a supertype, or analogued to increase immunogenicity.

Example 18

Definition of HLA-A1-Specific Peptide Motifs

HLA-A1 molecules were isolated and their naturally processed peptides characterized, as described in Example 3 above. In one case using MAT cells, pooled fractions corresponding to 19% to 50% $CH_3CN$ were used. As in the preceding example, residues showing at any given position except the first position, at least a two standard deviation increase over the random expected yield were identified and shown in TABLE 74. On the basis of these data, only Serine (S) and Threonine (T) were increased at position two. At position 3, aspartic acid (D) and glutamic acid (E) were elevated and at position 9 and 10 tyrosine (Y) showed a marked increase. Other increases noted were proline (P) at position 4 and leucine (L) at position 7. Therefore, the motifs for HLA-A1 based on these data would have residues at position 2 occupied by S or T, a peptide length of 9 or 10 amino acids and a C-terminal residue of Y. Alternatively, another motif would comprise a D or E at position 3 together with a C terminal residue of Y.

Example 19

Definition of HLA-A11-Specific Peptide Motifs

HLA-A11 motifs were defined by amino acid sequence analysis of pooled HPLC fractions, in one case corresponding to 7% to 45% $CH_3CN$ of fractionated peptides eluted from HLA-A11 molecules purified from the cell line BVR. On the basis of the data presented in TABLE 75, a motif for A11 consists of a conserved residue at position 2 of threonine (T) or valine (V), a peptide length of 9 or 10 amino acids, and a C-terminal conserved residue of lysine (K). At position 3 increases in methionine (M) and phenylalanine (F) were also seen and at position 8 glutamine (Q) was increased.

Example 20

Definition of HLA-A24.1-Specific Peptide Motifs

HLA-A24.1 allele-specific motifs were defined by amino acid sequence analysis of pooled fractions in one case corresponding to 7% to 19% $CH_3CN$ of HPLC fractionated peptides eluted from HLA-A24.1 molecules purified from the cell line KT3. On the basis of the data presented in TABLE 76 a motif for HLA-A24.1 consists of a conserved residue at position 2 occupied by tyrosine (Y), a peptide length of 9 or 10 amino acids, and a C-terminal conserved residue of phenylalanine (F) or leucine (L). Increases were also observed at several other positions: isoleucine (I) and methonine (M) at position 3; aspartic acid (D), glutamic acid (E), glycine (G), lysine (K) and proline (P) at position 4; lysine (K), methonine (M) and asparagine (N) at position 5; valine (V) at position 6; asparagine (N) and valine (V) at position 7; and, alanine (A), glutamic acid (E), lysine (K), glutamine (Q) and serine (S) at position 8.

Example 21

B7 Supertype Binding

Data indicated (Sidney, et al., *J. Immunol.* 154, 247 (1995); Hill, et al., *Nature* 360:434 (1992); Falk, et al., *Immunogenetics* 38:161 (1993); Barber, et al., *Curr. Biol.* 5:179 (1995); *Schönbach*, et al. *J. Immunol.* 154:5951 (1995)) that there is a relatively large family of HLA B specificities, collectively defined as the B7 supertype. In this Example the molecular binding assays as described in Example 1 are used to examine, in detail, the primary anchor specificities (position 2 and C-terminus) of the five most frequent B7 supertype HLA alleles (B*0702, B*3501, B51, B*5301, and B*5401). The B7 supermotif was found to be characterized by peptides that have a P in position 2, and a hydrophobic or aromatic residue at the C-terminus (referred to as the B7 supermotif).

Characterization of the primary anchor specificity of B7 supertype alleles was performed utilizing a panel of single substitution analogs of the HIV nef 84-92 peptide (sequence FPVRPQVPL (SEQ ID NO:3374). HIV nef 84-92 binds HLA molecules encoded by the B*0702, B*3501, B51, B*5301, and B*5401 alleles with either high ($IC_5$450 nM) or intermediate ($IC_{50}$ 50-500 nM) affinity.

It was found that all five B7 supertype molecules share a rather stringent position 2 specificity for proline. With only one exception (A in the case of B*3501), all of the substitutions eliminating P at position 2 were associated with greater than 10-fold decreases in binding affinity as compared to the parent peptide. By contrast, each HLA-B type expressed a rather unique specificity pattern at the C-terminus. For example, B*0702 preferred M, F and L, while B*5101 preferred L, I, and V. Despite these differences, the overall C-terminal specificity patterns exhibited a large degree of overlap. All alleles shared a specificity for residues of a hydrophobic chemical nature. The aliphatic residues I and V were preferred by at least four of the five molecules, and A, L, M, F, and W were preferred or tolerated in a majority of instances. Other residues, such as Y or T, were tolerated in only isolated instances, while some (e.g., K or D) were not tolerated at all.

This primary anchor specificity data is in agreement with data of Sidney, et al., *J. Immunol.* 154:247 (1995). Thus, peptides capable of cross-reactive B7 supertype binding should have proline in position 2 and a hydrophobic or aromatic (V, I, L, M, F, W, A) residue at their C-terminus. In formally defining the B7 supertype primary anchor motifs, Y has been conservatively included despite its relative lack of cross-reactivity, because Y constitutes the dominant signal in pool sequencing analyses of B*3501 (Hill, et al., *Nature* 360:434 (1992); Falk, et al., *Immunogenetics* 38:161 (1993), *Schönbach*, et al. *J. Immunol.* 154:5951 (1995)). In summary, the primary anchor motif of the B7 supertype is defined as P at position 2, and A, I, L, M, V, F, W, and Y at the C-terminus.

Preferred Amino Acid Length of Ligands Bound by the B7 Supertype HLA Molecules.

Class I molecules usually prefer peptides between 8 and 10 residues in length (Falk, et al., *Nature* 351:290 (1991)), although longer peptides have been shown to bind (Massale, et al., *J. Exp. Med.* 177:751 (1993); Chen, et al., *J. Immunol.* 152:2874 (1994); Collins, et al. *Nature* 371:626 (1994)). To determine the optimal peptide length for binding to molecules of the B7 supertype, panels of 8-, 9-, 10- and 11-mer peptides representing naturally occurring viral, tumor, or bacterial sequences, (each peptide bore the B7 primary anchor supermotif) were synthesized and tested in binding assays.

It was concluded that 9 amino acid residues represent the optimal peptide length for all of the B7 supertype molecules examined. This assessment was true both in terms of the percent of peptides of each size bound by any molecule, but also in terms of the degree of crossreactivity observed (data not shown). Thus, this information is relevant when preparing analogs that are longer or shorter than a starting native peptide.

Extended Supermotif (Secondary Anchor Motifs) of Peptides that Bind B7 Supertype HLA Molecules.

Other residues can act as secondary anchors, thus providing supplemental binding energy to the peptides (Ruppert, et al, *Cell* 74:929-37 (1993); Madden, et al. *Cell* 75, 693-708 (1993); Saito, et al., *J. Biol. Chem.* 268, 21309 (1993); Sidney, et al., *Hu. Immunol.* 45, 79-93 (1996); Kondo, et al, *J. Immunol.* 155:4307-12 (1995); Parker, et al., *J. Immunol.* 152, 163-75 (1994)). It has also been shown that certain residues can have negative effects on peptide binding to class I molecules (Ruppert, et al, *Cell* 74:929-37 (1993); Sidney, et al., *Hu. Immunol.*, 45, 79-93 (1996); Kondo, et al, *J. Immunol.* 155:4307-12 (1995), Boehncke, et al., *J. Immunol.* 150, 331-41 (1993)).

To develop an extended B7 supermotif allowing the efficient selection of peptides with cross-reactive B7 supertype binding, secondary anchors and secondary effects involved in peptide binding to B7 supertype molecules were defined in accordance with the methods described herein.

The binding capacity of 199 nonamer peptides for the five most common B7 supertype molecules, B*0702, B*3501, B51, B*5301, and B*5401 was determined, and the data analyzed. The 199 nonamer peptides represented naturally occurring viral sequences containing the B7 supertype primary anchors (proline in position 2, and A, V, I, L, M, F, and W at the C-terminus). For each position the average relative binding capacity (ARBC) of peptides carrying each of the 20 amino acids was calculated and compared to the ARBC of the entire peptide set. The occurrence of certain amino acids is very infrequent, thus, residues were grouped according to individual chemical similarities as previously described (Ruppert, et al, *Cell* 74:929 (1993)). This analysis was performed separately for B*0702, B*3501, B51, B*5301, and B*5401.

It was found that the patterns of preferences and aversions, in terms of secondary anchors, exhibited by each molecule were unique. For example, in the panel tested, 18 peptides had positively charged residues (R, H or K) in position 1. These peptides, as a group, were very good B*0702 binders, having an ARBC of 21. For B51, however, the same peptides were relatively poor binders, with an ARBC of 0.25. However, profound similarities in preferences were noted. For example, peptides bearing aromatic residues (F, W, and Y) in position one were, as a group, very good binders across the set of B7 supertype molecules, with ARBC of 4.2, 17, 16, 20, and 70 for B*0702, B*3501, B51, B*5301, and B*5401, respectively.

Figure 41:
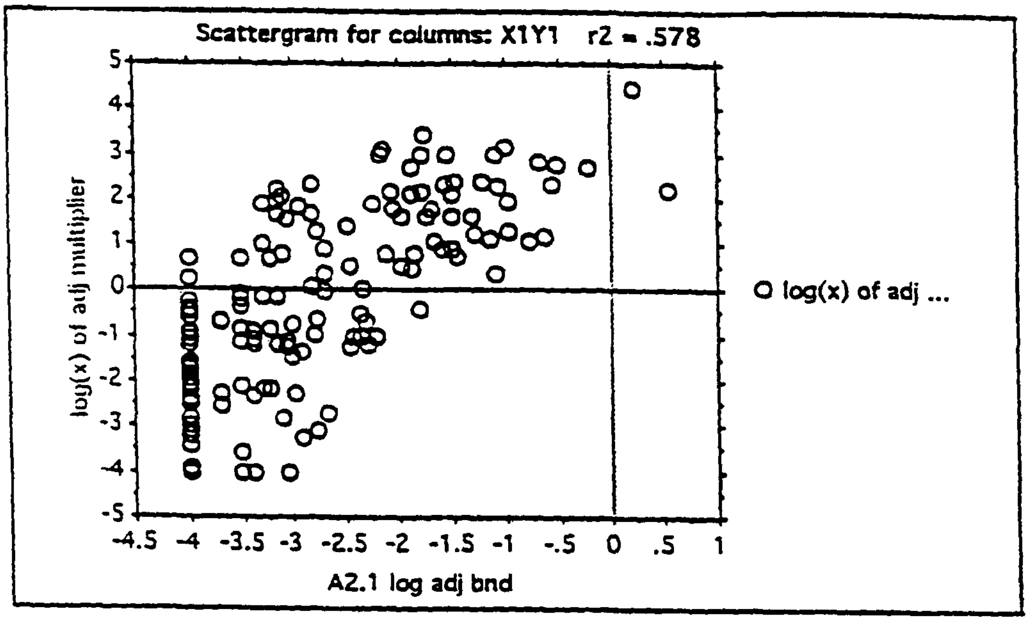
FIG. 41 and FIG. 42 show scattergrams of a set of 10-mer peptides containing preferred residues in positions 2 and 10 as scored by the "Grouped Ratio" and "Log of Binding" algorithms.

The values discussed above were subsequently used to derive maps of allele-specific secondary anchor requirements for each position. To do this, preferred and deleterious residues were defined as residues associated with ARBCs that were 3-fold greater than, or 3-fold less than, respectively, the overall average. These preferred and deleterious effects are summarized in FIG. 41. These secondary anchor maps reveal that while each molecule exhibited its own unique secondary anchor requirements, certain features were highly conserved amongst the B7 supertype molecules. For example, as indicated above, aromatic residues (F, W, and Y) at position 1 were preferred by all five of the B7 supertype molecules. Conversely, at position 8, acidic residues (D, E) were associated with poor binding capacity for four of five molecules.

Secondary effects preferred by three or more of the five B7 supertype molecules considered, were defined as shared. Shared positive (preferred) effects were defined only if not deleterious for any molecule. Conversely shared deleterious effects could not be positive for any molecule. These shared features were incorporated into an extended B7 supermotif which defined residues associated with either poor or good binding in a majority of the molecules of the B7 supertype.

Following this rationale, it was found that peptides bearing supermotif preferred secondary residues exhibited a greater degree of B7 supertype cross-reactivity than those which bear none, or which bear deleterious residues. This finding was established by determining the binding cross-reactivity of an independent set of peptides bearing the B7 supertype primary anchor specificity. As predicted, peptides which were extended supermotif positive (i.e., peptides with at least one extended supermotif preferred secondary residues, and no deleterious residues) exhibited a substantially greater degree of crossreactivity within the B7 supertype than supermotif negative peptides (peptides with one or more supermotif deleterious residues).

Implementation of the B7 Supermotif to Improve the Binding Capacity of Native Peptides by Creating Analogs.

HLA supermotifs (both primary and extended) are of value in predicting highly cross-reactive native peptides, as demonstrated herein. Moreover, definition of HLA supermotifs also allows one to engineer highly crossreactive "degenerate" epitopes by identifying residues within a native peptide sequence which can be analogued, or "fixed", to confer upon a peptide certain characteristics, e.g., greater binding cross-reactivity within the supertype.

To assess this possibility, six peptides which had been shown to have a high degree of degeneracy within the B7-like supertype were selected (TABLE 144). Each peptide already bound at least three of the five most common B7-like molecules with either high ($IC_{50}$<50 nM) or intermediate ($IC_{50}$ 50-500 nM) affinities. These peptides were analyzed in the context of both the B7-like supermotif and the allele specific secondary anchor motifs described above to determine if particular residues within their sequences could be "fixed" to further increase their binding to the B7-like supertype molecules. This assessment found that none of the particular peptides considered contained a supermotif negative residue. Three peptides (HCV core 168, MAGE 2170, and MAGE 3 196) each had one residue which was deleterious for a single B7-like molecule (TABLE 144).

Next, a panel of single substituted analogs was synthesized. Some analogs contained secondary anchor substitutions which were either supermotif positive, or positive in the context of a particular allele without being deleterious for any other substitutions were selected on the basis of the values disclosed here. Because the preferences for the C-terminal primary anchors were unique for each allele, substitutions at this position were also considered. Thus, for example, to test if degeneracy could be increased a number of analogs were made by substituting the supermotif positive F for the native residue in position 1. Other substitutions, such as the C-terminal L for Y in HBV pol 541 were made to address poor binding of the parent peptide to B*0702 and B*5401. When this panel was tested for its binding capacity to molecules of the B7-like supertype, the data shown in TABLE 144 was generated. In every case, an F substitution in position one exhibited increased binding and/or degeneracy compared to the parent sequence. For example, MAGE 2 170 bound with high affinity to B*0702, intermediate affinity to B*3501, B51, and B*5301, but only weakly to B*5401. The F1 analog of this peptide bound all five of these molecules with high affinity.

The success of substitutions aimed at specific molecules were much harder to generalize. For example, the substitution of L at the C-terminus of HBV pol 541 for the native Y was successful in conferring binding to B*0702 while increasing the binding affinity to other molecules (significantly in the cases of B51 and B*5401). In other instances, the effect observed was not as anticipated, as demonstrated by the case of HBV env 313. This peptide bound with high affinity to B*0702, B*3501, B51, and B*5301, but only weakly to B*5401. An M in 5 analog was made to increase B*5401 binding based on the observation that the aliphatic residues (L, I, V, and M) in position 5 were positive for B*5401, and relatively neutral for other molecules. As shown in TABLE 144, however, the significantly increased B*5401 binding capacity achieved with the M5 analog was at the expense of lowered binding to B*0702, B51, and B*5301. While the success of individual analogs was variable, it is notable that for each case at least one analog was capable of either improving the binding affinity, or extending the degeneracy of the parent peptide. Thus, already degenerate peptides can be discretely "fixed" to improve their binding capacity and extend their degeneracy.

For example, analogs representing primary anchor single amino acid substitutions to I at the C-terminus of two different B7-like peptides (HBV env 313 and HB pol 541) were synthesized and tested for their B7-supertype binding capacity. It was found that the I substitution had an overall positive effect on binding affinity and/or cross-reactivity in both cases. In the case of HBV env 313 the 19 replacement was effective in increasing cross-reactivity from 4 to 5 alleles bound by virtue of an almost 400-fold increase B*5401 binding affinity. In the case of HBV pol 541, increased cross-reactivity was similarly achieved by a substantial increase in B*5401 binding. Also, significant gains in binding affinity for B*0702, B51, and B*5301 were observed with the HBV pol 541 I9 analog.

Thus, HLA supermotifs are of value in engineering highly cross-reactive peptides by identifying particular residues at secondary anchor positions that are associated with such cross-reactive properties. To demonstrate this, the capacity of a second set of peptides representing discreet single amino acid substitutions at positions one and three of five different B7-supertype binding peptides were synthesized and tested for their B-7 supertype binding capacity. In 4/4 cases the effect of replacing the native residue at position 1 with the aromatic residue F (an "F1" substitution) resulted in an increase in cross-reactivity, compared to the parent peptide, and, in most instances, binding affinity was increased three-fold or better (TABLE 146). More specifically, for HBV env 313, MAGE2 170, and HCV core 168 complete supertype cross-reactivity was achieved with the F1 substitution analogs. These gains were achieved by dramatically increasing B*5401 binding affinity. Also, gains in affinity were noted for other alleles in the cases of HCV core 168 (B*3501 and B*5301) and MAGE2 170 (B*3501, B51 and B*5301). Finally, in the case of MAGE3 196, the F1 replacement was effective in increasing cross-reactivity because of gains in B*0702 binding. An almost 70-fold increase in B51 binding capacity was also noted.

Two analogs were also made using the supermotif positive F substitution at position three (an "F3" substitution). In both instances increases in binding affinity and cross-reactivity were achieved. Specifically, in the case of HBV pol 541, the F3 substitution was effective in increasing cross-reactivity by virtue of its effect on B*5401 binding. In the case of MAGE3 196, complete supertype cross-reactivity was achieved by increasing B*0702 and B*3501 binding capacity. Also, in the case of MAGE3 196, it is notable that increases in binding capacity between 40 and 5000-fold were obtained for B*3501, B51, B*5301, and B*5401.

In conclusion, these data demonstrate that by the use of single amino acid substitutions it is possible to increase the binding affinity and/or cross-reactivity of peptide ligands for HLA B7 supertype molecules.

Example 22

Identification of Immunogenic Peptides

To identify peptides of the invention, class I antigen isolation, and isolation and sequencing of naturally processed peptides was carried out as described above and in the parent applications. These peptides were then used to define specific binding motifs for each of the following alleles A3.2, A1, A11, and A24.1. These motifs are described above. The motifs described in TABLE 73, TABLE 74, TABLE 75, and TABLE 76, below, are defined from pool sequencing data of naturally processed peptides as described in the related applications. These motifs are described in the parent applications and summarized in TABLE 73, TABLE 74, TABLE 75, and TABLE 76, below.

Using the motifs identified above for various MHC class I allele amino acid sequences from various pathogens and tumor-related proteins were analyzed for the presence of these motifs. Screening was carried out described in the related applications. TABLE 11 provides the results of searches of the antigens.

The peptides listed in TABLES 81-84 were identified as described above and are grouped according to pathogen or antigen from which they were derived.

Using the B7-like-supermotifs identified in the parent applications described above, sequences from potential antigenic sources including Hepatitis B Virus (HBV), Hepatitis C Virus (HCV), Human Papilloma Virus (HPV), Human Immunodeficiency Virus (HIV), MAGE2/3, and *Plasmodium* were analyzed for the presence of these motifs.

In some embodiments, sequences for the target antigens were obtained from the current GenBank data base. In certain embodiments, sequences for the target antigens were obtained from the GenBank database (Release No. 71.0; 3/92). The identification of motifs was done using the "FIND-PATTERNS" program (Devereux, et al., *Nucleic Acids Research,* 12:387-95 (1984)). A computer search was carried out for antigen proteins comprising the B7-like-supermotif. TABLES 77-80, TABLES 81-84, and TABLES 85-86 provide the results of searches of the antigens. TABLES 77-80 and TABLES 85-86 shows results of screening a number of antigens. TABLES 81-84 shows results of screening MAGE antigens.

TABLE 25 and TABLE 34 list peptides identified in this search. Accordingly, a preferred embodiment of the invention comprises a composition comprising a peptide of TABLE 25 and/or TABLE 34.

Other viral and tumor-related proteins can also be analyzed for the presence of these motifs. The amino acid sequence or the nucleotide sequence encoding products is obtained from the GenBank database in the cases of Prostate Specific antigen (PSA), p53 oncogene, Epstein Barr Nuclear Antigen-1 (EBNA-1), and c-erb2 oncogene (also called HER-2/neu).

In the cases of Human Papilloma Virus (HPV), Prostate Specific Antigen (PSA), p53 oncogene, Epstein Barr Nuclear Antigen-1 (EBNA-1), and c-erb2 oncogene (also called HER-2/neu), and Melanoma Antigen-1 (MAGE-1), a single sequence exists.

In the cases of Hepatitis B Virus (HBV), Hepatitis C Virus (HCV), and Human Immunodeficiency Virus (HIV) several strains/isolates exist and many sequences have been placed in GenBank.

For HBV, binding motifs are identified for the adr, adw and ayw types. In order to avoid replication of identical sequences, all of the adr motifs and only those motifs from adw and ayw that are not present in adr are added to the list of peptides.

In the case of HCV, a consensus sequence from residue 1 to residue 782 is derived from 9 viral isolates. Motifs are identified on those regions that have no or very little (one residue) variation between the 9 isolates. The sequences of residues 783 to 3010 from 5 viral isolates were also analyzed. Motifs common to all the isolates are identified and added to the peptide list.

Finally, a consensus sequence for HIV type 1 for North American viral isolates (10-12 viruses) was obtained from the Los Alamos National Laboratory database (May 1991 release) and analyzed in order to identify motifs that are constant throughout most viral isolates. Motifs that bear a small degree of variation (one residue, in 2 forms) were also added to the peptide list.

Using the B7-like supermotifs identified in the related applications described above, sequences from various pathogens and tumor-related proteins were analyzed for the presence of these motifs. Screening was carried out described in the related applications. TABLES 12 and 13 provide the results of searches of the antigens.

Using the A3 supermotif described above, sequences from various pathogens and tumor-related proteins were analyzed for the presence of these motifs. Screening was carried out described in the related applications. TABLE 8 provides the results of searches of the antigens.

Using the A24 motif described above, sequences from various pathogens and tumor-related proteins were analyzed for the presence of these motifs. Screening was carried out described in the related applications. TABLE 9 provides the results of searches of t1 antigens.

Several motifs for each allele shown below were used to screen several antigens. Protein E6 of human papilloma virus (HPV) type 16 using motifs from all of the alleles disclosed above are shown (TABLES 77-80). Protein E7 of HPV type 18 was also searched for motifs from all alleles (TABLES 77-80) Melanoma antigens MAGE 1, 2 and 3 were searched for motifs from all alleles (TABLES 81-84). The antigen PSA was searched for motifs from all alleles (TABLES 85-86). Finally, core and envelope proteins from hepatitis C virus were also searched (TABLE 87). In the tables and the description of the motifs, the conventional symbol letter for each amino acid was used. The letter "X" represents a wild card character (any amino acid).

The following motifs were screened in the present search:

| | |
|---|---|
| | For HLA-A1 (A*0101) |
| 1 | XSXXXXXXY (SEQ ID NO: 14594) |
| 2 | XSXXXXXXXY (SEQ ID NO: 95) |
| 3 | XTXXXXXXY (SEQ ID NO: 96) |
| 4 | XTXXXXXXXY (SEQ ID NO: 97) |
| 5 | XXDXXXXXY (SEQ ID NO: 98) |
| 6 | XXDXXXXXXY (SEQ ID NO: 99) |
| 7 | XXEXXXXXY (SEQ ID NO: 14600) |
| 8 | XXEXXXXXXY (SEQ ID NO: 1) |
| | For HLA-A3.2 (A*0301) |
| 1 | XVXXXXXXK (SEQ ID NO: 2) |
| 2 | XVXXXXXXXK (SEQ ID NO: 3) |
| 3 | XLXXXXXXK (SEQ ID NO: 4) |
| 4 | XLXXXXXXXK (SEQ ID NO: 5) |
| 5 | XMXXXXXXK (SEQ ID NO: 6) |
| 6 | XMXXXXXXXK (SEQ ID NO: 7) |
| | For HLA-A11 (A*1101) |
| 1 | XTXXXXXXK (SEQ ID NO: 8) |
| 2 | XTXXXXXXXK (SEQ ID NO: 9) |
| 3 | XVXXXXXXK (SEQ ID NO: 10) |
| 4 | XVXXXXXXXK (SEQ ID NO: 11) |
| | For HLA-A24.1 (A*2401) |
| 1 | XYXXXXXXF (SEQ ID NO: 12) |
| 2 | XYXXXXXXXF (SEQ ID NO: 13) |
| 3 | XYXXXXXXL (SEQ ID NO: 14) |
| 4 | XYXXXXXXXL (SEQ ID NO: 15) |

Brief Description of TABLES 9-21

TABLES 9 and 10. Identified HLA-AI allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues.

TABLE 11. Binding affinity of HLA-A1 binding peptides. Peptides are identified by amino acid sequence, SEQ ID NO., and binding affinity to the designated HLA-A1 alleles (expressed as an ICso).

TABLE 12. Identified HLA-A2 allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues.

TABLE 13. Binding affinity of HLA-A2 binding peptides. Peptides are identified by amino acid sequence, SEQ ID NO., and binding affinity to the designated HLA-A2 alleles (expressed as an ICso).

TABLE 14. Identified HLA-A3 allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues. Binding affinity of HLA-A3 binding peptides. Peptides are identified by amino acid sequence, SEQ ID NO., and binding affinity to the designated HLA-A3 alleles (expressed as an $IC_{50}$).

TABLE 15. Identified HLA-A24 allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues. Binding affinity of HLA-A24 binding peptides. Peptides are identified by amino acid sequence, SEQ ID NO., and binding affinity to the designated HLA-A24 alleles (expressed as an $IC_{50}$).

TABLE 16. Identified HLA-B7 allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues. Binding affinity of HLA-B7 binding peptides. Peptides are identified by amino acid sequence, SEQ ID NO., and binding affinity to the designated HLA-B7 alleles (expressed as an $IC_{50}$).

TABLE 17. Identified HLA-B44 allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues. Binding affinity of HLA-B44 binding peptides. Peptides are identified by amino acid sequence, SEQ ID NO., and binding affinity to the designated HLA-B44 alleles (expressed as an $IC_{50}$).

TABLE 18. Identified HLA-DQ allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues. Binding affinity of HLA-DQ binding peptides. Peptides are identified by amino acid sequence, SEQ ID NO., and binding affinity to the designated HLA-DQ alleles (expressed as an $IC_{50}$).

TABLES 19 and 186. Identified HLA-DR allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues. Binding affinity of HLA-DR binding peptides. Peptides are identified by amino acid sequence, SEQ ID NO., and binding affinity to the designated HLA-DR alleles (expressed as an $IC_{50}$).

TABLE 20. Identified murine MHC class I allele-binding peptides. Peptides are identified by amino acid sequence, SEQ ID NO., number of amino acids in peptide (AA), origin of peptide (organism), identity of originating protein, position of peptide within protein sequence, and analog status, wherein an analog is a peptide of the invention where the amino acid sequence of any naturally-occurring peptide sequence has been modified by substitution of one or more amino acid residues.

TABLE 21. Binding affinity of muring MHC class I-binding peptides. Peptides are identified by amino acid sequence, SEQ ID NO., and binding affinity to the designated murine MHC class I alleles (expressed as an $IC_{50}$).

Example 23

Additional Identification of Immunogenic Peptides

Using the motifs identified above for HLA-A2.1 allele amino acid sequences from a tumor-related protein, Melanoma Antigen-1 (MAGE-1), were analyzed for the presence of these motifs. Sequences for the target antigen are obtained from the GenBank data base (Release No. 71.0; 3/92). The identification of motifs is done using the "FINDPATTERNS" program (Devereux et al., *Nucleic Acids Research* 12:387-395 (1984)).

Other viral and tumor-related proteins can also be analyzed for the presence of these motifs. The amino acid sequence or the nucleotide sequence encoding products is obtained from the GenBank database in the cases of Human Papilloma Virus (HPV), Prostate Specific antigen (PSA), p53 oncogene, Epstein Ban Nuclear Antigen-1 (EBNA-1), and c-erb2 oncogene (also called HER-2/neu).

In the cases of Hepatitis B Virus (HBV), Hepatitis C Virus (HCV), and Human Immunodeficiency Virus (HIV) several strains/isolates exist and many sequences have been placed in GenBank.

For HBV, binding motifs are identified for the adr, adw and ayw types. In order to avoid replication of identical sequences, all of the adr motifs and only those motifs from adw and ayw that are not present in adr are added to the list of peptides.

In the case of HCV, a consensus sequence from residue 1 to residue 782 is derived from 9 viral isolates. Motifs are identified on those regions that have no or very little (one residue) variation between the 9 isolates. The sequences of residues 783 to 3010 from 5 viral isolates were also analyzed. Motifs common to all the isolates are identified and added to the peptide list.

Finally, a consensus sequence for HIV type 1 for North American viral isolates (10-12 viruses) was obtained from the Los Alamos National Laboratory database (May 1991 release) and analyzed in order to identify motifs that are constant throughout most viral isolates. Motifs that bear a small degree of variation (one residue, in 2 forms) were also added to the peptide list.

TABLES 181 and 182 provide the results of searches of the following antigens cERB2, EBNA1, HBV, HCV, HIV, HPV, MAGE, p53, and PSA. Only peptides with binding affinity of at least 1% as compared to the standard peptide in assays described in Example 5 are presented. Binding as compared to the standard peptide is shown in the far right column. The column labeled "Pos." indicates the position in the antigenic protein at which the sequence occurs.

Using the motifs disclosed here, amino acid sequences from various antigens were screened for further motifs. Screening was carried out as described above. TABLES 176 and TABLE 177 provide the results of searches of the following antigens cERB2, CMV, Influenza A, HBV, HIV, HPV, MAGE, p53, PSA, Hu S3 ribosomal protein, LCMV, and PAP. Only peptides with binding affinity of at least 1% as compared to the standard peptide in assays described in Example 5 are presented. Binding as compared to the standard peptide is shown for each peptide.

Example 24

Identification of Immunogenic Peptides in Autoantigens

As noted above, the motifs of the present invention can also be screened in antigens associated with autoimmune diseases. Using the motifs identified above for HLA-A2.1 allele amino acid sequences from myelin proteolipid (PLP), myelin basic protein (MBP), glutamic acid decarboxylase (GAD), and human collagen types II and IV were analyzed for the presence of these motifs. Sequences for the antigens were obtained from Trifilieff et al., *C.R. Sceances Acad. Sci.* 300:241 (1985); Eyler at al., *J Biol. Chem.* 246:5770 (1971); Yamashita et al. *Biochiem. Biophys. Res. Comm.* 192:1347 (1993); Su et al., *Nucleic Acids Res.* 17:9473 (1989) and Pihlajaniemi et al. *Proc. Natl. Acad. Sci. USA* 84:940 (1987). The identification of motifs was done using the approach described in Example 5 and the algorithms of Examples 6 and 7. TABLE 178 provides the results of the search of these antigens.

Using the quantitative binding assays of Example 4, the peptides are next tested for the ability to bind MHC molecules. The ability of the peptides to suppress proliferative responses in autoreactive T cells is carried out using standard assays for T cell proliferation. For instance, methods as described by Miller et al. *Proc. Natl. Acad. Sci. USA,* 89:421 (1992) are suitable.

For further study, animal models of autoimmune disease can be used to demonstrate the efficacy of peptides of the invention. For instance, in HLA transgenic mice, autoimmune model diseases can be induced by injection of MBP, PLP or spinal cord homogenate (for MS), collagen (for arthritis). In addition, some mice become spontaneously affected by autoimmune disease (e.g., NOD mice in diabetes). Peptides of the invention are injected into the appropriate animals, to identify preferred peptides.

Example 25

Comparative Treatment of Data Obtained in Different Binding Analyses

HLA class I supermotif and motif analysis of antigens of interest was performed as described herein and in the related applications, noted above. Peptides comprising the appropriate HLA I motif or supermotif were then synthesized and assayed for binding activity. A detailed description of the protocol utilized to measure the binding of peptides to Class I and Class II MHC has been published (Sette et al., Mol. Immunol. 31:813, 1994; Sidney et al., in Current Protocols in Immunology, Margulies, Ed., John Wiley & Sons, New York, Section 18.3, 1998).

Since under these conditions [label]<[HLA] and $IC_{50}\geq$ [HLA], the measured $IC_{50}$ values are reasonable approximations of the true $K_D$ values. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation has proven to be the most accurate and consistent for comparing peptides that have been tested on different days, or with different lots of purified MHC.

HLA class I supermotif and motif-bearing peptides from HIV regulatory proteins, e.g., nef, rev, vif, tat, and vpr, are shown in TABLE 70, TABLE 71, TABLE 72, TABLE 73, TABLE 74, TABLE 75, TABLE 76, TABLES 77-80, TABLES 81-84, and TABLES 85-86. In these tables, "% conserv" refers to percent conservance, which is the degree to which the sequences are conserved in the strains evaluated to identify the sequences. The "A" designation indicates that the peptide is an analog of the native sequence. In the motif column, the designation "i" refers to individual motif and "s" refers to supermotif.

HLA class I supermotif and motif-bearing peptides from other antigens, e.g., cancer antigens such as CEA, p53, Her2/neu, MART1, MAGE2, MAGE3, tyrosinase, flu, gp100, HBV, HCV, HIV, HPV (including the strain designation), Epstein Barr Virus (EBV), prostate cancer-associated antigens, gliadin, *Mycobacterium leprae, Mycobacterium tuberculosis, T. cruzi, Candida* antigens, and malaria (*Plasmodium falciparum*) antigens are shown in TABLE 87, TABLE 88, TABLE 89, TABLE 90, TABLES 91-92, TABLES 93-94, TABLE 95, TABLE 96, TABLES 97-102, TABLES 103-107, TABLES 108-110, TABLES 111-122 and TABLES 123-124.

TABLE 87, TABLE 88 and TABLE 187 show peptides bearing an HLA-A1 supermotif and/or motif.

TABLE 89, TABLE 90, TABLES 91-92, TABLES 93-94 and TABLE 188 show peptides bearing an HLA-A2 supermotif.

TABLE 95, TABLE 96 and TABLE 189 show peptides bearing an HLA-A3 supermotif and/or motif.

TABLES 97-102 and TABLES 103-107 show peptides bearing an HLA-A24 supermotif and/or motif.

TABLES 108-110 and TABLES 111-122 show peptides bearing an HLA-B7 supermotif.

TABLE 123-124 shows peptides bearing an HLA-B44 supermotif.

Peptide binding data for the designated HLA molecules are provided as $IC_{50}$ values unless otherwise indicated. The "A" designation indicates that the peptide is an analog of the native sequence.

Using the HLA class II supermotif and motifs identified in related applications and as described above, sequences from various pathogens and tumor-related proteins were analyzed for the presence of these motifs. Screening and binding assays was carried out as described in the related applications designated herein.

HLA class II DR supermotif and DR3 motif-bearing peptides from HIV regulatory proteins, e.g., nef, rev, vif, tat, and vpr, are shown in TABLES 125-127 and TABLE 136. The term "% conserv" refers to percent conservance, which is the degree to which the sequences are conserved in the strains evaluated to identify the sequences. In TABLE 136, in the "sequence" column, the core sequence of the motif-bearing peptide is in lower case.

TABLES 128, TABLES 129-130, TABLES 131-132, TABLES 133-134, TABLES 135, and TABLES 136 show HLA class II DR supermotif and DR 3 motif bearing peptides and the antigens from which they are derived. The peptide reference number, sequence, antigen protein/position of the sequence in the antigen, and binding data are shown in the tables. TABLE 129 shows binding data for DRB1*0101, *0301, *0401, *0404, and *0405. TABLE 130 shows binding data for DRB1*0701, *0802, *0901, *1101, *1201, *1302, *1501, DRB3*0101, DRB4*0101, DRB5*0101, and DQB1*0301. TABLE 131 and TABLE 133 provide the peptide reference number sequence and protein antigen/position of sequence in antigen for the peptides. Binding data are provided in TABLE 132 and TABLE 134.

Peptide binding data for the designated HLA molecules are provided as $IC_{50}$ values unless otherwise indicated. The "A" designation indicates that the peptide is an analog of the native sequence.

Example 26

Quantitative Binding Assays

To verify that motif-containing peptide sequences are indeed capable of binding to the appropriate class I molecules, quantitative binding assays were performed as described in the parent applications. Binding affinities are expressed in reference to standard peptides as described in those applications. In addition, these applications describe algorithms to provide a more exact predictor of binding based upon the effects of different residues at each position of a peptide sequence, in addition to the anchor or conserved residues.

Using isolated MHC molecules prepared as described in Example 2, supra, quantitative binding assays were performed. Briefly, indicated amounts of MHC as isolated above were incubated in 0.05% NP40-PBS with ~5 nM of radiolabeled peptides in the presence of 1-3 μM $\beta_2M$ and a cocktail of protease inhibitors (final concentrations 1 mM PMSF, 1.3 mM 1.10 Phenanthroline, 73 μM Pepstatin A, 8 mM EDTA, 200 μM N-α-p-tosyl-L-Lysine Chloromethyl ketone). After various times, free and bound peptides were separated by TSK 2000 gel filtration, as described previously in Sette, et al., *J. Immunol.,* 148:844 (1992). Peptides were labeled by the use of the Chloramine T method Buus et al., *Science,* 235: 1352 (1987), which is incorporated herein by reference.

The various candidate HLA binding peptides were radiolabeled and offered (5-10 nM) to 1 μM purified HLA molecules. The HBc 18-27 peptide HLA binding peptide was radiolabeled and offered (5-10 nM) to 1 μM purified HLA A2.1. After two days at 23° C. in presence of a cocktail of protease inhibitors and 1-3 μM purified human $\beta_2M$, the percent of MHC class I bound radioactivity was measured by size exclusion chromatography, as previously described for class II peptide binding assays in Sette, et al., in *Seminars in Immunology*, Vol. 3, Gefter, ed. (W.B. Saunders, Philadelphia, 1991), pp 195-202, which is incorporated herein by reference. Using this protocol, high binding (30-95% of standard peptide binding) was detected in all cases in the presence, but not in the absence, of the relevant HLA allele. Also using this protocol, high binding (95%) was detected in all cases in the presence of purified HLA A2.1 molecules.

To explore the specificity of binding, we determined whether the binding was inhibitable by excess unlabeled peptide, and if so, what the 50% inhibitory concentration ($IC_{50}$%) might be. The rationale for this experiment was threefold. First, such an experiment is crucial in order to demonstrate specificity. Second, a sensitive inhibition assay is the most viable alternative for a high throughput quantitative binding assay. Third, inhibition data subjected to Scatchard analysis can give quantitative estimates of the K of interaction and the fraction of receptor molecules capable of binding ligand (% occupancy).

Results of binding assays described here may be expressed in terms of $IC_{50}$'s. Given the conditions in which our assays are run (i.e., limiting MHC and labeled peptide concentrations), these values approximate $K_D$ values. It should be noted that $IC_{50}$ values can change, often dramatically, if the assay conditions are varied, and depending on the particular reagents used (e.g., Class I preparation, etc.). For example, excessive concentrations of MHC will increase the apparent measured $IC_{50}$ of a given ligand.

As a specific example to verify that motif-containing peptide sequences are indeed capable of binding to the appropriate class I molecules, specific binding assays were established. HLA-A3.2 molecules were purified from GM3107 EBV cells by affinity chromatography using the GAPA3 mAb (anti-A3) to isolate A3.2. Prior to the step, the lysate was depleted of HLA B and C molecules by repeated passages over a B1.23.2 column (this antibody is B, C specific) generally as described in Example 2, above.

As a radiolabeled probe, the peptide 941.12 (KVFPYALINK (SEQ ID NO:14625)), containing an A3.2 motif, was used. This peptide contains the anchor residues $V_2$ and $K_{10}$, associated with A3.2-specific binders, described above. A Y residue was inserted at position 5 to allow for radiolodination. Peptides were labeled by the use of the Chloramine T method Buus et al., *Science* 235:1352 (1987), which is incorporated herein by reference.

Figure 17:
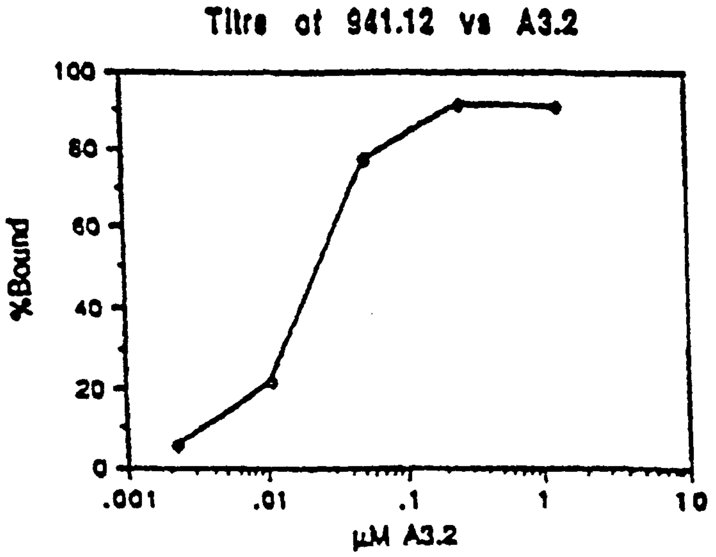
FIG. 17 shows binding of a radioactively labeled peptide of the invention to MHC molecules as measured by the bound radioactivity.

A dose range of purified A3.2 was incubated with 10 nM of 941.12 at pH 7.0 and 23° C., in presence of a protease inhibitor cocktail (1 mM PMSF, 1.3 mM 1.10 phenanthroline, 73 μM pepstatin A, 8 mM EDTA, and 200 μM N $a_p$-tosyl-L-lysine chloromethyl ketone (TLCK)), in presence of 1 μM purified human β2 microglobulin. After two days, the % bound radioactivity was measured by gel filtration over TSK 2000 columns as previously described for class II peptide binding assays in Sette et al., in *Seminars in Immunology*, Vol. 3, Gefter, ed. (W.B. Saunders, Philadelphia, 1991), pp 195-202, which is incorporated herein by reference. (see, FIG. 17). Good binding (in the 60 to 100% range) was observed for A3.2 concentrations ranging between 35 and 300 nM. 30% binding was observed at 15 nM A3.2.

Figure 18:
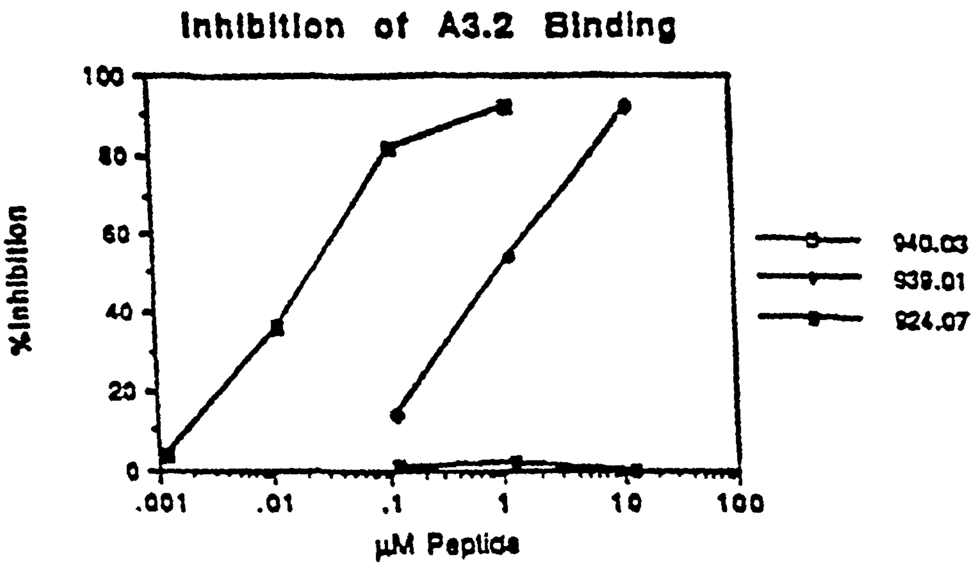
FIG. 18 shows inhibition of binding of a peptide of the invention to MHC molecules in the presence of three peptides (HBc 18-27 (92-4-07), a Prostate Specific Antigen peptide (939.01), and HIV nef 73-82 (940.03)).

To minimize A3.2 usage and to increase the sensitivity of the assay, a concentration of 5-10 nM A3.2 was selected for further assays. In the experiment shown in FIG. 18, 7 nM A3.2 and an equivalent concentration of radiolabeled 941.12 were incubated using the conditions described above and in the presence of a dose range of three peptides (HBc 18-27 (924.07), a Prostate Specific Antigen peptide (939.01), and HIV nef 73-82 (940.03)). It was found that peptide 940.03 inhibited strongly, with a 50% inhibitory concentration (IC50%) of 22 nM, while a weaker inhibition was observed with peptide 939.01 (IC50% 940 nM). Finally, peptide 924.07 did not show any inhibition up to the 30 μM level. Thus, it is concluded that peptides 940.03 and 939.01 are high and intermediate affinity binders, respectively, while peptide 924.07 is classified as a low affinity or negative binder.

For instance, in analysis of an inhibition curve for the interaction of the peptide HBc 18-27 with A2.1, the $IC_{50}$% was determined to be 25 nM. Further experiments were conducted to obtain Scatchard plots. For HBc 18-27/A2.1, six different experiments using six independent MHC preparations yielded a $K_D$ of $15.5\pm9.9\times10^{-9}$ M and occupancy values of 6.2% (±1.4).

Several reports have demonstrated that class I molecules, unlike class II, are highly selective with regard to the size of the peptide epitope that they recognize. The optimal size varies between 8 and 10 residues for different peptides and different class I molecules, although MHC binding peptides as long as 13 residues have been identified. To verify the stringent size requirement, a series of N- and C-terminal truncation/extension analogs of the peptide HBc 18-27 were synthesized and tested for A2.1 binding. Previous studies had demonstrated that the optimal size for CTL recognition of this peptide was the 10-mer HBc18-27 (Sette et al. supra). It was found that removal or addition of a residue at the C terminus of the molecule resulted in a 30 to 100-fold decrease in binding capacity. Further removal or addition of another residue completely obliterated binding. Similarly, at the N-terminus of the molecule, removal or deletion of one residue from the optimal HBc 18-27 peptide completely abrogated A2.1 binding.

Throughout this disclosure, results have been expressed in terms of $IC_{50}$'s. Given the conditions in which the assays are run (i.e., limiting MHC and labeled peptide concentrations), these values approximate $K_D$ values. It should be noted that $IC_{50}$ values can change, often dramatically, if the assay conditions are varied, and depending on the particular reagents used (e.g., Class I preparation, etc.). For example, excessive concentrations of MHC will increase the apparent measured $IC_{50}$ of a given ligand.

An alternative way of expressing the binding data, to avoid these uncertainties, is as a relative value to a reference peptide. The reference peptide is included in every assay. As a particular assay becomes more, or less, sensitive, the $IC_{50}$'s of the peptides tested may change somewhat. However, the binding relative to the reference peptide will not change. For example, in an assay run under conditions such that the $IC_{50}$ of the reference peptide increases 10-fold, all $IC_{50}$ values will also shift approximately ten-fold. Therefore, to avoid ambiguities, the assessment of whether a peptide is a good, intermediate, weak, or negative binder should be based on its $IC_{50}$, relative to the $IC_{50}$ of the standard peptide.

The reference peptide for the HLA-A2.1 assays described herein is referred to as 941.01 having a sequence of FLPSDYFPSV (SEQ ID NO:3775). An average $IC_{50}$ of 5 (nM) was observed under the assay conditions utilized.

Other reference peptides used in the assays include the following: A1CON1 (YLEPAIAKY (SEQ ID NO:14628)), 25 nM for A*0101; HBV core 18-27 F6→Y (FLPSDYFPSV (SEQ ID NO:7110)), 4.6 nM for A*0201; A3CON1 (KVFPYALINK (SEQ ID NO:14625)), 10 nM for A*0301; A3CON1 (KVFPYALINK (SEQ ID NO:14625)), 5.9 nM for A*1101; A24CON1 (AYIDNYNKF (SEQ ID NO:14629)), 12 nM for A82401; A2.1 signal sequence 5-13 $L_7$→Y (APRTLVYLL (SEQ ID NO:3230)) 4.7 nM for B*0701; HIV gp 586-593 $Y_1$>F, $Q_5$>Y (FLKDYQLL (SEQ ID NO:14630)), 14 nM for B*0801; Rat 60S (FRYNGLIHR (SEQ ID NO:3238)), 6.4 nM for B*2705; B35CON2 (FPFKYAAAF (SEQ ID NO:1369)), 4.4 nM B*3503.

If the $IC_{50}$ of the standard peptide measured in a particular assay is different than that reported in the table then it should be understood that the threshold values used to determine good, intermediate, weak, and negative binders should be modified by a corresponding factor. For example, if in an A2.1 binding assay, the $IC_{50}$ of the A2.1 standard (941.01) were to be measured as 8 nM instead of 5 nM, then a peptide ligand would be called a good binder only if it had an $IC_{50}$ of less than 80 nM (i.e., 8 nM×0.1), instead of the usual cut-off value of 50 nM.

The experimental system herein described can be used to test binding of large numbers of synthetic peptides to a variety of different class I specificities. Specific binding assays can be performed as follows.

HLA-A11-Specific Assay

Figure 19:
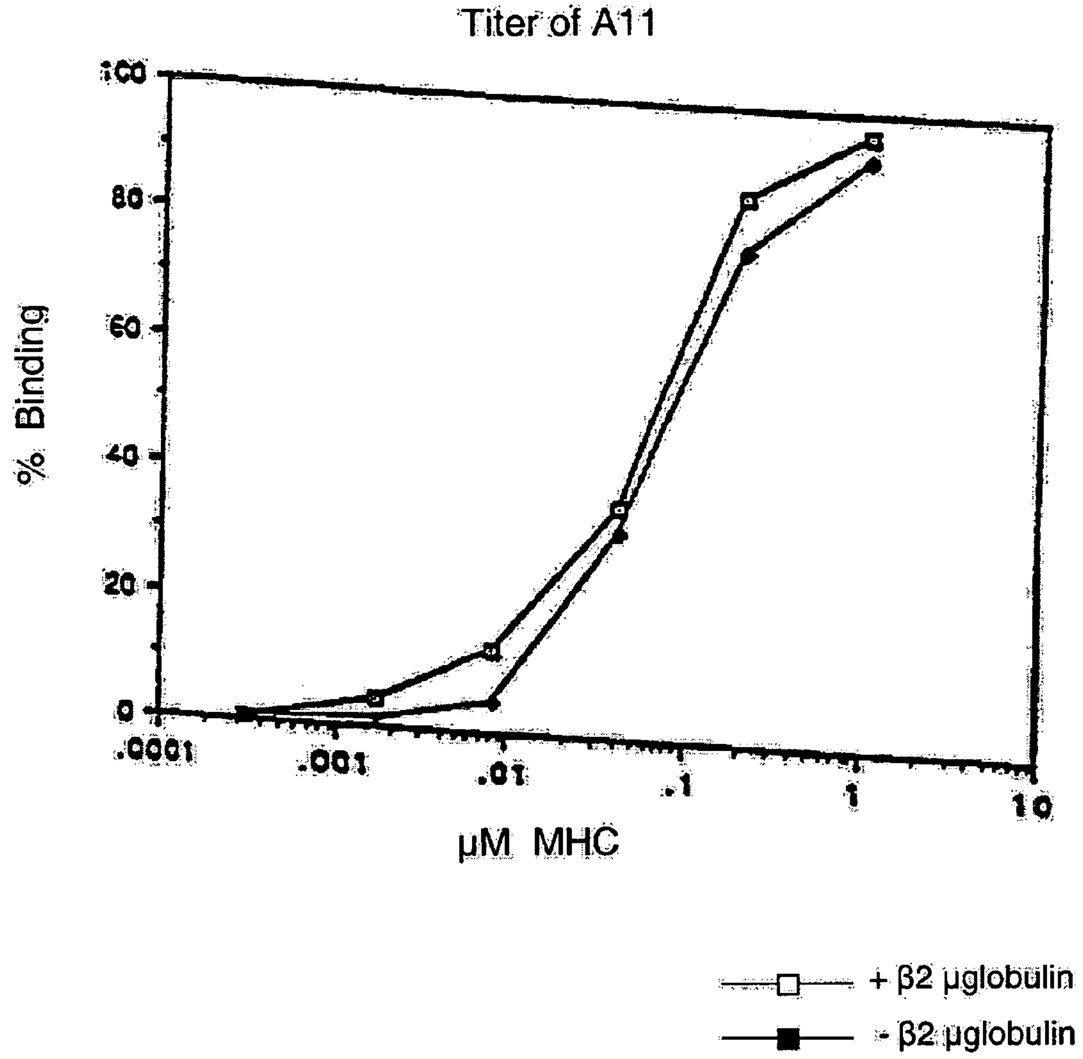
FIG. 19 shows the dependency of the binding on MHC concentration in the presence or absence of $\beta_2$ microglobulin.
Figure 20:
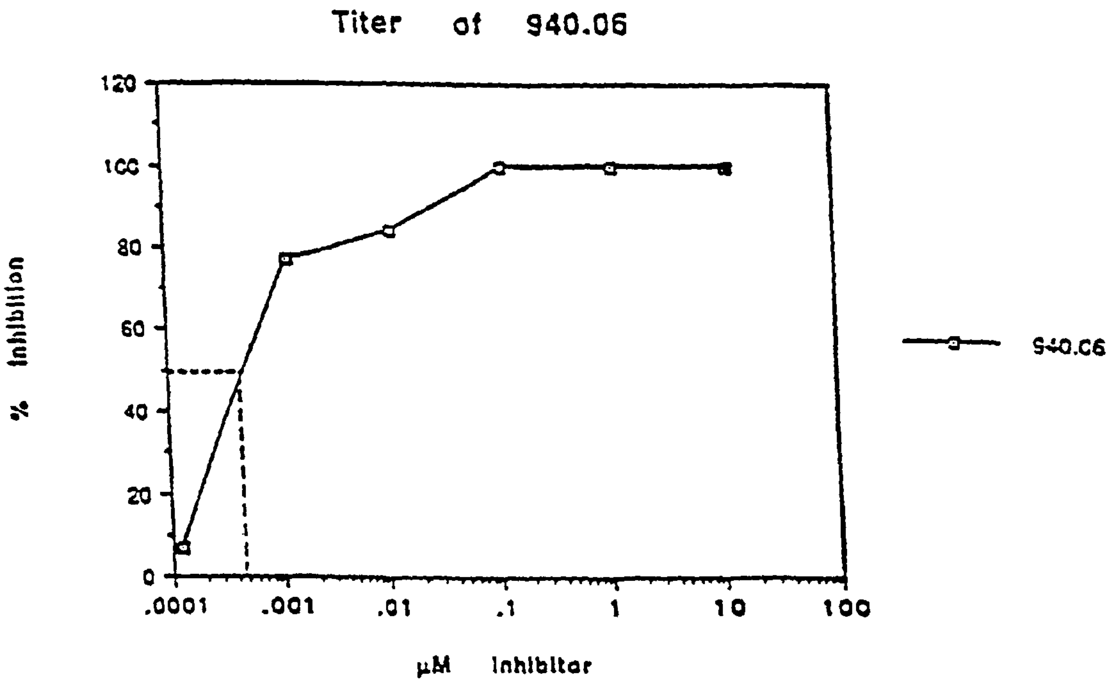
FIG. 20 shows dose dependent inhibition of binding with the addition of unlabeled peptide.
Figure 21:
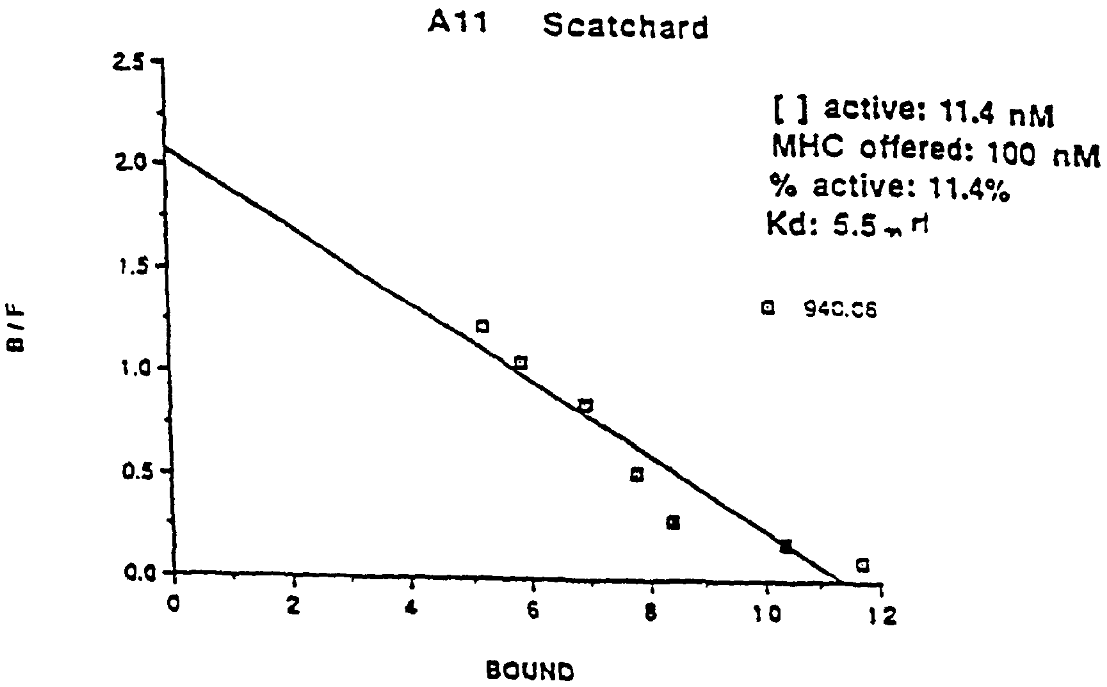
FIG. 21 Scatchard Analysis of binding to MHC A11 confirming an apparent $K_D$ of 6 nM.

The cell line BVR was used as a source of HLA. The dependency of the binding on MHC concentration in presence or absence of $\beta_2M$ are shown in FIG. 19, while FIG. 20 depicts the dose dependency of the inhibition by excess unlabeled ligand. Finally, FIG. 21 shows a Scatchard analysis experiment. Values of apparent kD of −6 nM and of 10% active receptor were obtained, and were remarkable for their similarity to the values obtained for A2.1 and A3.2. The sequence of the peptide used as a radiolabeled probe (940-06) is AVDLYHFLK (SEQ ID NO:14631).

HLA-A1-Specific Assay

Figure 22:
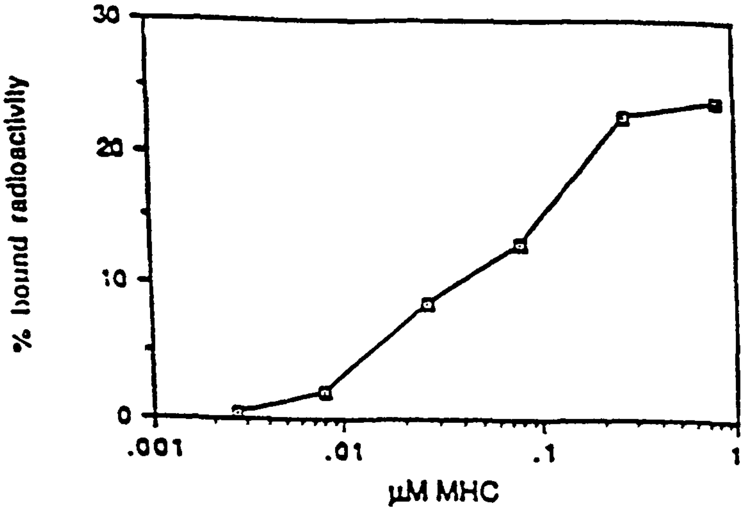
FIG. 22 shows the binding of a radioactively labeled peptide of the invention to MHC A1 as measured by bound reactivity.
Figure 23:
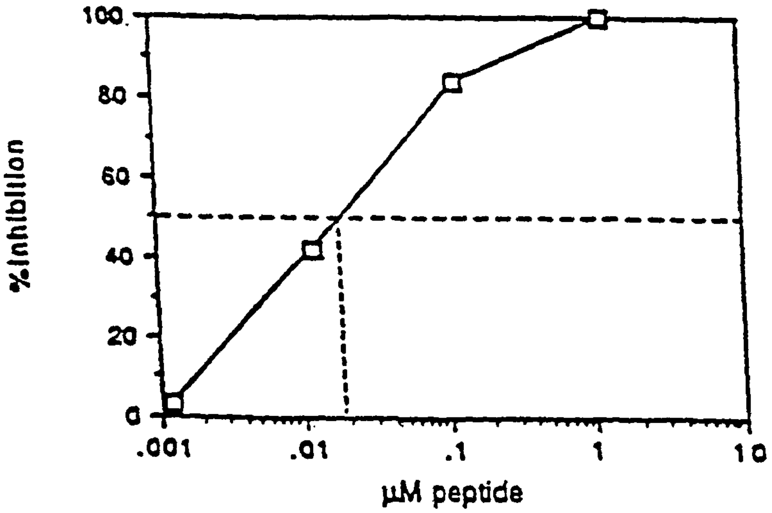
FIG. 23 shows dose dependent inhibition of binding with the addition of unlabeled peptide.
Figure 24:
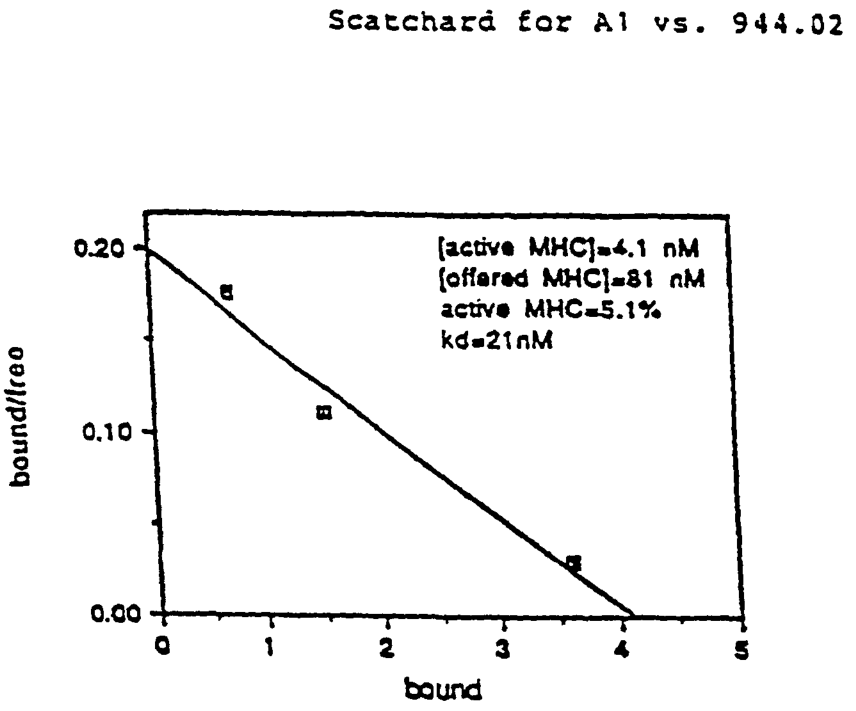
FIG. 24. Scatchard Analysis of binding to MHC A1 confirming an apparent $K_D$ of 21 nM.

In this case, the EBV cell line Steinlin was used as a source of purified HLA. The same protocol previously applied to purification of other HLA alleles (i.e., depletion of B, C molecules by a B1.23.2 mAb column, followed by purification of A molecules by means of a W632 mAb column) was utilized. On the basis of the pool sequencing data, consensus peptides were synthesized, directly radiolabeled, and tested for HLA binding using the standard protocol (1 mM $\beta_2M$, 2 days RT incubation in presence of protease inhibitors). A graph illustrating the relationship between % binding and iM input HLA A1 is shown in FIG. 22. From the data, it was concluded that in analogy with what was observed for HLA A2, 3, and 11, as little as 30 nM are sufficient to obtain −10% binding. The sequence of the peptide used as a radiolabeled probe (944.02) is YLEPAIAKY (SEQ ID NO:14629). In the next set of experiments, the specificity of the assay established was verified by its inhabitability by excess unlabeled peptide. The IC50% was measured (FIG. 23) as −20 nM. Further Scatchard analysis (FIG. 24) verified that the apparent $K_D$ of the interaction corresponded to 21 nM, with a % of active receptor corresponding to 5.1%.

HLA-A24 Specific Assay

Figure 13:
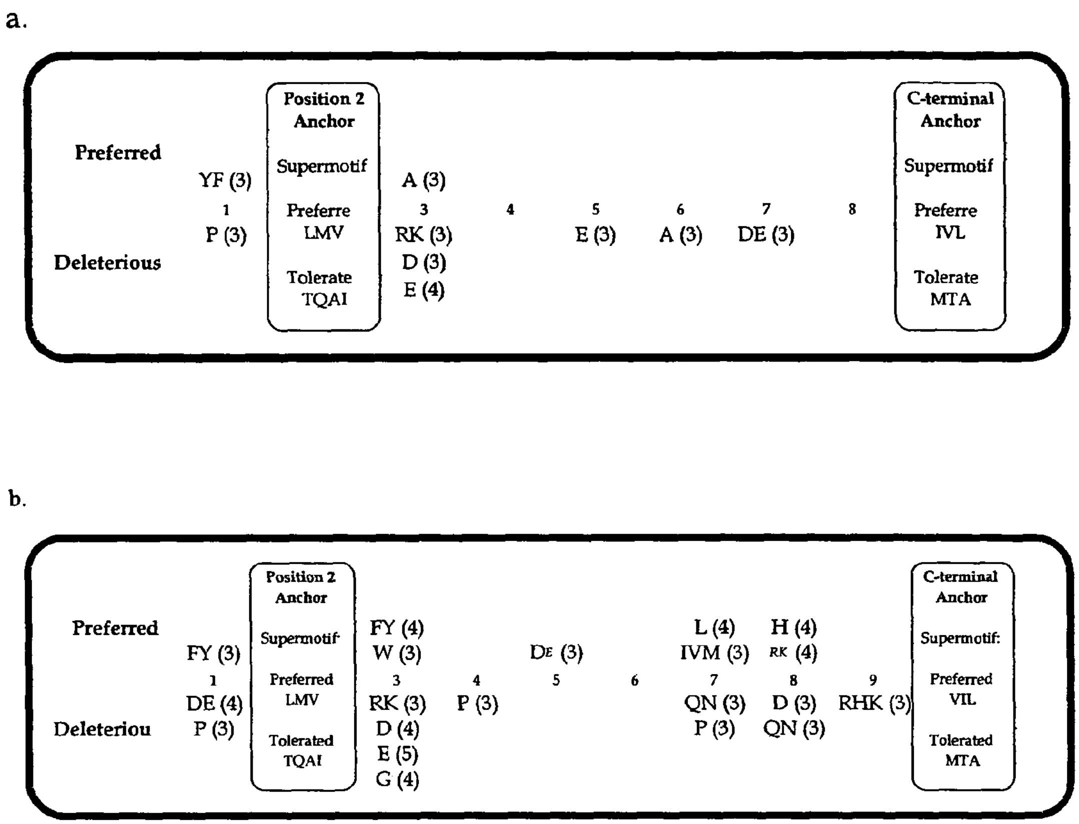
FIG. 13. A2 supermotif consensus summary of secondary and primary anchor influences on A2-supertype binding capacity of 9-(a) and 10-mer (b) peptides. Residues shown significantly influence binding to 3 or more A2-supertype molecules. The number of molecules influenced are indicated in parentheses. At secondary anchor positions, residues are considered preferred only if they do not have a deleterious influence on more than one molecule. Preferred residues which were deleterious in the context of one molecule are indicated by reduced and italicized font. Assessment at the primary anchor positions are based on single substitution and peptide library analyses, as discussed in the text.
Figure 25:
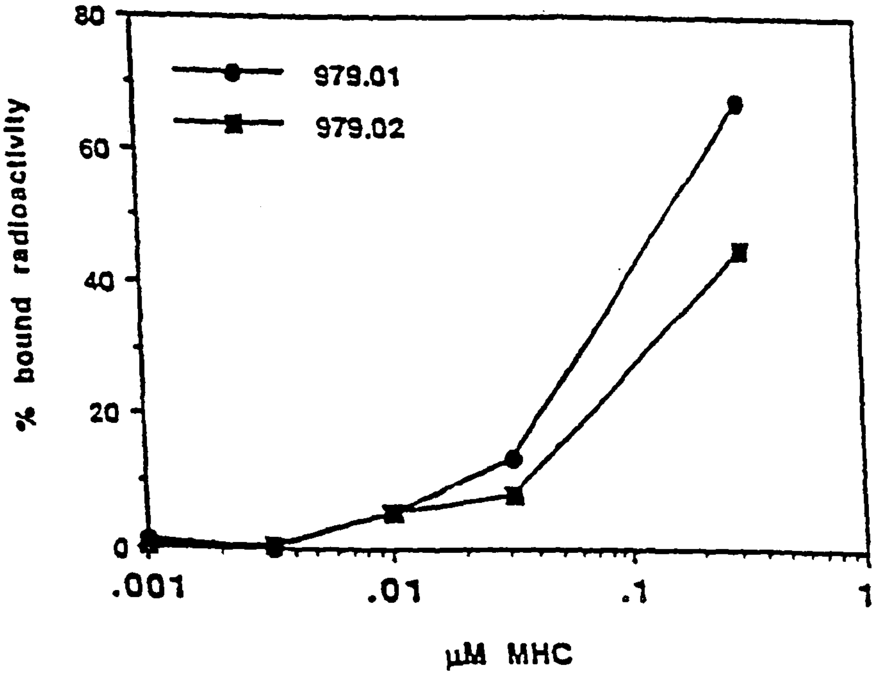
FIG. 25 shows the binding of two peptides of this invention as a function of MHC A24 concentration as measured by bound reactivity.
Figure 26:
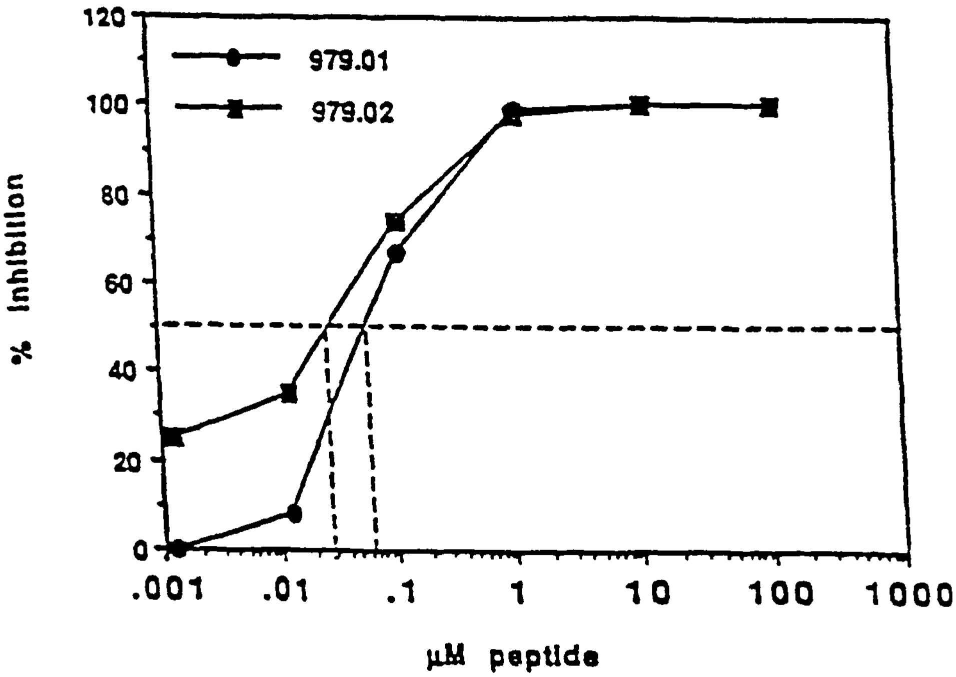
FIG. 26 shows the dose dependent inhibition of binding to MHC A24 with the addition of unlabeled peptides.
Figure 27A:
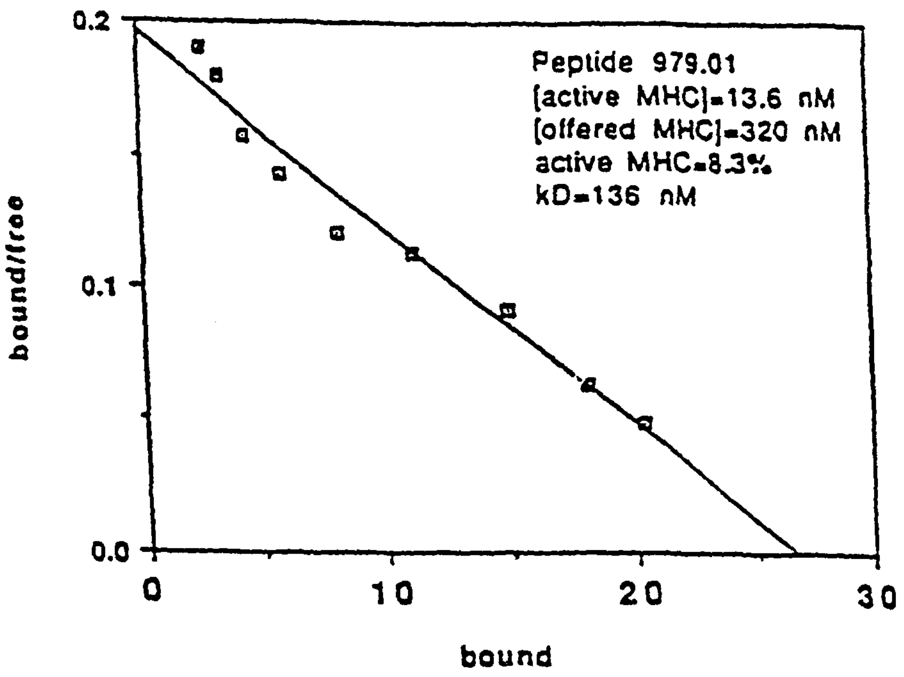
FIG. 27A and FIG. 27B show the Scatchard Analysis of binding to MHC A24 of the two peptides confirming a $K_D$ of 30 and 60 nM, respectively.
Figure 27B:
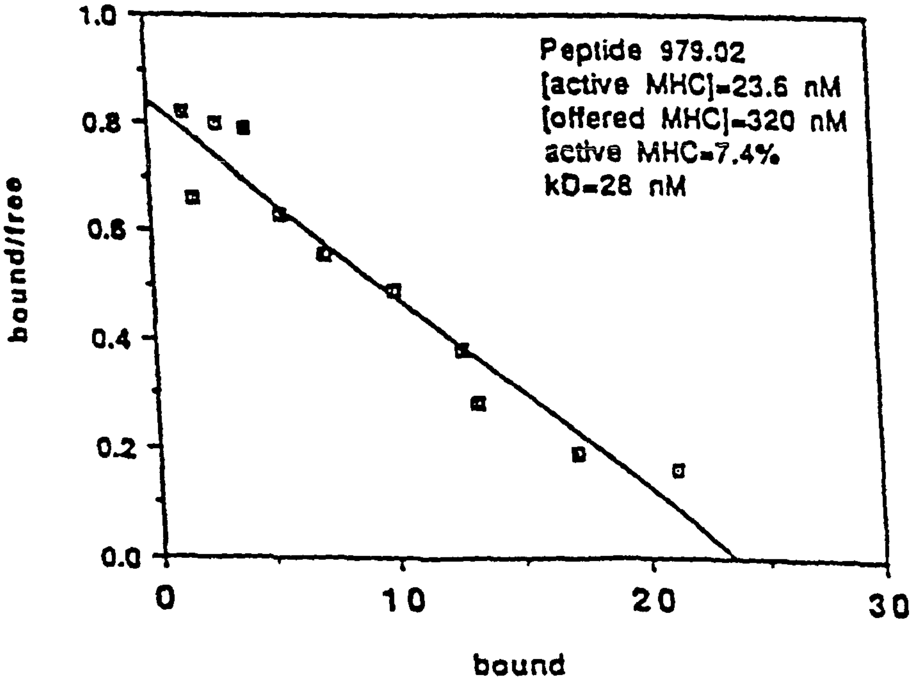

HLA A24 molecules were purified from the KT3 EBV cell line. In this case, two consensus peptides whose sequences were based on the pool sequencing data have been synthesized. Their sequences are: 979-01, AYIDNVYKF (SEQ ID NO:14632) and 979.02, AYIDNYNKF (SEQ ID NO:14629). The results of experiments in which the % bound of these two peptides as a function of input MHC was measured are shown in FIG. 25. In both cases, 10-15% binding was obtained with as little as 20-50 nM MHC. Cold inhibition experiments (FIG. 26), limiting MHC concentrations, revealed that the binding was readily inhibitable by excess unlabeled peptide, with an apparent $K_D$ of 30 and 60 nM, respectively. Further Scatchard experiments verified values of 136 nM and 28 nM, respectively. The apparent % of available receptor (active MHC) were 8.3% and 7.4%, respectively (FIG. 13A and FIG. 13B). On the basis of these data, peptide 979.02 was arbitrarily selected as standard label indicator for A24 assays. Furthermore, on the basis of the data herein described, we also conclude that the goal of establishing an A24-specific binding assay has been accomplished. In conclusion, specific assays for the five major HLA alleles have been described.

Example 27

Expansion of HLA A Motifs

Establishing in vitro binding assays allows one to readily quantitate in vitro the binding capacity of various synthetic peptides to the various alleles of interest (HLA A1, A2, A3, A11, and A24). This allows verification of the correctness of the motifs by means of peptides carrying the various HLA A motifs for their capacity to bind purified HLA molecules. Typically, peptides were synthesized with specific HLA motifs embedded in a neutral backbone composed of only alanine residues. In some cases, a K residue was also introduced within the sequence, with the purpose of increasing solubility. The use of such "neutral" poly A backbones, as applied to the case of class II molecules, has been described in detail, for example, by Jardetzky et al., (Jardetzky et al., *EMBO J.,* 9(6):1797, 1990)

For example, in the case of A3.2, a motif has been defined with a hydrophobic residue in position 2 and a positive charge (K) in position 9. Thus, to verify that the presence of these two anchor residues would allow, in the context of a poly A backbone, for A3.2 binding, the poly A analog with the sequence AMAAAAAAK (SEQ ID NO:5229) was synthesized (TABLE 88).

Similarly, other peptides carrying other HLA motifs were also synthesized and tested for HLA binding. It was found that in all cases, the presence of the specific HLA motifs was conducive to binding to the relevant HLA allele, with estimated $K_D$ comprised of between 125 and 2.8 nM. In most cases, the binding was also absolutely specific, in that no binding was detected to irrelevant alleles. Only two exceptions to this general rule were observed. Firstly, A3 and A11 peptides crossreacted extensively with each other, perhaps as could have been expected by the fact that the motifs for these two alleles are remarkably similar. Second, some A1 peptides crossreacted, albeit with much lower affinities, on A11 and A3.2.

To further define the structural requirements for the interaction between peptide epitopes and various class I alleles of interest, analogs of 10 residues in length of some of the 9 residue peptides shown in TABLE 88 were synthesized (TABLE 89). These analogs were generated by inserting an additional Ala residue within the poly A backbone, so that the anchor residues are not located in positions 2 and 10 (as opposed to 2 and 9 in the previous table). The results obtained illustrate that motifs of 10 residues are also capable of specifically binding to the relevant class I alleles, albeit with a slightly lower efficiency.

In summary, these data confirm that both 9-mer and 10-mer peptides which contain the appropriate motifs can bind HLA. On the basis of these data, 8-mer or 11-mer peptides should also be capable of binding, even if perhaps with lower affinities.

The data described above show that the presence of certain residues in the anchor positions does allow (at least in a "neutral" poly A backbone) for HLA binding. To investigate to what degree other amino acids (for example, chemically related amino acids) might be tolerated in these crucial anchor positions, analogs of some of the poly A peptides from TABLE 88 were synthesized, in which the residue present in position 2 (or 3) or 9 was varied. The results of this analysis are shown in TABLE 88, TABLE 89, TABLE 90, TABLES 91-92, TABLES 93-94, TABLE 95, and TABLE 96.

In the case of A3.2 (TABLE 90), in position 2, L, M, I, V, S, A, T, and F were found to be preferred (binding ≥0.1 relative to previously defined anchor residues), while C, G, and D were permitted (binding ≥0.01 to 0.1 relative to previously defined anchor residues). The substitution of E, because of its similarity to D, in this position should also be tolerated. In position 9, K, R, and Y were preferred. Because of a similarity in nature, that H and F should also be preferred. No other residue was tolerated in position 9 for A3 binding.

In the case of A11 (TABLES 91-92), the preferred residues in position 2 were L, M, I, V, A, S, T, G, N (L and Q by similarity). Tolerated were C, F, D (and E by similarity). In position 9, K was preferred and R was tolerated. H should also be tolerated by similarity.

In the case of A24 (TABLES 93-94), Y and F were preferred in position 2 (and W by similarity); no other residue was tolerated. In position 9, F, I, and L were preferred (and W and M by extension). No other residue was tolerated.

In the case of A1, three different anchor residues had previously been defined. The results shown in the preceding section show that they act independently of each other (i.e., that two out of three anchors would be sufficient for binding). This is indeed the case. For this reason, analogs containing two anchors were synthesized to define what residues might be preferred or tolerated in each position. The data shown in Table 18 show that in position 2, T, S, and M are preferred, and no other residue is tolerated. In position 3 (TABLE 96), D and E are preferred, and A,S (and T by similarity) are tolerated. Finally, in position 9, only Y is preferred, and no other residue appears to be tolerated (TABLE 96).

Thus, on the basis of the data, it is concluded that peptides carrying any combination of two preferred residues can bind. Peptides containing "imperfect" motifs, i.e., carrying a preferred residue at one position and a tolerated one at the other anchor position, should also be capable of binding, even if with somewhat lower affinity. Using the motifs of this invention for various MHC class I alleles amino acid sequences from various viral and tumor-related proteins were analyzed for the presence of motifs. The results of this motif analysis are shown in TABLES 112-122.

Example 28

Validation of HLA Peptide Binding Motifs with an Unbiased Set of HPV 16 Peptides Human Papillomaviruses (HPVs) are implicated in the etiology of cervical cancer (Pfister, H. (1974) Biology and biochemistry of papillomaviruses, *Rev. Physiol. Biochem.*, 99:111; zur Hausen, H. (1991). Human papillomaviruses in the pathogenesis of anogenital cancer. *Virology.* 184:9) and in up to 10% of total mortality due to cancer worldwide (zur Hausen, H. (1991). Viruses in Human Cancers, *Science,* 254: 1167). Cervical cancer is the second most common cause of cancer-related death in females worldwide (Parkin, D. M., Laara, E., and Muir, C. S. (1988), Estimates of the worldwide frequency of sixteen major cancers in (1980), *Int. J. Cancer,* 41:184). HPV DNA is present in more than 90% of the cervical carcinomas and predominantly of the HPV 16 genotype (Resnick, R. M., Cornelissen, M. T., Wright, D, K., Eichinger, G. H., Fox, H. S., ter Schegget, J., and Manos, M. M. (1990). Detection and typing of human papillomavirus in archival cervical cancer specimens by DNA amplification with consensus primers. *J. Natl. Cancer Inst.*; Van den Brule, A. J. C., Walboomers, J. M. M., du Maine, M., Kenemans, P., and Meijer, C. J. L. M. (1991). Difference in prevalence of human papillomavirus genotypes in cytomorphologically normal smears is associated with a history of cervical intraepithetal neoplasia, *Int. J. Cancer,* 48:404). The ability of HPV 16 early region 6 and 7 (E6, E7) open reading frames to in vitro immortalize rodent cells (Yasumoto, S., Burkhardt, A. L., Doniger, J., and DiPaolo, J. A. (1986). Human Papillomaviruses type 16 DNA induced malignant transformation of NIH3T3 cells. *J. Virol.,* 57:572) and human keratinocytes (Pirisi. L., Yasumoto, S., Feller, M., Doniger, J., and DiPaolo, J. A. (1987). Transformation of human fibroblasts and keratinocytes with human papillomavirus type 16 DNA. J. Virol., 61:1061) and to transform human fibroblasts (Smits, H. L., Raadsheer, E., Rood, I., Mehendale, S., Slater, R. M., van der Noordaa, J., and ter Schegget, J. (1988). Induction of anchorage-independent growth of human embryonic fibroblasts with a deletion in the short arm of chromosome 11, *J. Virol.* 62:4538) suggests direct involvement of HPV 16 in the multistep process of cervical carcinogenesis.

In general T cell immunity, in particular mediated by cytotoxic T lymphocytes (CTL) is important in the defense against virus-induced tumors (Melief, C. J. (1992). Tumor eradication by adoptive transfer of cytotoxic T lymphocytes, *Adv. Cancer Res.,* 58:143; Melief, C. J., and Kast, W. M. (1992). Lessons from T cell responses to virus induced tumors for cancer eradication in general, *Cancer Surv.,* 13:81). Recently in a mouse model, it was reported that some degree of protection against HPV 16 E7 expressing tumors can be obtained with CTL after immunization with HPV 16 E7 expressing cells (Chen. L., Thomas, E, K., Hu, S. L., Hellstrom, I., and Hellstrom, K. E. (1991). Human papillomavirus type 16 nucleoprotein E7 is a tumor rejection antigen, *Proc. Natl. Acad. Sci.,* 88:110; Chen, L., Ashe, S., Brady, W. A., Hellstrom, I., Hellstrom, K. E., Ledbetter, J. A, McGowan, P., and Linsley, P. S. (1992). Costimulation of Antitumor immunity by the B7 counterreceptor for the T lymphocyte molecules CD28 and CTLA-4. Cell. 71:1093). In vivo protection by CTL was recently shown in mouse models in which synthetic peptides containing CTL epitopes were used for efficient priming of mice against virus infections (Schulz, M., Zinkernagel, R. M., and Hengarter, H. (1991). Peptide-induced antiviral protection by cytotoxic T cells, *Proc. Natl. Acad. Sci.*, USA, 88:991; Kast, W. M., Roux, L., Curren, J., Blom, H. J. J., Voordouw, A. C., Meleon, R. H., Kolakofski, D., and Melief, C. J. M. (1991). Protection against lethal Sendai virus infection by in vivo priming of virus-specific cytotoxic T lymphocytes with an unbound peptide, *Proc. Natl. Acad. Sci.*, USA, 88:2283). Moreover in a mouse model it has now been shown that complete protection against HPV 16 induced tumors can be achieved by peptide vaccination with a CTL epitope derived from the viral oncogene E7.

The HPV 16 E6 and E7 gene products are the most desirable target antigens for vaccination against HPV 16 induced tumors. Both are retained and highly expressed in HPV 16-transformed cancer cells in vivo (Baker, C. J., Phelps, W. C., Lindgren, V., Braun, M. J., Gonda, M. A., and Howley, P. M. [1987]. Structural and transcriptional analysis of human papillomavirus type 16 sequences in cervical carcinoma cell lines, *J. Virol.,* 61:962; Smotkin, D., and Wettstein, F. O. [1986]. Transcription of human papillomavirus type 16 early genes in a cervical cancer and cancer-derived cell line and identification of the E7 protein, *Proc. Natl. Acad. Sci.*, USA, 83:4680) and involved in the induction and maintenance of cellular transformation in vitro (Crook, T., Morgenstern, J. P., Crawford, L., and Banks, L. [1989]. Continued expression of HPV-16 E7 protein is required for maintenance of the transformed phenotype of cells co-transformed by HPV-16 plus EJ ra,. *EMBO J.,* 8:513; Hawley-Nelson, P., Vousden, K. H., Hubbert, N. L., Lowy, D. R., and Schiller, J. T. [1989]. HPV 16 E6 and E7 proteins cooperate to immortalize human foreskin keratinocytes, *EMBO J.,* 8:3905). Dependence of in vitro growth of cell lines derived from cervical cancers on the expression of E6 and E7 emphasizes involvement of these oncogenes in maintenance of the phenotype of cervical carcinoma cell lines (Von Knebel Doeberitz, M, Bauknect, T., Bartch, D., and zur Hausen, H. [1991]. Influence of chromosomal integration on glucocorticoid-regulated transcription of growth-stimulation papillomavirus genes E6 and E7 in cervical carcinoma cells, *Proc. Natl. Acad. Sci*., USA, 88:1411). To determine the CTL epitopes and potential vaccine candidates of HPV 16 for humans, we screened peptides spanning the HPV 16 E6 and E7 protein sequences for their ability to bind to the most frequent human MHC molecules, namely HLA-A1, A3.2, A11.2 and A24. Combined these five alleles will cover about 90% of the world population (Dupont, B., ed. [1987]. Immunology of HLA Vol. I Histocompatibility Testing, Springer-Verlag, New York).

A complete set of 240 overlapping synthetic peptides of 9 aa length and 8 aa overlap covering the entire HPV 16 E6 and E7 oncogene sequences were synthesized. The peptides were tested for their ability to bind the aforementioned HLA molecules in the binding assay described above. The results of this analysis show the relative affinity of all peptides for the respective HLA alleles and reveal the possible candidate CTL epitopes for use in peptide based vaccines for humans in TABLE 98, TABLE 99, TABLE 100, and TABLE 101.

The results confirm that peptide binding motif described in this invention for the aforementioned HLA alleles predict which peptide of a protein is likely to bind into the groove of a specified HLA molecule. Since we used a large and unbiased set of peptides, the results of the peptide binding analyses were used to evaluate the value of these motifs both for their predictive capacities and the necessity to have particular anchor aa residues on positions 2, (3) and 9 in a peptide.

Peptides. Peptides were generated by solid phase strategies on a multiple peptide synthesizer (Abimed AMS 422) by repeated cycles in which addition of Fmoc protected amino acids to a resin of polystyrene was alternated with a Fmoc-deprotection procedure (Gausepohl, H., Kraft, M., Boulin, Ch., and Frank, R. W. [1990]. Automated multiple peptide synthesis with BOP activation. in Proc. of the 11th American peptide symposium. J. E. Rivier and G. R. Marshall, Ed. ESCOM, Leiden. 1003-1004). The peptides all carrying a COOH group at the C-terminal end, were cleaved from the resin and side chain protective groups were removed by treatment with aqueous TFA. Peptides were analyzed by reversed phase HPLC lyophilized and dissolved at a concentration of 1 mg/ml in phosphate-buffered saline with 3% DMSO (Sigma, St. Louis, Mo. 63175) before use. Once dissolved, the peptides were stored at −70° C. Since cysteine containing peptides are susceptible to (air) oxidation during synthesis and handling, these peptides were synthesized with an alanine instead of a cysteine.

Identification of Peptides from HPV 16 E6 and E7 Proteins that Bind to Different HLA-A Alleles.

A complete set of 240 peptides of 9 aa in length and overlapping by 8 aa, covering the sequences of the entire HPV 16 E6 and E7 proteins, was tested for binding to 5 different HLA-A molecules.

The results of this analysis are depicted in TABLE 98, TABLE 99, TABLE 100, and TABLE 101. TABLE 98 describes the peptides of HPV 16 that bound to HLA-A1 molecules. All peptides were tested. Listed are only peptides yielding ratio values of 0.001. It can be seen that 2 peptides bound with high affinity to this molecule (>0.1), 6 with intermediate affinity (0.1-0.01) and 1 with low affinity (0.01-0.001). Peptides were ranked by ratio value to allow comparison of data obtained in different experiments. To calculate the concentration of a peptide necessary to yield a 50% inhibition dose ($IC_{50}$) one has to divide the value of the standard $IC_{50}$ by the ratio. For example, peptide E6-80 has an $IC_{50}$ of 23 nM (81/3.5).

TABLE 99 describes the peptides that bound to HLA-A3.2 molecules. Seven peptides were identified as high affinity binders, 6 as intermediate affinity binders and 13 as low affinity binders. TABLE 100 describes the peptides that bound to HLA-A11.2 molecules. Six high affinity peptides were identified, 4 intermediate affinity binders and 10 low affinity binders. Two high affinity binding peptides (E6-59 IVYRDGNPY (SEQ ID NO:6071) and E6-80 ISEYRHYAY (SEQ ID NO:6072)) and two weak affinity binding peptides with a Y at the 9th position (E6-42 QQLLRREVY (SEQ ID NO:6022), E6-69 VADKALKFY (SEQ ID NO:6077)) were identified for HLA-A11.2 Considering the high binding strength of the first two peptides and the similarity between the HLA-A11.2 motif and the HLA-A3.2 motif in which Y's are preferred at the 9th aa position, tyrosines should be included at the 9th position in the HLA-A11.2 motif. Comparing TABLE 105 and TABLE 106, it is clear that there is a large overlap of peptides that bound to both A3.2 and A11.2 molecules. Eighteen out of 28 E6 and E7 peptides binding to these two HLA molecules overlapped and only 8 peptides were unique for HLA-A3.2 and 2 peptides unique for HLA-A11.2.

Finally, TABLE 107 describes the peptides that bound to HLA-A24 molecules. Here 2 peptides were identified as high affinity binding peptides, 5 as intermediate affinity binding peptides and 5 as low binding peptides. One high affinity peptide (E6-72 KALKFYSKI (SEQ ID NO:6105)) and one intermediate affinity peptide (E7-49 RAHYNIVTF (SEQ ID NO:6107)) were identified, indicating that an A at the second position should be allowed in the HLA-A24 motif. All these inclusions are indicated in TABLE 102. In analyzing TABLE 69, TABLE 70, TABLE 71, TABLE 72, and TABLE 73, it can be concluded that between 2 and 7 high affinity binding peptides were identified for all of the tested HLA-A molecules. Occasionally some peptides were binding to more alleles. Three peptides (E6-7, E6-37 and E6-79), bound to HLA-A2.1, A3.2 and A11.2. One peptide (E6-38) bound to HLA-A3.2, A11.2 and A24 and two peptides (E6-69 and E6-80) bound to HLA-A1, A3.2 and A11.2. But these cross-reactive peptides bound only weakly to one or more of the different HLA molecules. In general, however, it can be concluded that, except for HLA-A3.2 and HLA-A11.2 molecules, almost all HLA molecules bind unique peptides.

Validation of HLA-A Peptide Binding Motifs with an Unbiased Set of HPV 16 E6 and E7 Peptides.

We analyzed how well the motifs for anchor positions described in this invention predicted the binding of a peptide, and also the reverse: how well binding peptides followed the identified motifs. For this, peptides were ranked as high binders, intermediate binders, weak binders, and negative binders and for each peptide the motif prediction based on the anchor motif rules of Table 74 were analyzed. The overall efficiency of the 2, (3), and 9 anchor motifs was then calculated and this is summarized in TABLE 102. It can be concluded that the motifs described above for the different HLA-A molecules are quite accurate. One hundred percent of the HLA-A1, A3.2, and A24 high binders would be predicted as well as 67% of the HLA-11.2. Even for the intermediate binders between 40 and 100% would be predicted depending on the HLA-A molecule analyzed. Furthermore, the percent of weak binding peptides that would be predicted is low and the percent of those peptides that were predicted to bind but actually did not bind is very low for all these alleles.

Analyzed differently, of the 12 peptides predicted to bind to HLA-A1 actually 5 bound with high or intermediate affinity. This indicates that only a few peptides would have to be made to find these potential CTL epitopes. The figures for HLA-A3.2, A11.2, and A24 were 10/32, 7/26, and 4/7, respectively. This implies that the predictive value for all of these alleles is good. Besides a small number of peptides that had not been predicted by the recently described motifs, the (−) in TABLE 104, TABLE 105, TABLE 106, and TABLE 107, a number of peptides that were predicted by the 2, (3) and 9 anchor motifs did not bind, indicating that having the right anchor residues is not always sufficient for binding and implicating that non-anchor residues can make negative contributions to the binding of a peptide.

Example 29

Presence of a Motif is Necessary but not Sufficient for High Affinity Class I Binding To investigate further how the presence of different motifs might influence the capacity of different peptides to bind to the relevant HLA alleles, the sequences of various potential target molecules were scanned for the presence of motif-containing peptides. The peptides thus identified were synthesized and tested for binding. It was found (TABLE 97) that in the case of A3.2, only 39 (19%) of the 205 peptides bound with high affinity in the 1 to 50 nM range. 22.4% of them bound with intermediate affinities (in the 50 to 500 nM range), while 34.6% bound weakly (in the 500 nM to 50 μM range). Finally, 23.9% of them did not bind at all, at least up to the 50 íM level. In the case of A11, 33 (33%) of the 100 peptides bound with high affinity in the 1 to 50 nM range. 35% of them bound with intermediate affinities (in the 50 nM range), while 24% bound weakly (in the 500 nM to 50 μM range). Finally, 8% of them did not bind at all, at least up to the 50 μM level.

Similar results were also obtained (data not shown) in the case of A1 and A24.

The same type of analyses were also performed in the case of 10-mer peptides carrying either the A3.2, and A11 motifs (TABLE 109 and TABLE 110). It was found that in these cases, the frequency of good binders was even lower (17.5%, and 29.8%, respectively). These data confirm the fact that motif-containing 10-mer peptides can indeed bind, albeit with, in general, reduced affinity.

In summary, the data shown in this section clearly show that the presence of the correct anchor residues is not sufficient per se to allow for good HLA binding. It is thus apparent that the nature of the residues contained in positions other than 2(3) and 9 (or 10) can influence binding. The most likely explanation of this observation is that the presence of certain residues (in positions other than 2 and 9) can negate or increase the binding potential of a peptide determinant.

The data shown in the preceding sections describe how specific binding assays can be used to identify, within motif-containing peptides, peptides that are immunogenic. We also wanted to devise an alternative strategy, namely to derive procedures that would be able to predict, within motif-containing peptides, which peptides might be good or intermediate binders and thereby might be immunogenic. In other experiments not shown intermediate or good binders have been shown to be immunogenic. In particular, to identify residues that have a negative impact on binding an analysis of all positions for A3.2, A11, and all motif-containing peptides, both 9-mers and 10-mers is carried out. In the case of A11, because of the small occurrence of nonbinding peptides, a different cutoff was used such that the analysis compares good and intermediate binders on the one hand to weak and nonbinders on the other.

Example 30

Specificity and Cross-Reactivity of HLA Binding

Peptide sequences capable of binding the most common HLA alleles have been identified in previous studies. However, a large number of monospecific epitopes would be required to provide substantial coverage of all ethnic groups. In contrast, the alternative approach of identifying broadly crossreactive motifs (supermotifs) has the potential of covering a similar proportion of the population using just two or three motifs. TABLE 28 shows a hypothetical population coverage achieved by each of the different motif types or combinations of motif types, using known and predicted motifs.

To explore specificity and cross-reactivity of HLA binding in more detail, a panel of HLA-A and B restricted T cell epitopes was tested for binding in the assays described in Examples 1 & 2, above. It was found (TABLE 26) that the majority of the peptides were good or intermediate binders to the appropriate restriction element. The binding, in general, was allele-specific. Similar data were obtained with a panel of HLA-B naturally processed peptides (TABLE 27), in which it was found that 12 of 12 peptides were good binders to the relevant restriction element. In addition, however, some cross-reactivities were detected, particularly in the case of alleles which had overlapping motifs.

For example, a high degree of cross-reactivity was noted between A3.2 and A11 (shaded areas, TABLE 26). The cross-reactivity seen between B7 and B8 with the B8 epitope 1054.05 can be explained by the fact that this peptide has the motif for both B7 and B8. The B7 motif is proline in position 2 and small hydrophobics at the C-terminal. B8 recognized residues with basic charges (R,K) in positions 3 and 5, and small hydrophobics at the C-terminal. These data demonstrate that 1) in general, for both the A and B isotypes, the binding is rather specific; and 2) occasional cross-reactivities exist and can usually be explained by either shared motifs or the presence within a single peptide of more than one motif.

The data available thus far have defined a set of motifs which are summarized in Table 28. Three motifs are shared by multiple alleles (identified as types C, D, and F in TABLE 28). Alleles of type C have hydrophobic residues at position 2 and at the C-terminus; alleles of type D have hydrophobic residues at position 2, with positively charged residues (R,K) at the C-terminus; and alleles of type F have proline at position 2, with hydrophobic residues at the C-terminus. Coverage of a significant fraction of the population is achieved by identifying peptides which bind to the alleles listed in TABLE 28 for the C, D, and F "supermotifs."

Example 31

Prediction of Alleles Binding the Major Motif Supermotifs

Further analysis of the crossreactivity observed between A3, A11, A31, and Aw68 was made by assessing the similarities of these HLA molecules in the residues that make up the B and F binding pockets involved in the interactions with position 2 and the C terminal residue of the peptides which bind these molecules. When this analysis was performed, a high degree of similarity between these alleles becomes evident (see, Matsumura, M., et al., *Science,* 257:927 1992 for a discussion of the structure of the peptide binding pockets in the groove of MHC Class I molecules). TABLES 29 and 30 shows the residues which constitute the F or C-terminal pocket for these alleles. The residues are completely conserved in all four alleles, and experimental data have indicated that each of these alleles recognized basic residues (R,K) at the C-terminus of peptides. B27, an allele which also recognizes basic residues at the C-termini of peptides, differs from A3, A11, A31, and Aw68 by only a single residue, a conservative isoleucine to leucine difference.

These striking similarities can be contrasted with the sequences of HLA molecules which do not share the basic charge C-terminal motif. Further similarities between A3, A11, A31 and Aw68 are also seen in the B pocket (TABLE 31), where they also share overlapping motifs (hydrophobics and threonine).

Remarkable motif similarities are demonstrated by the preference of many HLA-B (B7, B14, B35, B51, B53, and B54) and HLA-C(Cw4, Cw6, and Cw7) alleles for proline in position 2. An analysis of the B pocket of the HLA-B alleles is shown in TABLE 33, and reveals that they all share similar B pockets, having the same or conservatively different (i.e., N/Q) residues in positions 9, 63, 66, and 70. Interestingly, in addition to sharing a motif based on proline in position 2, all of these alleles prefer hydrophobic residues (F of LIV) in position 9. If further alleles could be identified which have motifs fitting the three basic patterns (C, D, and F), it would allow exploitation of crossreactivity using peptides already developed. Crossreactive alleles could be identified by two different approaches. In the first approach, one could establish assays for a large panel of different alleles and empirically determine which motifs fit the various supermotifs. In the second approach, one could attempt to predict a priori crossreactivity based on pocket structure. The analysis discussed above, which compared and contrasted the binding pockets of alleles which share similar B pockets and motifs, or similar F pockets and motifs with alleles which have different motifs, supports the notion that sharing similar pockets will result in the sharing of similar motifs. If this assumption is true, a number of assays for which cell lines are readily available could be explored (TABLE 32). These alleles all have B and F pockets, which suggests that their motifs might fit into one of the motif types defined in TABLE 28.

Example 32

Peptide Binding to B54

To experimentally address the feasibility of increasing allele coverage by a priori selecting alleles which are likely to crossreact, we have examined B54, which is present in about 10% of the Asian population. Sequence analysis of the B pocket of B54 suggested a close similarity to B35, B51, and B53 (TABLE 33), B54 differing from the other alleles fairly conservatively at three positions. Most interestingly, the polar residues at positions 9, 63, and 70, which are invariable amongst $Pro_2$ preferring alleles (i.e., alleles to which peptides comprising the B7-like-supermotif bind) and, we speculate, may be crucial for "proline-ness," were completely invariant. The F pocket of B54 shares the S, N, L triplet at positions 77, 80, and 81 with B7, B8, and B35, and carries a pair of hydrophobic residues at positions 95 and 116, as do these other B alleles. B7, B8, and B35 all prefer peptides with hydrophobic C-terminals.

The analysis discussed above suggested that B54 might recognize peptides carrying a $Pro_2$-hydrophobic-c-terminal motif (i.e., a B7-like-supermotif). To test this hypothesis, we analyzed whether the B35 binding B35CON2 peptide (Cytel number 1021.05; sequence FPFKYAAAF (SEQ ID NO:1369)) could bind to B54. Indeed, excellent binding was detected, with an estimated Kd in the 5 nM range. Thus, a high affinity ligand was selected for B54 based on B and F pocket structural analysis without any previous knowledge of a specific motif. These data illustrate how it may be possible to select, a priori, alleles which have the potential for extensive crossreactivity and thus cover a large segment of the population.

Example 33

Binding of Peptides to B7-Like Supermotif HLA Alleles

Peptides bearing the B7-like supermotif were tested for binding to purified HLA molecules of some of the alleles sharing the B7-like specificity. The binding assay was performed as described in Example 2. TABLE 35 shows the binding to HLA-B*0701, B*3501, B*3502, B*3503, and B*5401 of a set of peptides reported in the literature to be restricted or naturally bound to various HLA-B alleles.

TABLE 36 shows the binding of a set of 124 9-mer and 124 10-mer B7-like supermotif bearing peptides of various viral and bacterial origin to HLA-B*0701, B*3501, B*5301, and B*5401. In general, immunogenicity is correlated with binding affinity in that peptides which bind MHC with affinities of 500 nM or less show greater immunogenicity.

As shown in TABLE 35 and TABLE 36, there are peptides which are capable of binding to more than one allele, demonstrating that molecules of the defined B7-like supermotif family are indeed capable of binding overlapping sets of peptides. To date, approximately 10 peptides capable of over 25% (at minimum) population coverage, as defined through its binding to any B7-like allele(s), have been identified (Table 106). HBV, HIV, HCV, Mage 2, Mage 3, and *P. falciparum* are each represented by at least one cross-reactive binder.

The basis for the observed cross-reactivity was examined by first establishing for four alleles, B*0701, B*3501, B*5301, and B*5401, their individual secondary anchor motifs (FIG. 3). From the individual motifs, a B7-like cross reactive motif is comprised of all residues which are positive secondary anchors for at least 2 of the four alleles examined. In its negative aspect, the motif excludes peptides bearing residues at certain positions which are detrimental influences on binding for at least 2 of the four alleles examined. As shown in TABLE 37, the B7-like cross-reactive supermotif allows the improved prediction of peptides which will be capable of binding to 2 or more alleles of the B7-like superfamily.

Example 34

Ex Vivo Induction of Cytotoxic T Lymphocytes (CTL)

Peripheral blood mononuclear cells (PBMC) are isolated from an HLA-typed patient by either venipuncture or apheresis (depending upon the initial amount of CTLp required), and purified by gradient centrifugation using Ficoll-Paque (Pharmacia). Typically, one can obtain one million PBMC for every ml of peripheral blood, or alternatively, a typical apheresis procedure can yield up to a total of $1\text{-}10\times10^{10}$ PBMC.

The isolated and purified PBMC are co-cultured with an appropriate number of antigen presenting cell (APC), previously incubated ("pulsed") with an appropriate amount of synthetic peptide (containing the HLA binding motif and the sequence of the antigen in question). PBMC are usually incubated at $1\text{-}2\times10^6$ cells/ml in culture medium such as RPMI-1640 (with autologous serum or plasma) or the serum-free medium AIM-V (Gibco).

APC are usually used at concentrations ranging from $1\times10^4$ to $2\times10^5$ cells/ml, depending on the type of cell used. Possible sources of APC include: 1) autologous dendritic cells (DC), which are isolated from PBMC and purified as described (Inaba, et al., *J. Exp. Med.* 166:182 (1987)); and 2) mutant and genetically engineered mammalian cells that express "empty" HLA molecules (which are syngeneic [genetically identical] to the patient's allelic HLA form), such as the, mouse RMA-S cell line or the human T2 cell line. APC containing empty HLA molecules are known to be potent inducers of CTL responses, possibly because the peptide can associate more readily with empty MHC molecules than with MHC molecules which are occupied by other peptides (DeBruijn, et al., *Eur. J. Immunol.* 21:2963-70 (1991)).

In those cases when the APC used are not autologous, the cells will have to be gamma irradiated with an appropriate dose (using, e.g., radioactive cesium or cobalt) to prevent their proliferation both ex vivo, and when the cells are reintroduced into the patients.

The mixture cultures, containing PBMC, APC and peptide are kept in an appropriate culture vessel such as plastic T-flasks, gas-permeable plastic bags, or roller bottles, at 37° centigrade in a humid air/$CO_2$ incubator. After the activation phase of the culture, which usually occurs during the first 3-5 days, the resulting effector CTL can be further expanded, by the addition of recombinant DNA-derived growth factors such as interleukin-2 (IL-2), interleukin-4 (IL-4), or interleukin-7 (IL-7) to the cultures. An expansion culture can be kept for an additional 5 to 12 days, depending on the numbers of effector CTL required for a particular patient. In addition, expansion cultures may be performed using hollow fiber artificial capillary systems (Cellco), where larger numbers of cells (up to $1\times10^{11}$) can be maintained.

Before the cells are infused into the patient, they are tested for activity, viability, toxicity and sterility. The cytotoxic activity of the resulting CTL can be determined by a standard $^{51}$Cr-release assay (Biddison, W. E. 1991, Current Protocols in Immunology, p'7, 17.1-7.17.5, Ed. J. Coligan et al., J. Wiley and Sons, New York), using target cells that express the appropriate HLA molecule, in the presence and absence of the immunogenic peptide. Viability is determined by the exclusion of trypan blue dye by live cells. Cells are tested for the presence of endotoxin by conventional techniques. Finally, the presence of bacterial or fungal contamination is determined by appropriate microbiological methods (chocolate agar, etc.). Once the cells pass all quality control and safety tests, they are washed and placed in the appropriate infusion solution (Ringer/glucose lactate) and infused intravenously into the patient.

Example 35

Assays for CTL Activity

1. Peptide Synthesis.

Peptide syntheses were carried out by sequential coupling of N-á-Fmoc-protected amino acids on an Applied Biosystems (Foster City, Calif.) 430A peptide synthesizer using standard Fmoc coupling cycles (software version 1.40). All amino acids, reagents, and resins were obtained from Applied Biosystems or Bachem. Solvents were obtained from Burdick & Jackson. Solid-phase synthesis was started from an appropriately substituted Fmoc-amino acid-Sasrin resin. The loading of the starting resin was 0.5-0.7 mmol/g polystyrene, and 0.1 or 0.25 meq were used in each synthesis. A typical reaction cycle proceeded as follows: 1) The N-terminal Fmoc group was removed with 25% piperidine in dimethylformamide (DMF) for 5 minutes, followed by another treatment with 25% piperdine in DMF for 15 minutes. The resin was washed 5 times with DMF. An N-methylpyrolidone (NMP) solution of a 4 to 10 fold excess of a pre-formed 1-hydroxybenzotriazole ester of the appropriate Fmoc-amino acid was added to the resin and the mixture was allowed to react for 30-90 min. The resin was washed with DMF in preparation for the next elongation cycle. The fully protected, resin bound peptide was subjected to a piperidine cycle to remove the terminal Fmoc group. The product was washed with dichloromethane and dried. The resin was then treated with trifluoroacetic acid in the presence of appropriate scavengers [e.g. 5% (v/v) water] for 60 minutes at 20° C. After evaporation of excess trifluoroacetic acid, the crude peptide was washed with dimethyl ether, dissolved in water and lyophilized. The peptides wee purified to >95% homogeneity by reverse-phase HPLC using $H_2O/CH_3CN$ gradients containing 0.2% TFA modifier on a Vydac, 300 Å pore-size, C-18 preparative column. The purity of the synthetic peptides was assayed on an analytical reverse-phase column, and their composition ascertained by amino acid analysis and/or sequencing. Peptides were routinely dissolved in DMSO at the concentration of 20 mg/ml.

2. Media.

RPMI-1640 containing 10% fetal calf serum (FCS) 2 mM Glutamine, 50 íg/ml Gentamicin and $5\times10^{-5}$M 2-mercaptoethanol served as culture medium and will be referred to as R10 medium.

RPMI-1640 containing 25 mM Hepes buffer and supplemented with 2% FCS was used as cell washing medium.

3. Rat Concanavalin A Supernatant.

The spleen cells obtained from Lewis rats (Sprague-Dawley) were resuspended at a concentration of $5\times10^6$ cells/ml in R10 medium supplemental with 5 μg/ml of ConA in 75 cm2 tissue culture flasks. After 48 hr at 37° C., the supernatants were collected, supplemented with 1% methyl-D-mannoside and filter sterilized (0.45 μm filter). Aliquots were stored frozen at −20° C.

4. LPS-Activated Lymphoblasts.

Murine splenocytes were resuspended at a concentration of $1\text{-}1.5\times10^6$/ml in R10 medium supplemented with 25 μg/ml LPS and 7 μg/ml dextran sulfate in 75 $cm^2$ tissue culture flasks. After 72 hours at 37° C., the lymphoblasts were collected for use by centrifugation.

5. Peptide Coating of Lymphoblasts.

Coating of the LPS activated lymphoblasts was achieved by incubating $30\times10^6$ lymphoblasts with 100 μg of peptide in 1 ml of R10 medium for 1 hr at 37° C. Cells were then washed once and resuspended in R10 medium at the desired concentration for use in in vitro CTL activation.

6. Peptide Coating of Jurkat A2/$K^b$ Cells.

Peptide coating was achieved by incubating $10\times10^6$ irradiated (20,000 rads) Jurkat A2.1/$K^b$ cells with 20 μg of peptide in 1 ml of R10 medium for 1 hour at 37° C. Cells were washed three times and resuspended at the required concentration in R10 medium.

7. In Vitro CTL Activation.

One to four weeks after priming spleen cells ($5\times10^6$ cells/well or $30\times10^6$ cells/T25 flask) were concultured at 37° C. with syngeneic, irradiated (3,000 rads), peptide coated lymphoblasts ($2\times10^6$ cells/well or $10\times10^6$ cells/T25 flask) in R10 medium to give a final volume of 2 ml in 24-well plates or 10 ml in T25 flasks.

8. Restimulation of Effector Cells.

Seven to ten days after the initial in vitro activation, described in paragraph 7 above, a portion of the effector cells were restimulated with irradiated (20,000 rads), peptide-coated Jurkat A2/$K^b$ cells ($0.2\times10^6$ cells/well) in the presence of $3\times10^6$ "feeder cells"/well (C57B1/6 irradiated spleen cells) in R10 medium supplemented with 5% rat ConA supernatant to help provide all of the cytokines needed for optimal effector cell growth.

9. Assay for Cytotoxic Activity.

Target cells ($3\times10^6$) were incubated at 37° C. in the presence of 200 μl of sodium $^{51}$Cr chromate. After 60 minutes, cells were washed three times and resuspended in R10 medium. Peptides were added at the required concentration. For the assay, $10^4$ $^{51}$Cr-labeled target cells wee added to different concentrations of effector cells (final volume of 200 μl) in U-bottom 96-well plates. After a 6-hour incubation period at 37° C., 0.1 ml aliquots of supernatant were removed from each well and radioactivity was determined in a Micromedic automatic gamma counter. The percent specific lysis was determined by the formula: percent specific release=100×(experimental release−spontaneous release)/(maximum release−spontaneous release). Where peptide titrations wee performed, the antigenicity of a given peptide (for comparison purposes) was expressed as the peptide concentration required to induce 40% specific $^{51}$Cr release at a given E:T.

Transgenic mice were injected subcutaneously in the base of the tail with an incomplete Freund's adjuvant emulsion containing 50 nM of the putative CTL epitopes containing the A2.1 motifs, and 50 nM of a hepatitis B core T helper epitope. Eight to 20 days later, animals were sacrificed and spleen cells were restimulated in vitro with syngeneic LPS lymphoblasts coated with the putative CTL epitope. A source of IL-2 (rat con A supernatant) was added at day 6 of the assay to a final concentration of 5% and CTL activity was measured on day 7. The capacity of these effector T cells to lyse peptide-coated target cells that express the A2 KB molecule (Jurkat A2 KB) was measured as lytic units. The results are presented in Tables 147 and 148.

The results of this experiment indicate that those peptides having a binding of at least 0.01 are capable of inducing CTL. All of the peptides in TABLES 181 and 182 having a binding of at least about 0.01 would be immunogenic.

Example 36

Algorithms to Identify Immunogenic Peptides

In light of results presented in the examples above, algorithms were developed to provide a more exact predictor of binding based upon the effects of different residues at each position of a peptide sequence, in addition to the anchor or conserved residues. More specifically, we utilize the data bank obtained during the screening of our collection of A1, 3, 11 or 24 motif-containing peptides to develop an algorithm for each particular allele which assigns a score for each amino acid at each position along a peptide. The score for each residue is taken as the ratio of the frequency of that residue in good and intermediate binders to the frequency of occurrence of that residue in nonbinders.

In the present algorithm residues have been grouped by similarity. This avoids the problem encountered with some rare residues, such as tryptophan, where there are too few occurrences to obtain a statistically significant ratio. A listing is made of scores obtained by grouping for each of the twenty amino acids by position for 9-mer peptides containing conserved residues that define their motif (2/9 motifs). A peptide is scored in the algorithm as a product of the scores of each of its residues.

The power of an algorithm to correlate with binding is further underlined by its ability to predict a population of peptides with the highest occurrence of good binders. If one were to rely, for example, solely on the 2/9 motif for predicting 9-mer peptides which bind to a specific MHC allele the large number of peptides containing the motif would be predicted to be good binders. In fact only a relatively small percentage of these peptides are good binders and a somewhat larger percentage are intermediate binders, while a still larger percentage of the peptides predicted by the motif are either weak or nonbinding peptides. In contrast, using the grouped algorithm of this invention a population of peptides are created with a greater percentage of good binders, a still greater percentage of intermediate binders, and a smaller percentage, relative to that predicted by motif-containing peptides, are weak and nonbinders.

The present example of an algorithm uses the ratio of the frequency of occurrence of an amino acid in binders and nonbinders to measure the impact of a particular residue at each position of a peptide. It is immediately apparent to one of ordinary skill in the art that there are alternative ways of creating a similar algorithm. For example, one could use average binding affinity values, or relative binding of single amino acid substitutions in a motif containing peptide with a poly-alanine backbone to generate an algorithm table.

An algorithm using average binding affinity has the advantage of including all of the peptides in the analysis, and not just good/intermediate binders and nonbinders. Moreover, it gives a more quantitative measure of affinity than the simpler group ratio algorithm. We have created such an algorithm by calculating for each amino acid, by position, the average log of binding when that particular residue occurs in our set of motif containing peptides. The algorithm score for a peptide is then taken as the sum of the scores by position for each of its residues.

Example 37

Analysis of the Immunogenicity of CTL and HTL Peptides

Class I and II antigen isolation was carried out as described in the related applications, noted above. Naturally processed peptides were then isolated and sequenced as described there. An allele-specific motif and algorithms were determined and quantitative binding assays were carried out.

Using the motifs identified above for HLA-A2.1 and other allele amino acid sequences from a number of antigens were analyzed for the presence of these motifs. TABLE 2 provides the results of these searches. The letter "J" represents norleucine.

Analyses of CTL and HTL responses against the immunogen, as well as against common recall antigens are commonly used and are known in the art. Assays employed included chromium release, lymphokine secretion and lymphoproliferation assays. Assays useful in these determinations are described in *Current Protocols in Immunology*, J. E. Coligan, et al., eds., John Wiley & Sons Press (2000), chapters 3, 4, 6, and 7.

In one embodiment, the appropriate antigen-presenting cells are incubated with 10-100 μM of peptide in serum-free media for 4 hours under appropriate culture conditions. The peptide-loaded antigen-presenting cells are then incubated with the responder cell populations in vitro for 7 to 10 days under optimized culture conditions. If screening for MHC class I presented peptides, positive CTL activation can be determined by assaying the cultures for the presence of CTLs that kill radiolabeled target cells, both specific peptide-pulsed targets as well as target cells expressing the endogenously processed form of the relevant virus or tumor antigen from which the peptide sequence was derived. If screening for MHC class II-presented peptides, positive HTL activation can be determined by assaying cultures for cytokine production or proliferation.

In one embodiment, prior to incubation of the stimulator cells with the cells to be activated, i.e., precursor CD8+ cells, an amount of antigenic peptide is added to the stimulator cell culture, of sufficient quantity to become loaded onto the human Class I molecules to be expressed on the surface of the stimulator cells. In the present invention, a sufficient amount of peptide is an amount that will allow about 200, and preferably 200 or more, human Class I MHC molecules loaded with peptide to be expressed on the surface of each stimulator cell. Preferably, the stimulator cells are incubated with >20 μg/ml peptide.

Resting or precursor CD8+ cells are then incubated in culture with the appropriate stimulator cells for a time period sufficient to activate the CD8+ cells. Preferably, the CD8+ cells are activated in an antigen-specific manner. The ratio of resting or precursor CD8+ (effector) cells to stimulator cells may vary from individual to individual and may further depend upon variables such as the amenability of an individual's lymphocytes to culturing for which the within-described treatment modality is used. Preferably, however, the lymphocyte:stimulator cell ratio is in the range of about 30:1 to 300:1. The effector/stimulator culture may be maintained for as long a time as is conditions and the nature and severity of the disease condition or other condition necessary to stimulate a therapeutically useable or effective number of CD8+ cells.

The induction of CTL in vitro requires the specific recognition of peptides that are bound to allele specific MHC class I molecules on APC. The number of specific MHC/peptide complexes per APC is crucial for the stimulation of CTL, particularly in primary immune responses. While small amounts of peptide/MHC complexes per cell are sufficient to render a cell susceptible to lysis by CTL, or to stimulate a secondary CTL response, the successful activation of a CTL precursor (pCTL) during primary response requires a significantly higher number of MHC/peptide complexes. Peptide loading of empty major histocompatability complex molecules on cells allows the induction of primary cytotoxic T lymphocyte responses. Peptide loading of empty major histocompatability complex molecules on cells enables the induction of primary cytotoxic T lymphocyte responses.

Since mutant cell lines do not exist for every human MHC allele, it is advantageous to use a technique to remove endogenous MHC-associated peptides from the surface of APC, followed by loading the resulting empty MHC molecules with the immunogenic peptides of interest. The use of non-transformed (non-tumorigenic), non-infected cells, and preferably, autologous cells of patients as APC is desirable for the design of CTL induction protocols directed towards development of ex vivo CTL therapies. This application discloses methods for stripping the endogenous MHC-associated peptides from the surface of APC followed by the loading of desired peptides.

A stable MHC class I molecule is a trimeric complex formed of the following elements: 1) a peptide usually of 8-10 residues, 2) a transmembrane heavy polymorphic protein chain which bears the peptide-binding site in its α1 and α2 domains, and 3) a non-covalently associated non-polymorphic light chain, $\beta_2$ microglobulin. Removing the bound peptides and/or dissociating the β2 microglobulin from the complex renders the MHC class I molecules nonfunctional and unstable, resulting in rapid degradation. All MHC class I molecules isolated from PBMCs have endogenous peptides bound to them. Therefore, the first step is to remove all endogenous peptides bound to MHC class I molecules on the APC without causing their degradation before exogenous peptides can be added to then.

Two possible ways to free up MHC class I molecules of bound peptides include lowering the culture temperature from 37° C. to 26° C. overnight to destablize β2 microglobulin and stripping the endogenous peptides from the cell using a mild acid treatment. The methods release previously bound peptides into the extracellular environment allowing new exogenous peptides to bind to the empty class I molecules. The cold-temperature incubation method enables exogenous peptides to bind efficiently to the MHC complex, but requires an overnight incubation at 26° C. which may slow the cell's metabolic rate. It is also likely that cells not actively synthesizing MHC molecules (e.g., resting PBMC) would not produce high amounts of empty surface MHC molecules by the cold temperature procedure.

Harsh acid stripping involves extraction of the peptides with trifluoroacetic acid, pH 2, or acid denaturation of the immunoaffinity purified class I-peptide complexes. These methods are not feasible for CTL induction, since it is important to remove the endogenous peptides while preserving APC viability and an optimal metabolic state which is critical for antigen presentation. Mild acid solutions of pH 3 such as glycine or citrate-phosphate buffers have been used to identify endogenous peptides and to identify tumor associated T cell epitopes. The treatment is especially effective, in that only the MHC class I molecules are destabilized (and associated peptides released), while other surface antigens remain intact, including MHC class II molecules. Most importantly, treatment of cells with the mild acid solutions does not affect the cell's viability or metabolic state. The mild acid treatment is rapid since the stripping of the endogenous peptides occurs in two minutes at 4° C. and the APC is ready to perform its function after the appropriate peptides are loaded. The technique is utilized herein to make peptide-specific APCs for the generation of primary antigen-specific CTL. The resulting APC are efficient in inducing peptide-specific CD8+ CTL.

Activated CD8+ cells may be effectively separated from the stimulator cells using one of a variety of known methods. For example, monoclonal antibodies specific for the stimulator cells, for the peptides loaded onto the stimulator cells, or for the CD8+ cells (or a segment thereof) may be utilized to bind their appropriate complementary ligand. Antibody-tagged molecules may then be extracted from the stimulator-effector cell admixture via appropriate means, e.g., via well-known immunoprecipitation or immunoassay methods.

Effective, cytotoxic amounts of the activated CD8+ cells can vary between in vitro and in vivo uses, as well as with the amount and type of cells that are the ultimate target of these killer cells. The amount will also vary depending on the condition of the patient and should be determined via consideration of all appropriate factors by the practitioner. Preferably, however, about $1\times10^6$ to about $1\times10^{12}$, more preferably about $1\times10^8$ to about $1\times10^{11}$, and even more preferably, about $1\times10^9$ to about $1\times10^{10}$ activated CD8+ cells are utilized for adult humans, compared to about $5\times10^6$-$5\times10^7$ cells used in mice.

Preferably, as discussed above, the activated CD8+ cells are harvested from the cell culture prior to administration of the CD8+ cells to the individual being treated. It is important to note, however, that unlike other present and proposed treatment modalities, the present method uses a cell culture system that is not tumorigenic. Therefore, if complete separation of stimulator cells and activated CD8+ cells is not achieved, there is no inherent danger known to be associated with the administration of a small number of stimulator cells, whereas administration of mammalian tumor-promoting cells may be extremely hazardous.

Methods of re-introducing cellular components are known in the art and include procedures such as those exemplified in U.S. Pat. No. 4,844,893 to Honsik, et al., and U.S. Pat. No. 4,690,915 to Rosenberg. For example, administration of activated CD8+ cells via intravenous infusion is appropriate.

The peptides of the invention can be identified and tested for in vivo immunogenicity using HLA transgenic mice. The utility of HLA transgenic mice for the purpose of epitope identification (Sette et al., *J Immunol,* 153:5586-92 (1994); Wentworth et al., *Int Immunol,* 8:651-9 (1996); Engelhard et al., *J Immunol,* 146:1226-32 (1991); Man et al., *Int Immunol,* 7:597-605 (1995); Shirai et al., *J Immunol,* 154:2733-42 (1995)), and vaccine development (Ishioka et al., *J Immunol,* 162:3915-25 (1999)) has been established. Most of the published reports have investigated the use of HLA A2.1/$K^b$ mice but it should be noted that B*27, and B*3501 mice are also available. Furthermore, HLA A*11/$K^b$ mice (Alexander et al., *J. Immunol.,* 159:4753-61 (1997)), and HLA B7/$K^b$ and HLA A1/$K^b$ mice have also been generated. Data from 38 different potential epitopes was analyzed to determine the level of overlap between the A2.1-restricted CTL repertoire of A2.1/$K^b$-transgenic mice and A2.1+ humans (Wentworth et al., *Eur J Immunol,* 26:97-101 (1996)). In both humans and mice, an MHC peptide binding affinity threshold of approximately 500 nM correlates with the capacity of a peptide to elicit a CTL response in vivo. A high level of concordance between the human data in vivo and mouse data in vivo was observed for 85% of the high-binding peptides, 58% of the intermediate binders, and 83% of the low/negative binders. Similar results were also obtained with HLA A11 and HLA B7 transgenic mice (Alexander et al., *J Immunol*, Vol. 159 (10):4753-61 (1997)). Thus, because of the extensive overlap that exists between T cell receptor repertoires of HLA transgenic mouse and human CTLs, transgenic mice are valuable for assessing immunogenicity of the multi-epitope constructs described herein. Peptides binding to MHC class II alleles can be examined using HLA-DR transgenic mice. See, i.e., Taneja V., David C. S., *Immunol Rev,* 169:67-79 (1999)).

More sensitive techniques such as the ELISPOT assay, intracellular cytokine staining, and tetramer staining have become available in the art to determine lymphocyte antigen responsiveness. It is estimated that these newer methods are 10- to 100-fold more sensitive than the common CTL and HTL assays (Murali-Krishna et al., *Immunity,* 8:177-87 (1998)), because the traditional methods measure only the subset of T cells that can proliferate in vitro, and may, in fact, be representative of only a fraction of the memory T cell compartment (Ogg G. S., McMichael A. J., *Curr Opin Immunol,* 10:393-6 (1998)). Specifically in the case of HIV, these techniques have been used to measure antigen-specific CTL responses from patients that would have been undetectable with previous techniques (Ogg et al., *Science,* 279:2103-6 (1998); Gray et al., *J Immunol,* 162:1780-8 (1999); Ogg et al., *J Virol,* 73:9153-60 (1999); Kalams et al., *J Virol,* 73:6721-8 (1999); Larsson et al., *AIDS,* 13:767-77 (1999); Come et al., *J Acquir Immune Defic Syndr Hum Retrovirol,* 20:442-7 (1999)).

The peptides of the present invention and pharmaceutical and vaccine compositions thereof are useful for administration to mammals, particularly humans, to treat and/or prevent viral infection and cancer. Examples of diseases which can be treated using the immunogenic peptides of the invention include prostate cancer, hepatitis B, hepatitis C, AIDS, renal carcinoma, cervical carcinoma, lymphoma, CMV and chondyloma acuminatum. A protective (or prophylatic) vaccine includes one that will protect against future exposure to pathogen or cancer. A therapeutic vaccine includes one that will ameriolate, attenuate, or ablate symptoms or disease state induced by or related to a pathogen or malignancy.

In circumstances in which efficacy of a prophylactic vaccine is primarily correlated with the induction of a long-lasting memory response, restimulation assays can be the most appropriate and sensitive measures to monitor vaccine-induced immunological responses. Conversely, in the case of therapeutic vaccines, the main immunological correlate of activity can be the induction of effector T cell function, most aptly measured by primary assays. Thus, the use of sensitive assays allows for the most appropriate testing strategy for immunological monitoring of vaccine efficacy.

The induction of CTL in vitro requires the specific recognition of peptides that are bound to allele specific MHC class I molecules on APC. The number of specific MHC/peptide complexes per APC is crucial for the stimulation of CTL, particularly in primary immune responses. While small amounts of peptide/MHC complexes per cell are sufficient to render a cell susceptible to lysis by CTL, or to stimulate a secondary CTL response, the successful activation of a CTL precursor (pCTL) during primary response requires a significantly higher number of MHC/peptide complexes. Peptide loading of empty major histocompatability complex molecules on cells allows the induction of primary cytotoxic T lymphocyte responses. Peptide loading of empty major histocompatability complex molecules on cells enables the induction of primary cytotoxic T lymphocyte responses.

Since mutant cell lines do not exist for every human MHC allele, it is advantageous to use a technique to remove endogenous MHC-associated peptides from the surface of APC, followed by loading the resulting empty MHC molecules with the immunogenic peptides of interest. Antigen-presenting cells can be normal cells such as peripheral blood mononuclear cells or dendritic cells (Inaba, et al., *J. Exp. Med.* 166:182 (1987); Boog, *Eur. J. Immunol.* 18:219 (1988)). The use of non-transformed (non-tumorigenic), non-infected cells, and preferably, autologous cells of patients as APC is desirable for the design of CTL induction protocols directed towards development of ex vivo CTL therapies. This application discloses methods for stripping the endogenous MHC-associated peptides from the surface of APC followed by the loading of desired peptides.

A stable MHC class I molecule is a trimeric complex formed of the following elements: 1) a peptide usually of 8-10 residues, 2) a transmembrane heavy polymorphic protein chain which bears the peptide-binding site in its $\alpha1$ and $\alpha2$ domains, and 3) a non-covalently associated non-polymorphic light chain, $\beta_2$ microglobulin. Removing the bound peptides and/or dissociating the $\beta_2$ microglobulin from the complex renders the MHC class I molecules nonfunctional and unstable, resulting in rapid degradation. All MHC class I molecules isolated from PBMCs have endogenous peptides bound to them. Therefore, the first step is to remove all endogenous peptides bound to MHC class I molecules on the APC without causing their degradation before exogenous peptides can be added to them.

Two possible ways to free up MHC class I molecules of bound peptides include lowering the culture temperature from 37° C. to 26° C. overnight to destabilize $\beta_2$ microglobulin and stripping the endogenous peptides from the cell using a mild acid treatment. The methods release previously bound peptides into the extracellular environment allowing new exogenous peptides to bind to the empty class I molecules. The cold-temperature incubation method enables exogenous peptides to bind efficiently to the MHC complex, but requires an overnight incubation at 26° C. which may slow the cell's metabolic rate. It is also likely that cells not actively synthesizing MHC molecules (e.g., resting PBMC) would not produce high amounts of empty surface MHC molecules by the cold temperature procedure.

Harsh acid stripping involves extraction of the peptides with trifluoroacetic acid, pH 2, or acid denaturation of the immunoaffinity purified class I-peptide complexes. These methods are not feasible for CTL induction, since it is important to remove the endogenous peptides while preserving APC viability and an optimal metabolic state which is critical for antigen presentation. Mild acid solutions of pH 3 such as glycine or citrate-phosphate buffers have been used to identify endogenous peptides and to identify tumor associated T cell epitopes. The treatment is especially effective, in that only the MHC class I molecules are destabilized (and associated peptides released), while other surface antigens remain intact, including MHC class II molecules. Most importantly, treatment of cells with the mild acid solutions do not affect the cell's viability or metabolic state. The mild acid treatment is rapid since the stripping of the endogenous peptides occurs in two minutes at 4° C. and the APC is ready to perform its function after the appropriate peptides are loaded. The technique is utilized herein to make peptide-specific APCs for the generation of primary antigen-specific CTL. The resulting APC are efficient in inducing peptide-specific CD8+ CTL.

Activated CD8+ cells may be effectively separated from the stimulator cells using one of a variety of known methods. For example, monoclonal antibodies specific for the stimulator cells, for the peptides loaded onto the stimulator cells, or for the CD8+ cells (or a segment thereof) may be utilized to bind their appropriate complementary ligand. Antibody-tagged molecules may then be extracted from the stimulator-effector cell admixture via appropriate means, e.g., via well-known immunoprecipitation or immunoassay methods.

Effective, cytotoxic amounts of the activated CD8+ cells can vary between in vitro and in vivo uses, as well as with the amount and type of cells that are the ultimate target of these killer cells. The amount will also vary depending on the condition of the patient and should be determined via consideration of all appropriate factors by the practitioner. Preferably, however, about $1\times10^6$ to about $1\times10^{12}$, more preferably about $1\times10^8$ to about $1\times10^{11}$, and even more preferably, about $1\times10^9$ to about $1\times10^{10}$ activated CD8+ cells are utilized for adult humans, compared to about $5\times10^6$-$5\times10^7$ cells used in mice.

Preferably, as discussed above, the activated CD8+ cells are harvested from the cell culture prior to administration of the CD8+ cells to the individual being treated. It is important to note, however, that unlike other present and proposed treatment modalities, the present method uses a cell culture system that is not tumorigenic. Therefore, if complete separation of stimulator cells and activated CD8+ cells is not achieved, there is no inherent danger known to be associated with the administration of a small number of stimulator cells, whereas administration of mammalian tumor-promoting cells may be extremely hazardous.

Methods of re-introducing cellular components are known in the art and include procedures such as those exemplified in U.S. Pat. No. 4,844,893 to Honsik, et al. and U.S. Pat. No. 4,690,915 to Rosenberg. For example, administration of activated CD8+ cells via intravenous infusion is appropriate.

Example 38

Use of Peptide Epitopes as Diagnostic Agents for Evaluating Immune Responses In one embodiment of the invention, HLA class I and class II binding peptides can be used as reagents to evaluate an immune response. The evaluated immune response can be induced by any immunogen. For example, the immunogen may result in the production of antigen-specific CTLs or HTLs that recognize the peptide epitope(s) employed as the reagent. Thus, a peptide of the invention mayor may not be used as the immunogen. Assay systems that can be used for such analyses include tetramer-based protocols, staining for intracellular lymphokines, interferon release assays, or ELISPOT assays.

For example, following exposure to a putative immunogen, a peptide of the invention can be used in a tetramer staining assay to assess peripheral blood mononuclear cells for the presence of any antigen-specific CTLs. The HLA-tetrameric complex is used to directly visualize antigen-specific CTLs and thereby determine the frequency of such antigen-specific CTLs in a sample of peripheral blood mononuclear cells (see, e.g., Ogg et al., *Science* 279:2103-2106, 1998; and Altman et al., *Science* 174:94-96, 1996).

A tetramer reagent comprising a peptide of the invention is generated as follows: A peptide that binds to an HLA molecule is refolded in the presence of the corresponding HLA heavy chain and P2-microglobulin to generate a trimolecular complex. The complex is biotinylated at the carboxyl terminal end of the HLA heavy chain, at a site that was previously engineered into the protein. Tetramer formation is then induced by adding streptavidin. When fluorescently labeled streptavidin is used, the tetrameric complex is used to stain antigen-specific cells. The labeled cells are then readily identified, e.g., by flow cytometry. Such procedures are used for diagnostic or prognostic purposes; the cells identified by the procedure can be used for therapeutic purposes.

Peptides of the invention are also used as reagents to evaluate immune recall responses. (see, e.g., Bertoni et al., *J C/in. Invest.* 100:503-513, 1997 and Penna et al., *J Exp. Med.* 174:1565-1570, 1991). For example, a PBMC sample from an individual expressing a disease-associated antigen (e.g. a tumor-associated antigen such as CEA, p53, MAGE2/3, HER2/neu, or an organism associated with neoplasia such as HPV or HSV) can be analyzed for the presence of antigen-specific CTLs or HTLs using specific peptides. A blood sample containing mononuclear cells may be evaluated by cultivating the PBMCs and stimulating the cells with a peptide of the invention. After an appropriate cultivation period, the expanded cell population may be analyzed, for example, for CTL or for HTL activity.

Thus, the peptides can be used to evaluate the efficacy of a vaccine. PBMCs obtained from a patient vaccinated with an immunogen may be analyzed by methods such as those described herein. The patient is HLA typed, and peptide epitopes that are bound by the HLA molecule(s) present in that patient are selected for analysis. The immunogenicity of the vaccine is indicated by the presence of CTLs and/or HTLs directed to epitopes present in the vaccine.

The peptides of the invention may also be used to make antibodies, using techniques well known in the art (see, e.g. *CURRENT PROTOCOLS IN IMMUNOLOGY*, Wiley/Greene, NY; and *Antibodies A Laboratory Manual Harlow*, Harlow and Lane, Cold Spring Harbor Laboratory Press, 1989). Such antibodies are useful as reagents to determine the presence of disease-associated antigens or may be used therapetucially. Antibodies in this category include those that recognize a peptide when bound by an HLA molecule, i.e., antibodies that bind to a peptide-MHC complex.

The immunogenic peptides of this invention may also be used to make monoclonal antibodies. Such antibodies may be useful as potential diagnostic or therapeutic agents.

Epitopes in accordance with the present invention were successfully used to induce an immune response. Immune responses with these epitopes have been induced by administering the epitopes in various forms. The epitopes have been administered as peptides, as nucleic acids, and as viral vectors comprising nucleic acids that encode the epitope(s) of the invention. Upon administration of peptide-based epitope forms, immune responses have been induced by direct loading of an epitope onto an empty HLA molecule that is expressed on a cell, and via internalization of the epitope and processing via the HLA class I pathway; in either event, the HLA molecule expressing the epitope was then able to interact with and induce a CTL response. Peptides can be delivered directly or using such agents as liposomes. They can additionally be delivered using ballistic delivery, in which the peptides are typically in a crystalline form. When DNA is used to induce an immune response, it is administered either as naked DNA, generally in a dose range of approximately 1-5 mg, or via the ballistic "gene gun" delivery, typically in a dose range of approximately 10-100 μg. The DNA can be delivered in a variety of conformations, e.g., linear, circular etc. Various viral vectors have also successfully been used that comprise nucleic acids which encode epitopes in accordance with the invention.

Accordingly compositions in accordance with the invention exist in several forms. Embodiments of each of these composition forms in accordance with the invention have been successfully used to induce an immune response.

One composition in accordance with the invention comprises a plurality of peptides. This plurality or cocktail of peptides is generally admixed with one or more pharmaceutically acceptable excipients. The peptide cocktail can comprise multiple copies of the same peptide or can comprise a mixture of peptides. The peptides can be analogs of naturally occurring epitopes. The peptides can comprise artificial amino acids and/or chemical modifications such as addition of a surface active molecule, e.g., lipidation; acetylation, glycosylation, biotinylation, phosphorylation etc. The peptides can be CTL or HTL epitopes. In a preferred embodiment the peptide cocktail comprises a plurality of different CTL epitopes and at least one HTL epitope. The HTL epitope can be naturally or non-naturally (e.g., PADRE®, Epimmune Inc., San Diego, Calif.). The number of distinct epitopes in an embodiment of the invention is generally a whole unit integer from one through one hundred fifty (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or, 100).

An additional embodiment of a composition in accordance with the invention comprises a polypeptide multi-epitope construct, i.e., a polyepitopic peptide. Polyepitopic peptides in accordance with the invention are prepared by use of technologies well-known in the art. By use of these known technologies, epitopes in accordance with the invention are connected one to another. The polyepitopic peptides can be linear or non-linear, e.g., multivalent. These polyepitopic constructs can comprise artificial amino acids, spacing or spacer amino acids, flanking amino acids, or chemical modifications between adjacent epitope units. The polyepitopic construct can be a heteropolymer or a homopolymer. The polyepitopic constructs generally comprise epitopes in a quantity of any whole unit integer between 2-150 (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or, 100). The polyepitopic construct can comprise CTL and/or HTL epitopes. One or more of the epitopes in the construct can be modified, e.g., by addition of a surface active material, e.g. a lipid, or chemically modified, e.g., acetylation, etc. Moreover, bonds in the multiepitopic construct can be other than peptide bonds, e.g., covalent bonds, ester or ether bonds, disulfide bonds, hydrogen bonds, ionic bonds etc.

Alternatively, a composition in accordance with the invention comprises construct which comprises a series, sequence, stretch, etc., of amino acids that have homology to (i.e., corresponds to or is contiguous with) to a native sequence. This stretch of amino acids comprises at least one subsequence of amino acids that, if cleaved or isolated from the longer series of amino acids, functions as an HLA class I or HLA class II epitope in accordance with the invention. In this embodiment, the peptide sequence is modified, so as to become a construct as defined herein, by use of any number of techniques known or to be provided in the art. The polyepitopic constructs can contain homology to a native sequence in any whole unit integer increment from 70-100%, e.g., 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or, 100 percent.

A further embodiment of a composition in accordance with the invention is an antigen presenting cell that comprises one or more epitopes in accordance with the invention. The antigen presenting cell can be a "professional" antigen presenting cell, such as a dendritic cell. The antigen presenting cell can comprise the epitope of the invention by any means known or to be determined in the art. Such means include pulsing of dendritic cells with one or more individual epitopes or with one or more peptides that comprise multiple epitopes, by nucleic acid administration such as ballistic nucleic acid delivery or by other techniques in the art for administration of nucleic acids, including vector-based, e.g. viral vector, delivery of nucleic acids.

Further embodiments of compositions in accordance with the invention comprise nucleic acids that encode one or more peptides of the invention, or nucleic acids which encode a polyepitopic peptide in accordance with the invention. As appreciated by one of ordinary skill in the art, various nucleic acids compositions will encode the same peptide due to the redundancy of the genetic code. Each of these nucleic acid compositions falls within the scope of the present invention. This embodiment of the invention comprises DNA or RNA, and in certain embodiments a combination of DNA and RNA. It is to be appreciated that any composition comprising nucleic acids that will encode a peptide in accordance with the invention or any other peptide based composition in accordance with the invention, falls within the scope of this invention.

It is to be appreciated that peptide-based forms of the invention (as well as the nucleic acids that encode them) can comprise analogs of epitopes of the invention generated using principles already known, or to be known, in the art. Principles related to analoging are now known in the art, and are disclosed herein; moreover, analoging principles are disclosed in co-pending application serial number U.S. Ser. No. 09/226,775 filed 6 Jan. 1999. Generally the compositions of the invention are isolated or purified.

The peptides may also find use as diagnostic reagents. For example, a peptide of the invention may be used to determine the susceptibility of a particular individual to a treatment regimen which employs the peptide or related peptides, and thus may be helpful in modifying an existing treatment protocol or in determining a prognosis for an affected individual. In addition, the peptides may also be used to predict which individuals will be at substantial risk for developing chronic infection.

To identify peptides of the invention, class I antigen isolation, and isolation and sequencing of naturally processed peptides was carried out as described in the related applications. These peptides were then used to define specific binding motifs for each of the following alleles A3.2, A1, A11, and A24.1. These motifs are described on page 3, above. The motifs described in TABLES 6-9, below, are defined from pool sequencing data of naturally processed peptides as described in the related applications.

Example 39

Ex Vivo Induction of Cytotoxic T Lymphocytes (CTL)

Peripheral blood mononuclear cells (PBMC) are isolated from an HLA-typed patient by either venipuncture or apheresis (depending upon the initial amount of CTLp required), and purified by gradient centrifugation using Ficoll-Paque (Pharmacia). Typically, one can obtain one million PBMC for every ml of peripheral blood, or alternatively, a typical apheresis procedure can yield up to a total of 1-10×$10^{10}$ PBMC.

The isolated and purified PBMC are co-cultured with an appropriate number of antigen presenting cell (APC), previously incubated ("pulsed") with an appropriate amount of synthetic peptide (containing the HLA binding motif and the sequence of the antigen in question). PBMC are usually incubated at 1-2×$10^6$ cells/ml in culture medium such as RPMI-1640 (with autologous serum or plasma) or the serum-free medium AIM-V (Gibco).

APC are usually used at concentrations ranging from 1×$10^4$ to 2×$10^5$ cells/ml, depending on the type of cell used. Possible sources of APC include: 1) autologous dendritic cells (DC), which are isolated from PBMC and purified as described (Inaba, et al., *J. Exp. Med.,* 166:182 (1987)); and 2) mutant and genetically engineered mammalian cells that express "empty" HLA molecules (which are syngeneic [genetically identical] to the patient's allelic HLA form), such as the, mouse RMA-S cell line or the human T2 cell line. APC containing empty HLA molecules are known to be potent inducers of CTL responses, possibly because the peptide can associate more readily with empty MHC molecules than with MHC molecules which are occupied by other peptides (De-Bruijn, et al., *Eur. J. Immunol.,* 21:2963-2970 (1991)).

In those cases when the APC used are not autologous, the cells will have to be gamma irradiated with an appropriate dose (using, e.g., radioactive cesium or cobalt) to prevent their proliferation both ex vivo, and when the cells are re-introduced into the patients.

The mixture cultures, containing PBMC, APC and peptide are kept in an appropriate culture vessel such as plastic T-flasks, gas-permeable plastic bags, or roller bottles, at 37° centigrade in a humid air/$CO_2$ incubator. After the activation phase of the culture, which usually occurs during the first 3-5 days, the resulting effector CTL can be further expanded, by the addition of recombinant DNA-derived growth factors such as interleukin-2 (IL-2), interleukin-4 (IL-4), or interleukin-7 (IL-7) to the cultures. An expansion culture can be kept for an additional 5 to 12 days, depending on the numbers of effector CTL required for a particular patient. In addition, expansion cultures may be performed using hollow fiber artificial capillary systems (Cellco), where larger numbers of cells (up to 1×$10^{11}$) can be maintained.

Before the cells are infused into the patient, they are tested for activity, viability, toxicity and sterility. The cytotoxic activity of the resulting CTL can be determined by a standard $^{51}Cr$-release assay (Biddison, W. E. 1991, *Current Protocols in Immunology*, p 7,17.1-7.17.5, Ed. J. Coligan, et al., J. Wiley and Sons, New York), using target cells that express the appropriate HLA molecule, in the presence and absence of the immunogenic peptide. Viability is determined by the exclusion of trypan blue dye by live cells. Cells are tested for the presence of endotoxin by conventional techniques. Finally, the presence of bacterial or fungal contamination is determined by appropriate microbiological methods (chocolate agar, etc.). Once the cells pass all quality control and safety tests, they are washed and placed in the appropriate infusion solution (Ringer/glucose lactate) and infused intravenously into the patient.

Example 40

Preparation of Effective HLA Allele-Specific Antigen Presenting Cells

This example demonstrates the use of cold temperature incubation or acid stripping/peptide loading method to prepare effective HLA-allele-specific antigen presenting cells (APC). The APC were used to sensitize precursor cytotoxic T lymphocytes which led to the development of antigen-specific cytotoxic cells. This was accomplished using either phytohemaglutinin (PHA) T-cell blasts or peripheral blood mononuclear cells (PBMC) or *staphylococcus aureus* Cowan I (SAC-I) activated PBMC as APC. The results are applicable to other APC and to the other MHC alleles.

The following describes sources for materials used in the following examples:

L-Ascorbic acid, Cat #B582, J. T. Baker, Phillipsburg, N.J.

Anti-HLA A2 (BB7.2), Cat #HB82, ATCC, Rockville, Md.

Anti-HLA DR (LB3.1), from J. Gorga, Children's Hospital, Pittsburgh, Pa.

Anti-HLA Alpha chain pan ABC (9.12.1), from R. DeMars, University of Wisconsin, Madison, Wis.

Anti-mouse IgG FITC conjugate, Cat #F2883, Sigma, St. Louis, Mo.

$B_2$ microglobulin, Cat #MO114, Scripps Labs, San Diego, Calif.

BSA Fraction V, Cat #A9418, Sigma, St. Louis, Mo.

50 cc conical centrifuge tubes, Cat #2070, Falcon, Lincoln, Park, N.J.

Cryo 1° C. freezing container, Cat #5100-0001, Nalge, Rochester, N.Y.

Cryovial, Cat #5000-0012, Nalge, Rochester, N.Y.

Dimethyl sulfoxide (DMSO), Cat #D2650, Sigma, St. Louis, Mo.

DNAse, Cat #260912, Calbiochem, San Diego, Calif.

Dynabeads M-450 goat anti-mouse IgG, Cat #110.06, Dynal, Great Neck, N.Y.

EDTA tetrasodium salt, Cat #ED4SS, Sigma, St. Louis, Mo.

FACScan, Becton Dickinson, San Jose, Calif.

Fetal calf serum (FCS), Cat #3000, Irvine Scientific, Irvine, Calif.

Ficoll-Paque, Cat #17-0840-03, Pharmacia, Piscataway, N.J.

Gentamicin, Cat #600-5750AD, Gibco, Grand Island, N.Y.

L-Glutamine, Cat #9317, Irvine Scientific, Irvine, Calif.

GS-6KR centrifuge, Beckman Instruments, Palo Alto, Calif.

Human AB serum (HS), Cat #100-112, Gemini Bioproducts, Calabasas, Calif.

Human rIL-2, Sandoz, Basel, Switzerland.

Human rIL-7, Cat #F1-1587-1, Genzyme, Cambridge, Mass.

Isopropanol, Cat #A464-4, Fisher Scientific, Pittsburgh, Pa.

MicroCELLector T-150 culture flask for selection of CD4+ cells, Cat #8030, Applied Immune Sciences, Menlo Park, Calif.

Micromedic automatic gamma counter, ICN Micromedics Systems, Huntsville, Ala.

OKT4 hybridoma supernatant, Cat #CRL 8002, ATCC, Rockville, Md.

Paraformaldehyde, Cat #T-353, Fisher, Pittsburgh, Pa.

PBS calcium and magnesium free (CMF), Cat #17-516B, BioWhittaker, Walkersville, Md.

Peptides used in this study were synthesized at Cytel and described in TABLE 123.

Phytohemagglutinin (PHA), Cat #HA-16, Wellcome, Dartford, England.

RPMI 1640+Hepes+glutamine, Cat #12-115B, BioWhittaker, Walkersville, Md.

RPMI 1640+Hepes+glutamine, Cat #380-24OOAJ, Gibco, Grand Island, N.Y.

Sodium chloride (NaCl), Cat #3624-05, J. T. Baker, Phillipsburg, N.J.

Sodium ($^{51}Cr$) chromate, Cat #NEZ 030, NEN, Wilmington, Del.

Sodium phosphate monobasic, Cat #S9638, Sigma, St. Louis, Mo.

Triton X-100, Cat #X-100, Sigma, St. Louis, Mo.

24 well tissue culture plate, Cat #3047, Falcon, Becton Dickinson, San Jose, Calif.

96 well U-bottomed cluster plate, Cat #3799, Costar, Cambridge, Mass.

Culture Medium.

PHA blasts and CTL inductions were done in RPMI 1640+Hepes+glutamine (Gibco) supplemented with 2 mM L-glutamine (Irvine Scientific), 50 μg/ml gentamicin (Gibco), and 5% heat inactivated pooled human Type AB serum (Gemini Bioproducts) [RPMI/5% HS]. EBV transformed lymphoblastoid cell lines (LCL) were maintained in RPMI 1640+Hepes+glutamine (BioWhittaker) supplemented with L-glutamine and gentamicin as above and 10% heat inactivated fetal calf serum (Irvine Scientific) [RPMI/10% FCS]. Chromium release assays were performed in RPMI/10% FCS.

Cytokines.

Recombinant human interleukin-2 (rIL-2) (Sandoz) was used at a final concentration of 10 U/ml. Recombinant human interleukin-7 (rIL-7) (Genzyme) was used at a final concentration of 10 ng/ml.

Isolation of Peripheral Blood Mononuclear Cells (PBMC).

Whole blood was collected in heparin (10 U/ml) containing syringes and spun in 50 cc conical centrifuge tubes (Falcon) at 1600 rpm (Beckman GS-6KR) 15 min. The plasma layer was then removed and 10 ml of the buffy coat collected with a 10 ml pipette using a circular motion. The buffy coat was mixed thoroughly and diluted with an equal volume of serum free RPMI 1640. The diluted buffy coat was then layered over 20 ml Ficoll-Paque (Pharmacia) in a 50 cc conical tube and centrifuged 400×g for 20 min at room temperature with the brake off. The Ficoll-plasma interface containing the PBMCs was collected using a transfer pipet (two interfaces per 50 cc tube) and washed three times with 50 ml RPMI (1700, 1500, and 1300 rpm for 10 min.

Freezing and Thawing PBMC.

PBMC were frozen at $30\times10^6$ cells/ml of 90% FCS+10% DMSO (Sigma), in 1 ml aliquots using cyrovials (Nalge). Cryovials were placed in Cryo 1° C. freezing containers (Nalge) containing isopropanol (Fisher) and placed at −70° C. from 4 hr (minimum) to overnight (maximum). Isopropanol was changed after every 5 uses. Cryovials were transferred to liquid nitrogen for long term storage. PBMC were thawed by continuous shaking in a 37° C. water bath until the last crystal was nearly thawed. Cells were immediately diluted into serum free RPMI medium containing DNAse 30 μg/ml (to avoid clumping) (Calbiochem), and washed twice.

Depletion of Lymphocyte Subpopulations.

CD4 lymphocyte depletion was performed using antibody-coated flasks: MicroCELLector T-150 flasks for the selection of CD4+ cells (Applied Immune Sciences) were washed according to the manufacturer's instructions with 25 ml PBS CMF+1 mM EDTA (Sigma) by swirling flasks for 30 sec followed by incubation for 1 hr at room temperature on a flat surface. Buffer was aspirated and flasks were washed 2 additional times by shaking the flasks for 30 sec and maintaining coverage of the binding surface. To each washed flask, 25 ml culture medium+5% HS were added and incubated for 20 min at room temperature on a flat surface. Media was left in the flask until it was ready to receive the cells. PBMC were thawed in RPMI/5% HS containing 30 μg/ml DNAse, and washed twice. HS in the wash blocks Fc receptors on PBMCS. For one flask a maximum of $12\times10^7$ cells were resuspended in 25 ml culture medium. Culture medium was aspirated from the flask and then the cell suspension was gently added to the MicroCELLector. Flasks containing the cells were incubated for 1 hr at room temperature on a flat surface. At the end of the incubation, the flask was gently rocked from side to side for 10 sec to resuspend the nonadherent cells. Nonadherent CD4 depleted cells were harvested, and then flasks were washed twice with PBS CMF to collect the nonadherent cells. Harvested CD4-depleted cells were pelleted by centrifugation and resuspended in complete culture medium (RPMI/5%/HS).

Generation of PHA Blasts.

PBMC were isolated using the standard Ficoll-Paque protocol. Frozen cells were washed twice before use. Cells were cultured at $2\times10^6$/ml in RPMI/5% HS containing 1 μg/ml PHA (Wellcome) and 10 U/ml rIL-2. PHA blasts were maintained in culture medium containing 10 U/ml rIL-2 with feeding and splitting as needed. PHA blasts were used as APC on day 6 of culture. Generation of empty class I molecules and peptide loading were only performed by the acid strip method when using these APC.

Acid Stripping/Peptide Loading of PBMC and PHA Blasts.

PBMC were isolated using the Ficoll-Paque protocol. When using frozen cells, PBMC were washed twice before using. PHA blasts were prepared as previously described and washed twice before using. Once cells were prepared, they were washed once in cold sterile 0.9% NaCl (J. T. Baker)+1% BSA. In a 50 cc conical centrifuge tube, the cells were resuspended at $10^7$/ml in cold sterile citrate-phosphate buffer [0-13 M L-ascorbic acid (J. T. Baker), 0.06 M sodium phosphate monobasic (Sigma) pH 3, 1% BSA, 3 μg/ml $\beta_2$ microglobulin (Scripps Labs)] and incubated for 2 min on ice. Immediately, 5 volumes of cold sterile neutralizing buffer #1 [0.15 M sodium phosphate monobasic pH 7.5, 1% BSA, 3 μg/ml $\beta_2$ microglobulin, 10 μg/ml peptide] were added, and the cells were pelleted at 1500 rpm, 5 min at 4° C. Cells were resuspended in 1 volume cold sterile neutralizing buffer #2 [PBS CMF, 1% BSA, 30 μg/ml DNAse, 3 μg/ml $\beta_2$ microglobulin, 40 μg/ml peptide] and incubated for 4 hrs at 20° C. Cells were diluted with culture medium to approximately $5\times10^6$/ml and irradiated with 6000 rads. Cells were then centrifuged at 1500 rpm for 5 min at room temperature and resuspended in culture medium. The acid stripped/peptide loaded cells were used immediately in the CTL induction cultures (below).

Induction of Primary CTL Using Acid Stripped/Peptide Loaded Autologous PBMCs or PHA Blasts as Stimulators.

Acid stripping/peptide loading of PBMC and PHA blasts are described above. During the last 4 hr incubation of stimulator cells with peptide, the responder cell population was prepared: Responders were PBMC that were depleted of CD4+ cells (described above). Responder cells were resuspended in culture medium at $3\times10^6$/ml. 1 ml of the responder cell suspension was dispensed into each well of a 24-well tissue culture plate (Falcon, Becton Dickinson). The plates were placed in the incubator at 37° C., 5% $CO_2$ until the stimulator population was ready. Once irradiated, stimulator APC were resuspended in culture medium containing 20 ng/ml rIL-7 at $10^6$/m1 for the PBMC, or at $3\times10^5$/ml for the PHA blasts. 1 ml of stimulator cell suspension was added per well to the plates containing the responders. On day 7 after induction, a 100 μl culture medium containing 200 ng/ml rIL-7 was added to each well (20 ng/well rIL-7 final). On day 10 after induction, 100 μl of culture medium containing 200 U/ml rIL-2 was added to each well (20 U/well rIL-2 final).

Antigen Restimulation of CTL.

On day 12-14 after the induction, the primary CTL were restimulated with peptide using adherent APC. Autologous PBMC were thawed and washed as described above. Cells were irradiated at 6000 rads. Cells were pelleted and resuspended in culture medium at $4\times10^6$/ml. 1 ml of cell suspension was added to each well of a 24-well tissue culture plate, and incubated for 2 hrs at 37° C., 5% $CO_2$. Non-adherent cells were removed by washing each well three times with serum free RPMI. After this step, a 0.5 ml culture medium containing 3 μg/ml $\beta_2$ microglobulin and 20 μg/ml total peptide was added to each well. APC were incubated for 2 hrs at 37° C., under 5% $CO_2$ with the peptide and $B_2$ microglobulin. Wells were aspirated and 1 ml of responder cells at $1.5\times10^6$/ml in culture medium was added to each well. After 2 days, 1 ml of culture medium containing 20 U/ml rIL-2 was added to each well.

Cytotoxicity Chromium Release Assay.

Seven days following restimulation of primary induction, the cytotoxic activity of the cultures was assessed.

a. Effector Cell Preparation:

The responders, which at this stage are renamed "effectors", were centrifuged and resuspended at $10^7$/ml in RPMI/10% FCS. Three-fold serial dilutions of effectors were performed to yield effector to target ratios of 100:1, 33:1, 11:1, and 3:1. Effector cells were aliquoted at 100 μl/well on 96 well U-bottomed cluster plates (Costar), in duplicate.

b. Target Cell Preparation:

Approximately 16-20 hrs prior to the assay, target cells were resuspended at $3\times10^5$/ml in RPMI/10% FCS in the presence or absence of 3 μg/ml $\beta_2$ microglobulin and 10 μg/ml total peptide. After preincubation, target cells were centrifuged and pellets were resuspended in 200 μl (300 μCi) sodium ($^{51}Cr$) chromate (NEN). Cells were incubated at 37° C. for 1 hr with agitation. Labeled target cells were washed 3 times with RPMI/10% FCS.

c. Setting Up the Assays:

Target cell concentration was adjusted to $10^5$/ml in RPMI/10% FCS and 100 μl aliquots were added to each well containing responders. K562 cells (cold targets, to block NK, and LAK activity) were washed and resuspended in RPMI/10% FCS at $10^7$/ml. Aliquots of 20 μl were added per well, yielding a 20:1 of cold K562 target:labeled target. For the determination of the spontaneous $^{51}Cr$ release, 100 μl/well of RPMI/10% FCS were added to 100 μl/well of labeled target cells, and 20 μl/well of K562. For maximum $^{51}Cr$ release, 100 μl 1% Triton X-100 (Sigma) in PBS CMF, was added to the 100 μl/well labelled target cells, and 20 μl/well K562. Plates were centrifuged for 2 min at 1200 rpm to accelerate cell conjugate formation. Assays were incubated for 5 hr at 37° C., 5% $C0_2$. Assays were harvested by centrifuging plates for 5 min at 1200 rpm and collecting 100 μl/well of supernatant. Standard gamma counting techniques were used to determine percent specific lysis (Micromedic automatic gamma counter, 0.5 min per tube).

Cultured Cell Lines.

JY, a HLA A2.1 expressing human EBV-transformed B-cell line, was grown in RPMI/10% FCS. K562, a NK cell sensitive erythroblastoma line was grown in RPMI/10% FCS. K562 was used to reduce background killing by NK and LAK cells in the chromium release assays.

Peptides.

The peptides used in these studies were synthesized at Cytel and their sequences are described in TABLE 123. Peptides were routinely diluted in 100% DMSO at 20 mg/ml, aliquoted, and stored at −20° C.

FACS Analysis.

Approximately $10^6$ cells were used for each antibody that was to be tested. Cells were washed twice with PBS CNU+0.1% BSA. To each sample, 100 μl PBS CMF+0.1% BSA+primary antibody at 2 μg/ml (BB7.2, ATCC) or (9.12.1, Inserm-CNRS, Marseille, France) or (LB3.1, Children's Hospital Pittsburgh) were added. A negative control was always included. Cells were incubated on ice for 20 min and washed twice with PBS CMF+0.1% BSA. Cells were resuspended in 100 μl anti-mouse IgG FITC conjugate (Sigma), diluted 1:50 in PBS CMF+0.1% BSA, and incubated 20 min on ice. Cells were washed twice with PBS CMF+0.1% BSA, and resuspended in PBS for FACScan (Becton Dickinson) analysis. When it was necessary to postpone analysis to the subsequent days, the cells were fixed with PBS/1% paraformaldehyde (Fisher) and analyzed within one week.

Binding Assays Using Intact Cells and Radiolabelled Peptide.

JY cells were treated with citrate-phosphate buffer and neutralizing buffer #1 as described above. JY control cells were left untreated in tissue culture media. After treatment both cell populations were washed twice with serum free RPMI and loaded with $^{125}$I-radiolabelled 941.01 (HBc15-27) peptide (standard chloramine T iodination). To determine binding specificity, 2×10$^6$ cells were resuspended in 200 μl neutralizing buffer #2 (described above) containing $^{125}$I-941.01 (10$^5$ cpms)+/−100 μg unlabelled 941.01. Cells were incubated for 4 hrs at 20° C. and washed twice with serum free RPMI to remove free peptide. Cells were resuspended in 200 μl of serum free RPMI. In a microfuge tube the cell suspension was layered over an 800 μl FCS and pelleted by centrifugation for 5 sec. Supernatants were aspirated and the radioactivity remaining in the pellet was measured (Micromedic automatic gamma counter, 1 min per tube).

Example 41

Class I MHC Molecule Peptide Stripping/Loading by Mild Acid Treatment

Mild acid solutions of pH 3 such as glycine or citrate-phosphate buffers have been used by various groups to identify endogenous peptides and to identify tumor associated T cell epitopes. The treatment is unique in that only the MHC class I molecules are destabilized (and peptides released), while all other surface antigens remain intact including MHC class II molecules. Most importantly, treatment of cells with the mild acid solutions of this example do not affect the cell's viability or metabolic state. The mild acid treatment is rapid since the stripping of endogenous peptides occurs in two minutes at 4° C. and the APC is ready to perform its function after the appropriate peptides are loaded. In this example we utilized the technique to make peptide specific APCs for the generation of primary antigen-specific CTL. The resulting APC were efficient in inducing peptide-specific CD8+ CTL.

Measurements by FACS Analysis.

Figure 28:
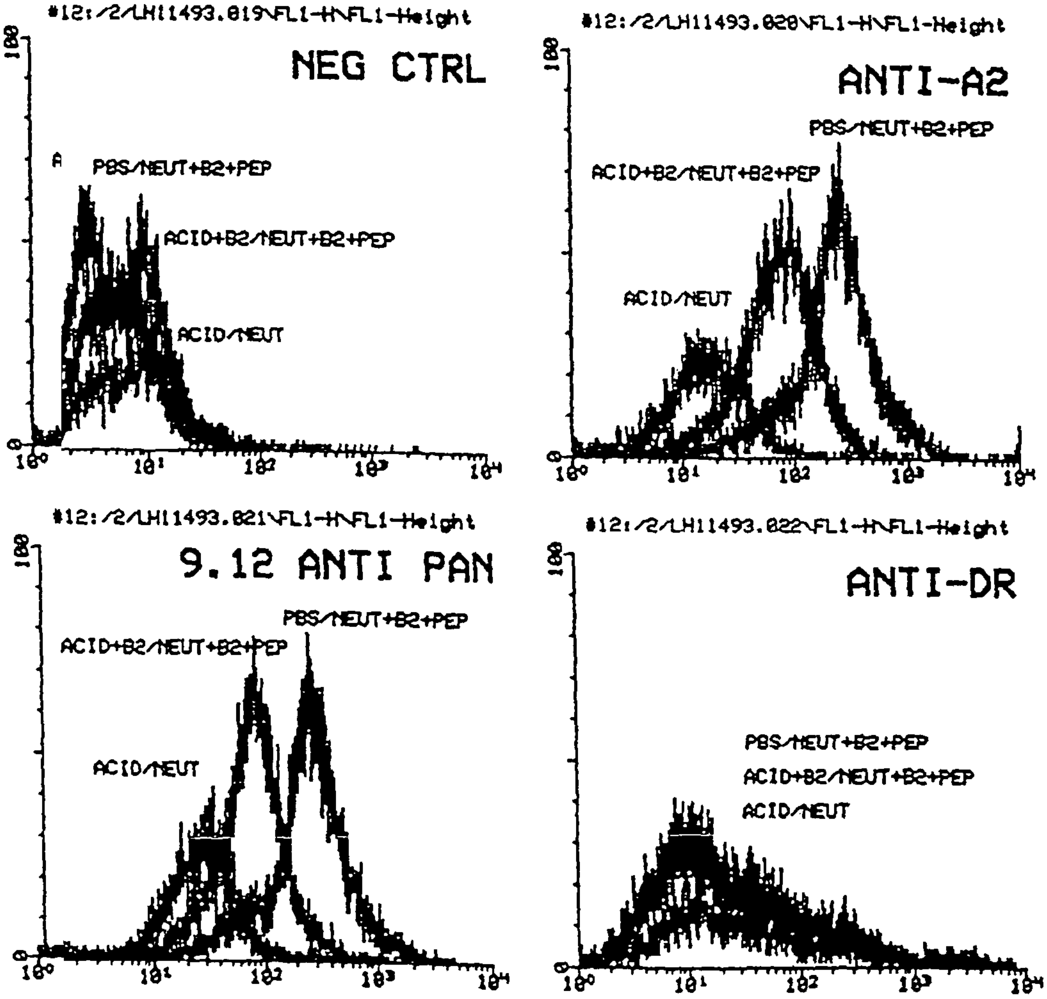
FIG. 28 shows the effect on MHC class 1 molecules of $\beta_2$ Microglobulin and a peptide of choice on-acid-stripped PHA blasts.
Figure 29:
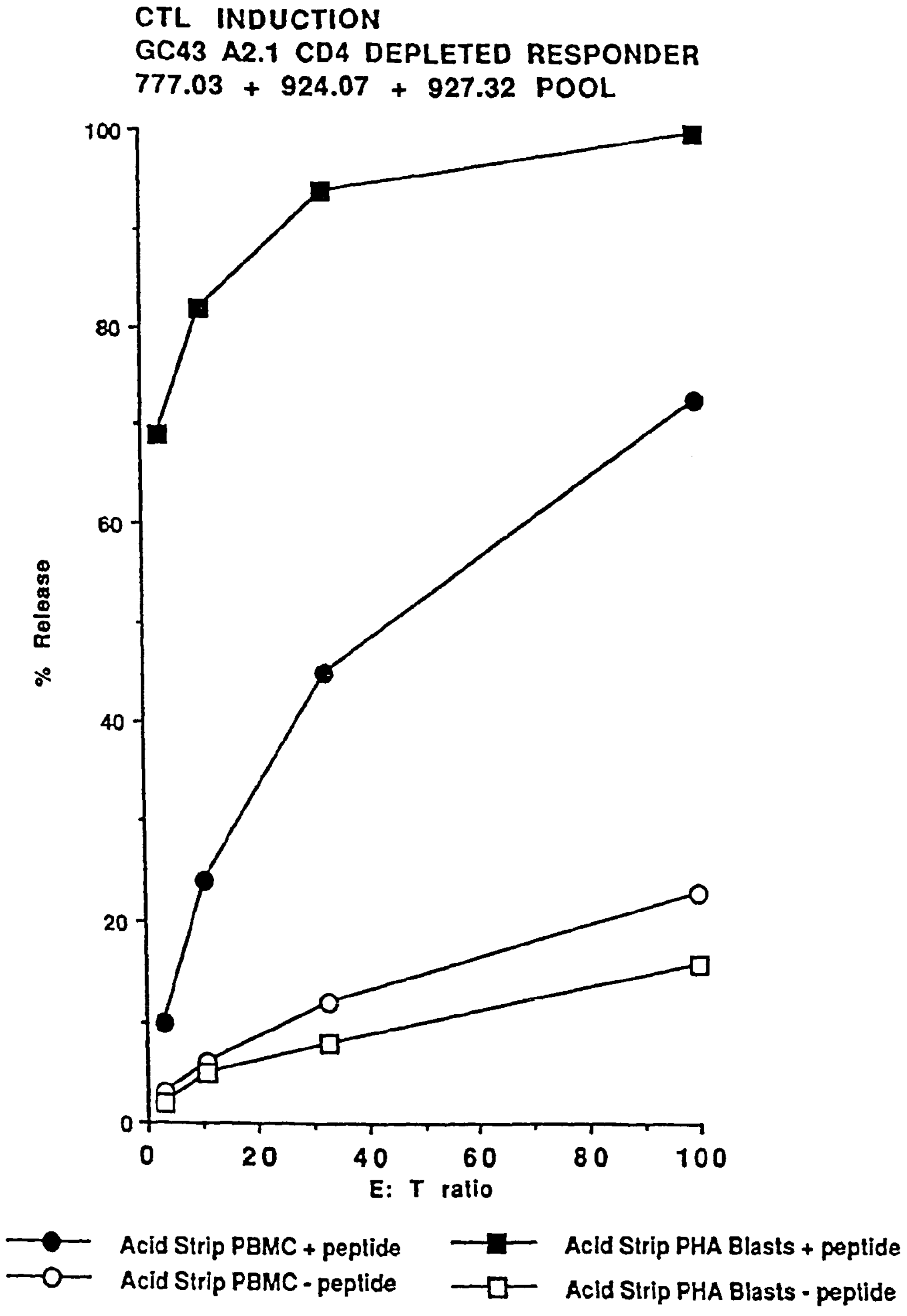
FIG. 29 shows CTL induction using GC43 A2.1 responders and autologous acid-stripped PBMCs or PHA blasts loaded with the 777.03-924.07-927.32 peptide pool.
Figure 31:
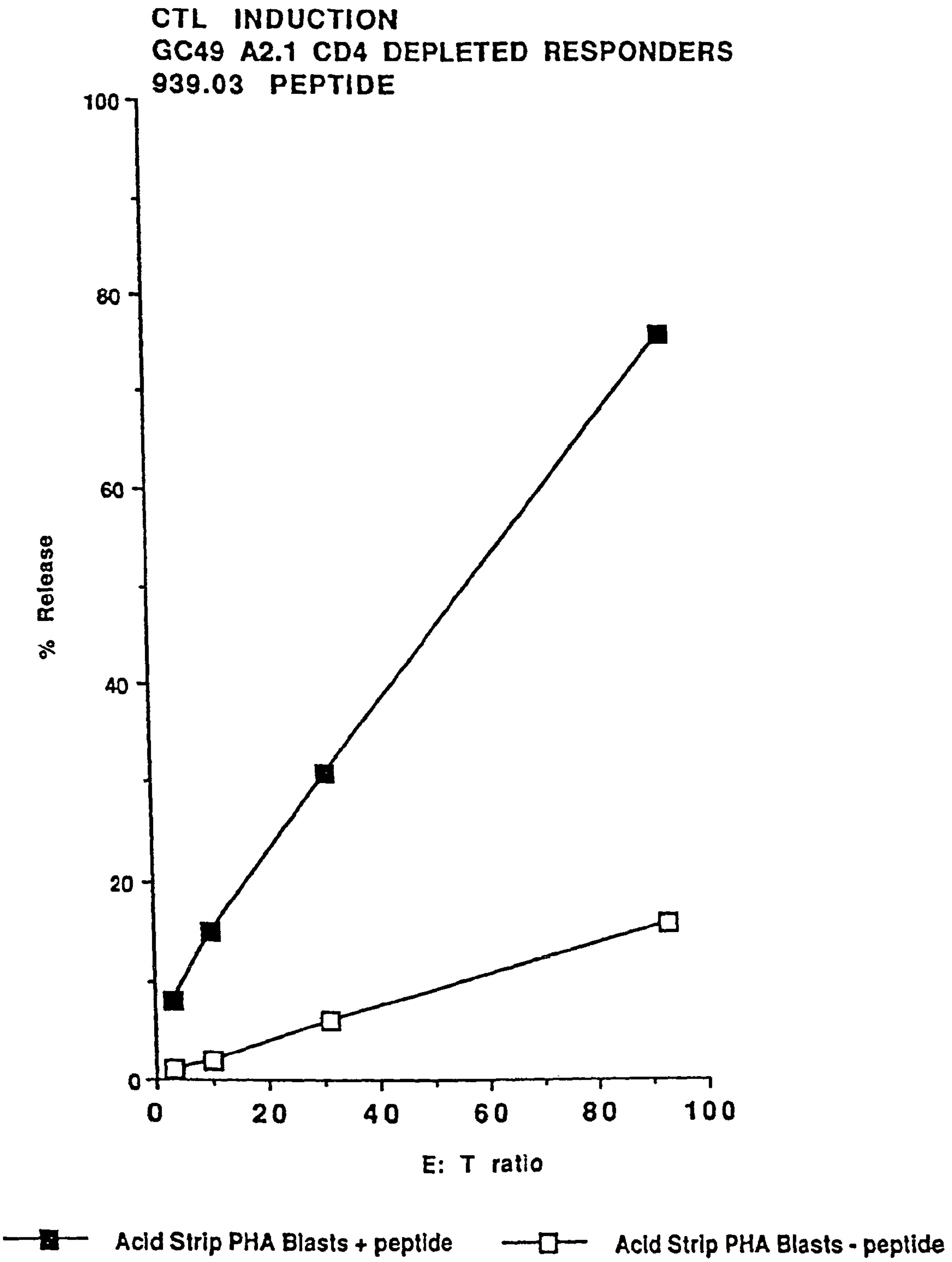
FIG. 31 shows CTL induction using GC49 A2.1 responders and Autologous Acid stripped PHA blasts as stimulators after loading with 939.03 peptide.
Figure 32:
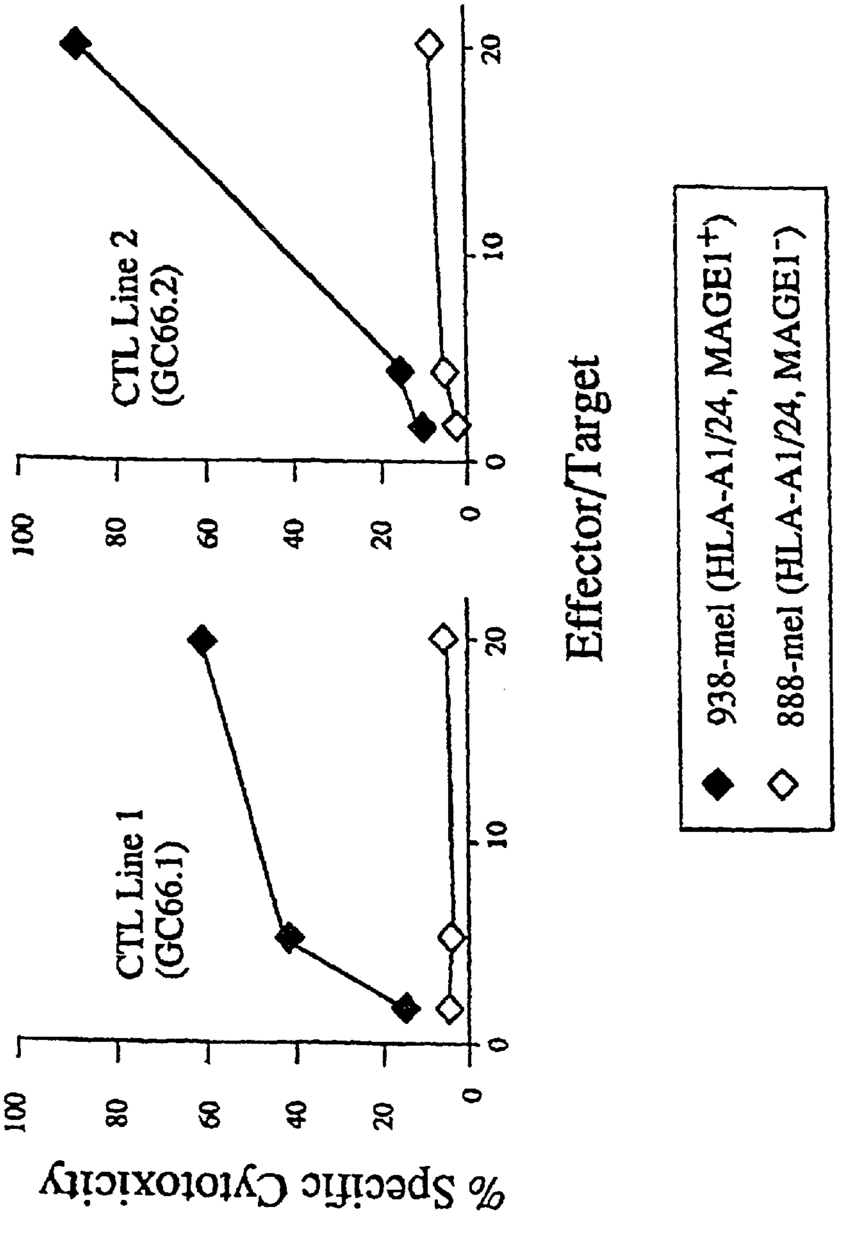
FIG. 32 shows CTL induction using GC66 A1 responders and autologous acid stripped PBMCs as stimulators after loading of peptide 938.01.

PHA-induced T-cell blasts were acid stripped/peptide loaded according to the methods described in Example 15. The resulting cells were stained for FACS analysis using anti-HLA-A2 (BB7.2) and anti-HLA alpha chain-specific (9.12.1) monoclonal antibodies. Controls for this experiment included the same cell population which was not treated at pH 3 (but treated with PBS buffer at pH 7.2), and with cells treated with citrate-phosphate buffer (to strip the MHC) but neutralized in the absence of $\beta_2$ microglobulin and peptide. The results presented in FIG. 28, indicate that treatment of these cells with the citrate-phosphate (pH 3) buffer significantly reduced (10-fold) the reactivity of the cells toward both anti-HLA class I antibodies alone (anti-HLA-A2 and the alpha chain specific), but not towards a monoclonal antibody specific for class II MHC molecules (anti-HLA-DR). Most importantly, neutralization of the acid-stripped cells in the presence of $B_2$ microglobulin and peptide resulted in preservation of a significant amount of class I MHC antibody-reactive sites, with only a 2.5-fold decrease in fluorescence intensity. Importantly, the acid-treated cells remained viable, as measured by trypan blue exclusion and forward/lateral FACS scatter analysis. Similar results were obtained using EBV-transformed B cell lines, fresh (or frozen) PBMC and other peptides (which bind to either HLA-A2.1 or HLA-A1) (data not shown).

Binding of Radiolabeled Peptides to Empty MHC Molecules.

To determine the efficiency of peptide loading using the cold temperature incubation or acid stripping/peptide loading protocol, JY cells (an HLA-A2.1 EBV-transformed B cell line) were preincubated at 26° C. overnight or acid-stripped to remove the endogenous MHC-associated peptides and the loading of exogenous peptide was determined using a $^{125}$I-radiolabelled HLA-A2.1 binding peptide. The specificity of this reaction was determined by measuring the inhibition of labelled peptide binding using a cold peptide of the same sequence. Results presented in TABLES 123-124 demonstrate that acid-treatment of the cells increased significantly (approximately 10-fold) the amount of labeled peptide binding to the JY cells. Furthermore, the binding of labelled peptide was completely blocked by the addition of the cold peptide, demonstrating specific binding (data not shown).

In Vitro Induction of Primary Antigen-Specific CTL Using Acid Stripped/Peptide Loaded APCS.

Additional critical parameters for the induction of primary CTL using both the cold temperature incubation and acid strip protocol are: 1) enrichment of CD8+ T-cells in the responder cell population (or depletion of CD4+ T-cells), 2) addition of rIL-7 to the CTL induction cultures from day 0, and 3) restimulation of the cultures with antigen on day 12-14 using autologous adherent cells pulsed with peptide.

Example 42

Screening Peptides to Identify CTL Epitopes

In order to identify CTL epitopes, CTL was stimulated by SAC-I activated PBMCs as APC. Cold temperature expression of the MHC in which class 1 β2 microglobulin complex is unstable was utilized in addition to acid stripping to generate PBMC APC.

Complete Culture Medium.

The tissue culture medium used in this study consisted of RPMI 1640 with Hepes and L-glutamine (Gibco) supplemented with 2 mM L-glutamine (Irvine Scientific), 0.5 mM sodium pyruvate (Gibco), 100 U/100 ug/ml penicillin/streptomycin (Irvine), and 5% heat-inactivated Human Serum Type AB (RPMI/5% HS; Gemini Bioproducts). Culture media used in the growth of EBV-transformed lines contained 10% heat-inactivated fetal calf serum (RPMI/10% FCS, Irvine) instead of human serum.

Cytokines.

Recombinant human Interleukin-2 (rIL-2) and Interleukin-4 (rIL-4) were obtained from Sandoz and used at a final concentration of 10 U/ml and 10 ng/ml, respectively. Human interferon-γ (IFN-γ) and recombinant human Interleukin-7 (rIL-7) were obtained from Genzyme and used at 20 U/ml and 10 ng/ml, respectively.

Peptides.

Peptides were synthesized at Cytel and are described in TABLES 123-124. Peptides were routinely diluted in 100% DMSO at 20 mg/ml, aliquoted, and stored at −70° C. until use.

Cell Lines.

JY, Steinlin, EHM, BVR, and KT3 are homozygous human EBV-transformed B cell lines expressing HLA $A_{2.1}$, $A_1$, $A_3$, $A_{11}$, and $A_{24}$, respectively. They are grown in RPMI/10% FCS. K562, an NK cell sensitive, erythoblastoma line grown in RPMI/10% FCS, was used for reduction of background killing in CTL assays. Melanoma cell lines either expressing the MAGE antigen, mel 397 and mel 938, or not expressing the MAGE antigen; mel 888, were also grown in RPMI/10% FCS.

Isolation of Peripheral Blood Mononuclear Cells (PBMCs).

Whole blood was collected into heparin containing syringes and spun in 50 cc tubes at 1600 RPM (Beckman GS-6KR) for 15 minutes. The plasma layer was then removed and 10 ml of buffy coat was collected with a pipette using a circular motion. The buffy coat was mixed well and diluted with an equal volume of RPMI. The buffy coat (30 ml) was then layered on 20 ml of Ficoll-Paque (Pharmacia) and centrifuged at 1850 RPM (400×g) for 20 minutes, 25° C., with the brake off. The interface between the ficoll and the plasma containing the PBMCs was recovered with a transfer pipet (two interfaces per 50 ml tube) and washed three times with 50 ml of RPMI (1700, 1500, and 1300 RPM for 10 minutes). Cells were resuspended in 10-20 ml of culture medium, counted, and adjusted to the appropriate concentration.

Freezing PBMCs.

30 million cells/tube (90% FCS/10% DMSO; Sigma) were inserted into a Nalgene Cryo 1° C. Freezing Container containing isopropanol (Fisher) and placed at −70° C. from 4 hrs (minimum) to overnight (maximum). The isopropanol was changed every five times. Tubes were transferred to liquid nitrogen for long term storage. To thaw, PBMCs were continuously shaken in a 37° C. water bath until the last crystal was almost thawed (tubes were not allowed to sit in the water bath or at room temperature for any period of time). Cells were diluted into serum-free RPMI containing 30 μg/ml DNase to prevent clumping by dead cell DNA and washed twice.

Induction of Primary CTL Using SAC-I Activated PBMCs as APCs a. Preparation of APCs:

PBMCs were purified using the standard Ficoll-Paque protocol and resuspended at $1\times10^6$/ml in RPMI/5% FCS containing 0.005% Pansorbin cells (SAC-I cells expressing Protein A; Calbiochem), 20 μg/ml Immunobeads (Rabbit anti-Human IgM; Biorad), and 20 ng/ml of human rIL-4. Two ml of cells per well were plated in a 24-well plate (Falcon, Becton Dickinson) and cultured at 37° C. After 3 days, the medium was removed and the cells were washed three times followed by addition of RPMI/10% HS. The cells were used after culturing for an additional 2 days in RPMI/10% HS.

b. Expression of Empty Class I Molecules on the Surface of APCs and Peptide loading of APCs.

1. Cold temperature incubation:

a. Expression of empty MHC in APCs: The APCs were adjusted to a concentration of $2\times10^6$/ml in complete culture medium containing 10 ng/ml rIL-4, 20 U/ml human IFN-γ, and 3 μg/ml β2 microglobulin ($\beta_2$m; Scripps Lab). The cells were then incubated overnight at 26° C. in the presence of 5% $CO_2$. It should be noted that these cells only express a fraction of Class I molecules in the empty state (~10%).

b. Peptide loading of APC stimulator cells: Empty Class I expressing APCs were washed 1-2 times with serum free RPMI (+L-glutamine and Hepes) and resuspended at $1\times10^7$ in serum-free RPMI containing 50 μg/ml total of the peptide pool (i.e., 16.7 μg/ml of each peptide in a pool of three; 25 μg/ml of each peptide in a pool of two; 50 μg/ml of individual peptide), 30 μg/ml DNAse, and 3 μg/ml $\beta_2$m. Following a 4 hour incubation at 20° C., the cells were irradiated at 6100 rads ($5\times10^6$/ml; 25 million cells/tube), washed and adjusted to the appropriate concentration for addition to the induction culture (see below).

2. Acid stripping: This was used as an alternative method for generating empty MHC on the surface of the APCs. The SAC-I activated PBMCs were washed once in cold 0.9% sodium chloride (J. T. Baker) containing 1% BSA. The cells were resuspended at $10^7$/ml in cold citrate-phosphate buffer (0.13M L-ascorbic acid [J. T. Baker], 0.06M sodium phosphate monobasic [Sigma], pH3) containing 1% BSA and 3 μg/ml $\beta_2$m and incubated on ice. After 2 minutes, 5 volumes of cold 0.15M sodium phosphate monobasic buffer, pH7.5, containing 1% BSA, 3 μg/ml $\beta_2$m, and 10 μg/ml peptide [neutralizing buffer #1] was added and the cells centrifuged at 1500 RPM for 5 minutes at 4° C. The cells were resuspended in 1 ml of cold PBS containing 1% BSA, 30 μg/ml DNase, 3 μg/ml β2 microglobulin, and 50 μg/m1 peptide [neutralizing buffer #2] and incubated for 4 hours at 20° C. As above, subsequent to the four hour incubation at 20° C., the cells were irradiated at 6100 rads ($5\times10^6$/ml; 25 million cells/tube), washed, then adjusted to the appropriate concentration for addition to the induction culture (see below).

c. Preparation of the CD4+ Depleted PBMC Responder Cell Population (Depletion of Lymphocyte Sub-Populations Using AIS Flasks).

AIS MicroCellector T-150 flasks (specific for the depletion of CD4+ T cells; Menlo Park, Calif.) were primed by adding 25 ml of PBS/1 mM EDTA, swirling for 30 seconds so that all surfaces were moistened, and then incubating with the binding surface down at room temperature for 1 hour. Following this incubation, flasks were shaken vigorously for 30 seconds, washed 1 time with PBS/EDTA, 2 additional times with PBS and then incubated with 25 ml of culture medium for 15 minutes. PBMCs were thawed in serum-free RPMI (+L-glutamine+Hepes) containing 30 μg/ml DNAse, washed once, and incubated for 15 minutes in culture medium. Following aspiration of culture medium from the flasks, up to 180 million PBMCs were added in 25 ml of culture medium containing 30 μg/ml DNAse. After 1 hour at room temperature, the flasks were rocked gently for 10 seconds to resuspend the nonadherent cells. The nonadherent cell suspension containing the CD8+ T cells was collected and the flasks were washed 2 times with PBS. The CD4+ T cell depleted PBMCs were centrifuged and counted for addition to the induction culture. The CD4+ and CD8+ phenotype of the CD4+ depleted cell population was determined by FACS analysis (see below). In general, this technique resulted in a two-fold enrichment for CD8+ T cells with an average of approximately 40-50% CD8+ T cells and 15-20% remaining CD4+ T cells following depletion of CD4+ T cells. Depletion of CD4+ T cells can also be accomplished by antibody and complement or antibody coated magnetic beads (Dynabeads). Depletion of CD4+ T cells served the purpose of enriching CTLp and removing cells which would complete for cell nutrients and may interfere with CTLp expansion.

d. Induction of Primary CTL.

During the 4 hour peptide loading of the stimulator APCs, CD4+ depleted PBMC to be used as the responder population were prepared utilizing AIS flasks for selection of CD8+ T cells through the depletion of CD4+ T cells (above). The responder cells were plated at $3\times10^6$/ml in a 1 ml volume (24 well plate) and placed at 37° C. until the peptide loaded stimulator APCs were prepared. The irradiated, peptide loaded APCs were washed 1 time in serum-free RPMI (+L-glutamine and Hepes), adjusted to $1\times10^6$/m1 in complete medium, and plated into a 24 well plate at 1 ml/plate: For PBMC, $1\times10^6$ stimulator cells (1 ml volume) were plated into the wells containing the responder cells; For SAC-I activated PBMC and PHA blasts, 1 ml of $3\times10^5$/ml stimulator cells were plated in each well. A final concentration of 10 μg/ml of additional peptide was added in addition to 10 ng/ml final concentration of rIL-7 (2 ml total volume). On day 7 an additional 10 μg/ml rIL-7 was added to the culture and 10 U/ml rIL-2 was added every 3 days thereafter. On day 12, the cultures were restimulated with peptide pulsed adherent cells and tested for cytolytic activity 7 days later (below).

Protocol for Restimulation of Primary CTL Using Adherent APC.

PBMCs were thawed into serum-free RPMI (+L-glutamine and Hepes) containing 30 μg/ml DNAse, washed 2 times, and adjusted to $5\times10^6$/ml in culture medium containing DNAse. PBMCs (25 million cells/tube in 5 ml) were irradiated at 6100R. After 1 wash, the PBMCs were resuspended in culture medium and adjusted to $4\times10^6$/ml. 1 ml of irradiated PBMCs was added per well of a 24-well plate. The PBMC were incubated for 2 hours at 37° C., washed 3 times to remove non-adherent cells, and cultured in medium containing 20 μg/ml total peptide and 3 μg/ml $\beta_2$ microglobulin added in a 0.5 ml volume and again incubated for 2 hours at 37° C. The peptide was aspirated and $1.5\times10^6$ responder cells resuspended in culture medium were added in a 1 ml volume. After 2 days, 1 ml of culture medium containing 20 U/ml rIL-2 was added.

FACS Analysis.

One million cells/tube were centrifuged, resuspended in 100 μl/tube PBS/0.1% BSA/0.02% sodium azide (Sigma) plus 10 μl/tube directly conjugated antibody (Becton Dickinson), and incubated on ice 15-20 minutes. Cells were then washed 2 times with PBS/0.1% BSA/0.02% sodium azide and resuspended in PBS to analyze on FACScan (Beckton Dickinson). When it was not possible to analyze samples within 1-2 days, cells were fixed with PBS containing 1% paraformaldehyde (Fisher) and analyzed within one week.

Cytotoxicity Assay a. Target Cell Preparation.

Approximately 16-20 hours prior to the CTL assay, target cells (Class I matched EBV-transformed lines) were washed once and resuspended in a 10 ml volume at $3\times10^5$/ml in RPMI/5% FCS in the presence or absence of 10 μg/ml total peptide.

b. Labeling of Target Cells:

Target cells were centrifuged and resuspended in 200 μl/tube sodium $^{51}Cr$ chromate (NEN), then incubated at 37° C. for 1 hour on a shaker. Targets were washed 3 times (10 ml/wash) with RPMI/10% FCS and resuspended in 10 ml (to determine the efficiency of labelling, 50 μl/target was counted on the Micromedic automatic gamma counter).

c. CTL Assay.

Target cells were adjusted to $2\times10^5$/ml and 50 μl of the cell culture was added to each well of a U-bottomed 96-well plate (Costar Corp.) for a final concentration of $1\times10^4$/well. K562 cells were washed once, resuspended at $4\times10^6$/ml, and 50 μl/well was added for a final concentration of $2\times10^5$/well (ratio of cold K562 to target was 20:1). Responder cells were washed once, resuspended at $9\times10^6$/ml, and three fold serial dilutions were performed for effector to target ratios of 90:1, 30:1, 10:1, and 3:1. Responder cells were added in a volume of 100 μl in duplicate wells. For spontaneous release, 50 μl/well of labelled target cells, 50 μl/well K562, and 100 μl/well of medium was added. For maximum release, 50 μl/well target, 50 μl/well K562, and 100 μl/well of 0.1% Triton-X100 (Sigma) was added. Plates were centrifuged for 5 minutes at 1200 RPM. Following a 5 hour incubation at 37° C., plates were centrifuged again for 5 minutes at 1200 RPM, and 100 μl/well of supernatant was collected. Standard gamma counting techniques (Micromedic automatic gamma counter; 0.5 minutes/tube) were used to determine the percent specific lysis according to the formula: % specific lysis=cpm experimental−cpm spontaneous release/cpm maximum release−cpm spontaneous release×100. A cytotoxicity assay (CTL assay) was considered positive if the lysis by CTL of targets sentized with a specific peptide at the two highest effector to target (E:T) ratios was 15% greater than lysis of control targets (i.e., target cells without peptide). A cytotoxicity assay (CTL assay) was considered borderline if the lysis by CTL of targets sensitized with a specific peptide at the two highest effector to target (E:T ratios was 6% greater than lysis of control targets (i.e., target cells without peptide).

d. Results.

Figure 33:
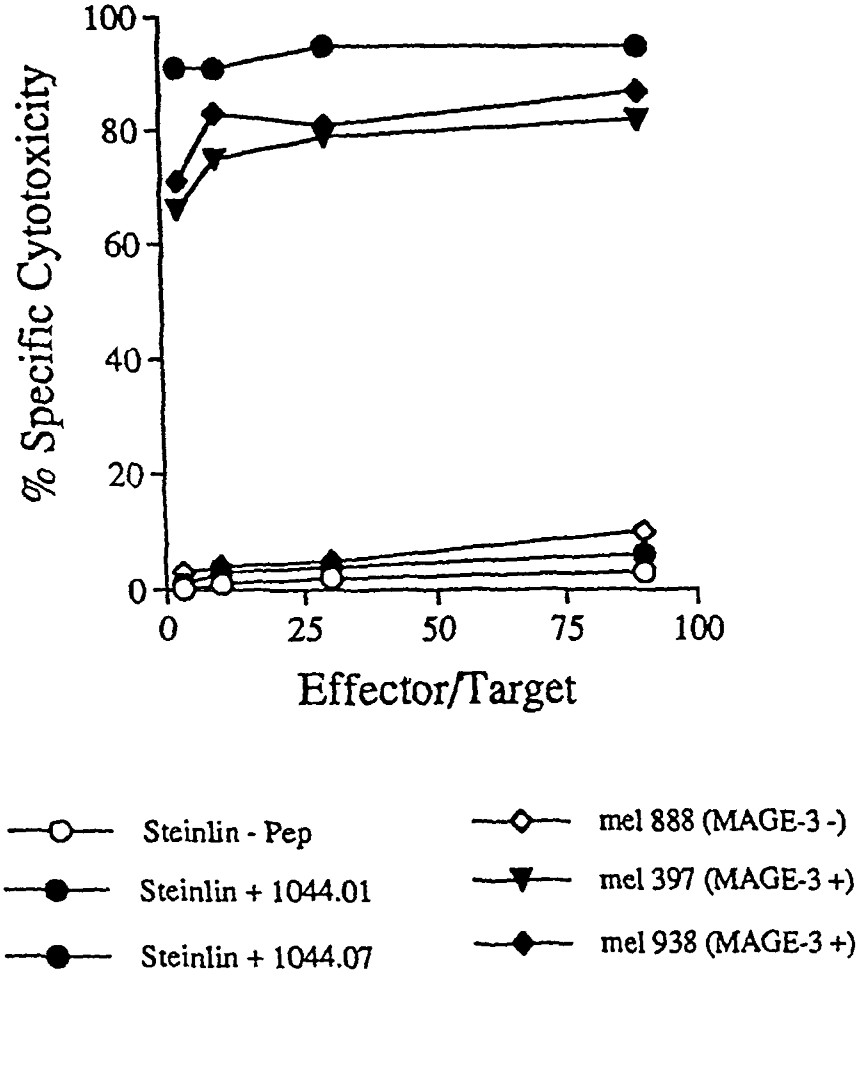
FIG. 33 illustrates the lysis of peptide sensitized targets and endogenous targets following stimulation with SAC-I activated PBMCs loaded with a MAGE 3 peptide.
Figure 34:
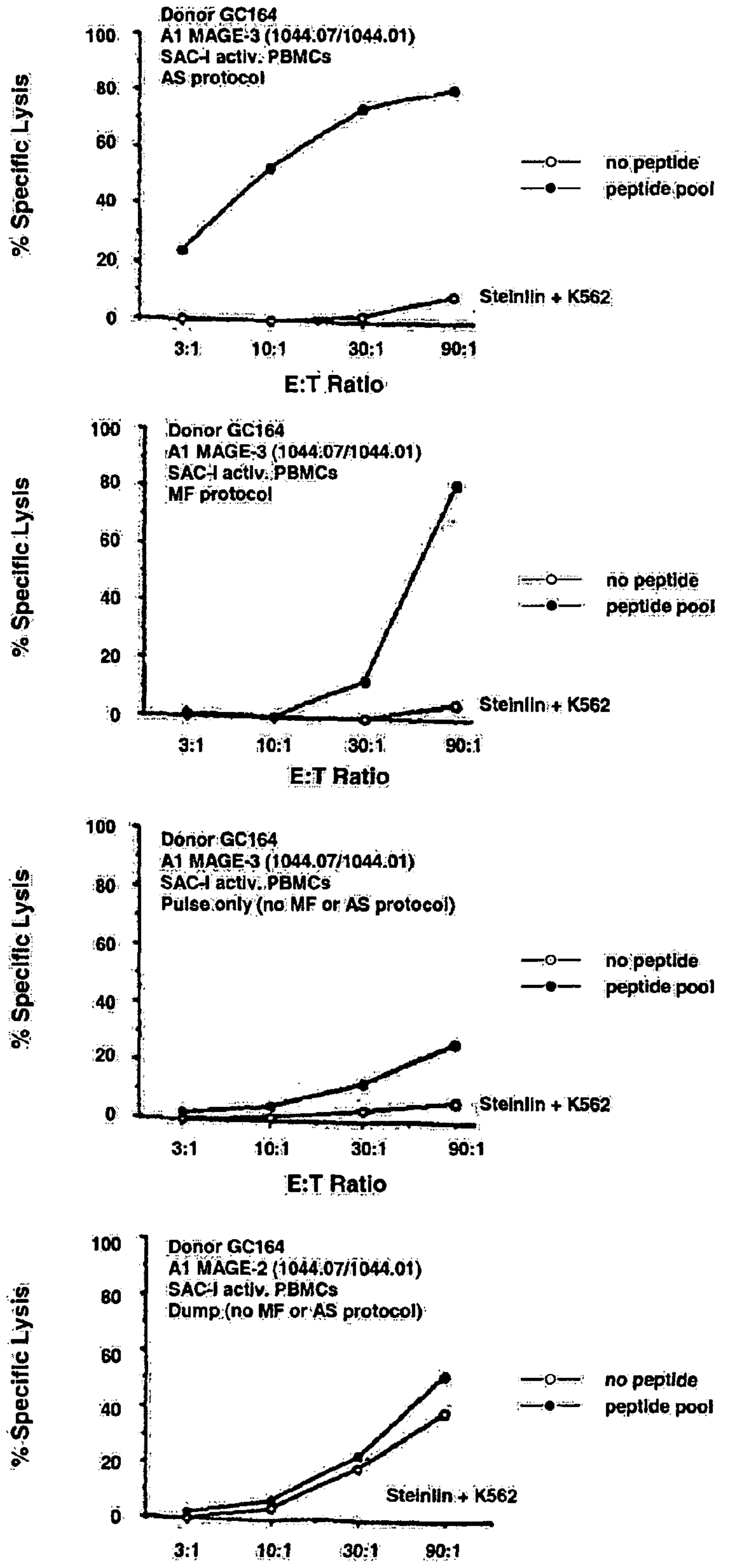
FIG. 34 shows a comparison of the acid strip-loading with the cold temperature incubation.
Figure 36:
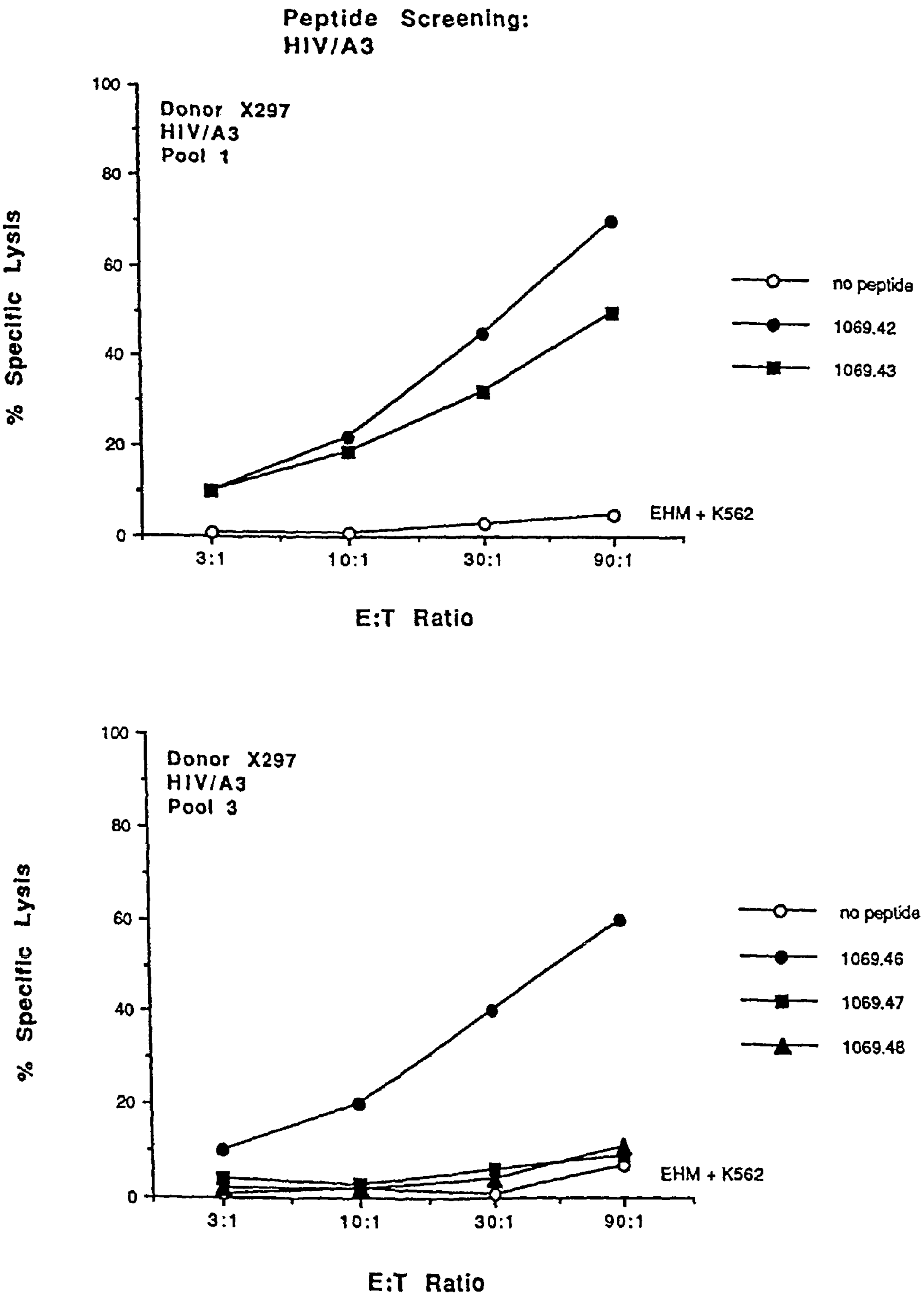
FIG. 36 shows a CTL response to an immunogenic peptide for HIV/A3.
Figure 37:
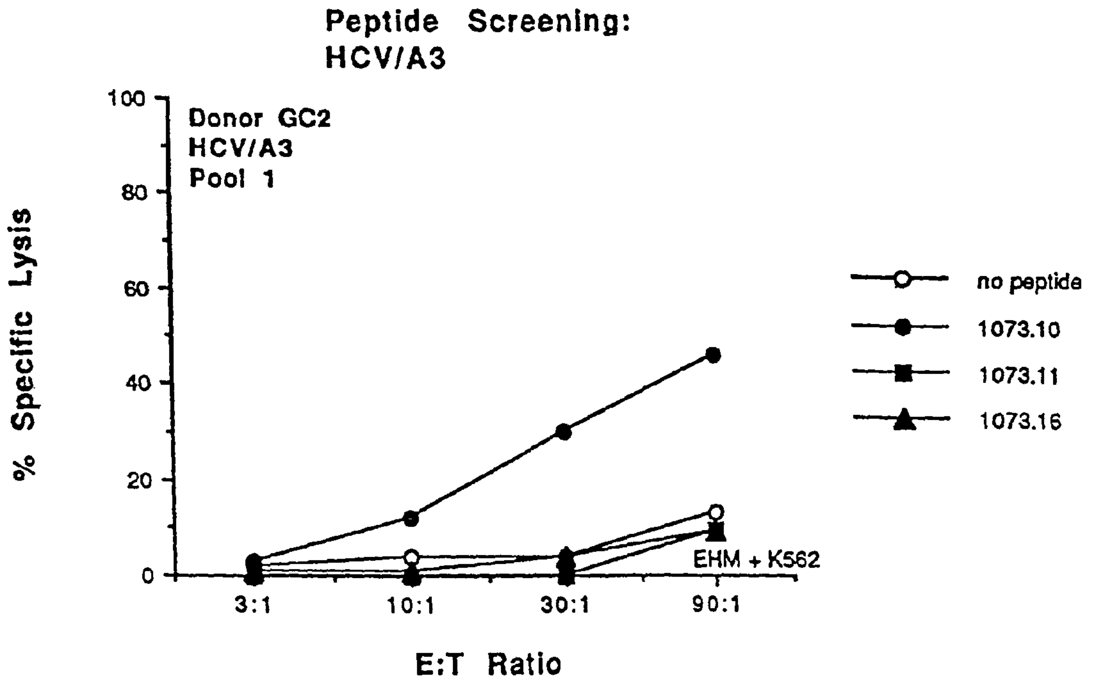
FIG. 37 shows a CTL response to an immunogenic peptide for HCV/A3.
Figure 38:
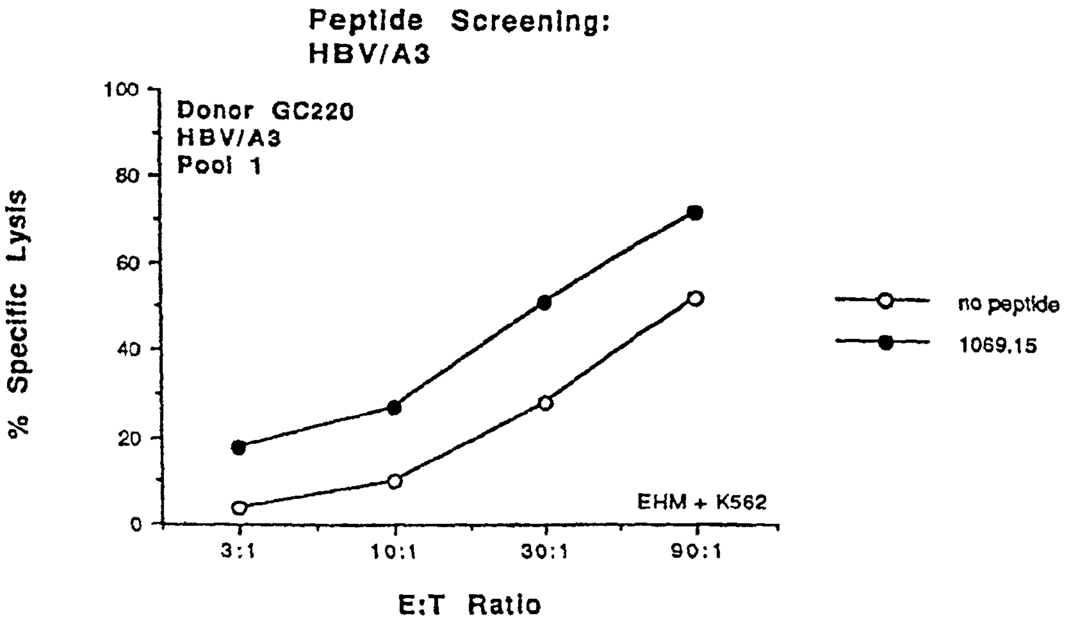
FIG. 38 shows a CTL response to an immunogenic peptide for HBV/A3.

Of the peptides that bind to the indicated alleles, 9 of the 49 MAGE peptides, 10 of the 45 HIV peptides, 3 of the 25 HCV peptides, and 2 of the 20 HBV peptides tested to date induced primary CTL in vitro. Representative graphs illustrating CTL responses to various immunogenic peptides are shown for MAGE (FIG. 35), HIV (FIG. 36), HCV (FIG. 37), and HBV (FIG. 38). The CTL induction data are summarized in TABLE 123-124 which lists the immunogenic peptides which bind to the appropriate MHC and induce primary CTL in vitro. Indicated is the peptide's sequence, corresponding antigen and HLA allele to which it binds. Results shown in FIG. 33 illustrate lysis of peptide sensitized targets and endogenous targets following stimulation with SAC-I activated PBMCs loaded with a MAGE 3 peptide, 1044.07 by the cold temperature and incubation technique. FIG. 34 shows a comparison of the acid strip loading technique (Panel a) with the cold temperature incubation technique (panel b).

Example 43

Analog Peptides with Substitutions at Primary and Secondary Anchor Positions and Effects on A24 Binding A model poly alanine 9-mer peptide containing the A24-allele specific motif of Y in position 2 and F in position 9 was used to evaluate the possibility that there are other residues that can serve as primary anchors for peptide binding to HLA-A24 molecules. It was found that in position 2 not only Y, but also F, M, and possibly W, were accepted. The acceptability of W at position 2 was confirmed by data in this Example. At the C-termini of 9 or amino acid ligands, F and W were most preferred, but also L and I were accepted. From these results, it was concluded that A24 binding of any peptide which carries a tolerated residue in position 2 or the C-terminal position (for example, M in position 2) should be increased by creating an analog peptide by replacing the acceptable residue with a more canonical anchor.

The results of further experiments describing the prominent role of amino acids which were not primary anchors as determinants of A24 binding capacity have been determined (see, e.g., Kondo, et al, *J. Immunol.* 155:4307 (1995)). Thus, an overall A24 binding data was compiled, and for each position the relative average binding affinity of peptides carrying particular residues was calculated. Based on this calculation, preferred and deleterious residues were identified; these are shown in FIG. 44.

Secondary Residues of 9-mer Peptides and A24 Binding.

In the case of 9-mer peptides it was found, for example, that peptides carrying G or negatively charged residues (D, E) at position 1 tended to bind poorly, with an average affinity 10-fold lower than the average affinity of a sample panel of 141 different 9-mer peptides analyzed. By contrast, peptides carrying aromatic residues (F, Y, W) at position 1 bound very well with an average affinity 11.8-fold higher than the overall average. Peptides with positively charged residues (R, K, M in position one also tended to bind well, with average affinity 4.6-fold higher than the overall average.

Negative effects on A24 binding capacity were also detected when certain residues were present at several other positions: D or E at positions 3 and 6, G at positions 4 and 7, positive charges (K, R, H) at position 6, A at position 8, P at position 5, and amides (Q and N) at positions 5 and 8. Conversely, it was found that aromatic (Y, F, W) residues favored A24 binding when found at position 7 or 8, and small hydrogen bonding residues such as (S, T, C) had a positive effect when present at position 4.

Thus, it was found that every single position along the 9-mer sequence can influence A24 binding. It was also interesting that hydrophobic residues (F, W, Y, L, I, V, and M) were never associated with poor binding.

10-mer Peptides and A24 Binding.

A similar analysis was also performed with 10-mer peptides. Analogous to the preceding section concerning 9-mers, several secondary effects were also discerned when analogs were prepared of 10 mer peptides.

As was the case for 9-mer peptides, negative residues (D, E) in position 3 and 6 were associated with poor binding. In general, however, the map of secondary effects for 10-mers was quite distinct from that of 9-mers. For example, P, in the case of 9-mer peptides, was not associated with significantly increased binding at any position and was even associated with decreased binding at position 5. However, for 10-mers, P was associated with increased binding capacity when found at positions 4, 5, or 7 of 10-mer peptide ligands.

In 10-mer peptides, position 5 appears to be most important in terms of secondary effects, with (besides the already mentioned P) Y, F, and W associated with good A24 binding and R, H, and K associated with poor binding capacity. The presence of A at positions 7 and 9, and amide (Q, N) residues at positions 4 and 8 were also associated with poor binding capacity. Thus, in accordance with the principles for preparing peptide analogs disclosed herein, this information provides guidance for the preparation of 9-mer and 10-mer analogs of peptides that bind HLA A24 molecules.

Example 44

Immunogenicity of HPV Peptides in A2.1 Transgenic Mice

A group of 14 HPV peptides, including 9 potential epitopes plus 3 low binding and one non-binding peptides as controls was screened for immunogenicity in HLA-A2.1 transgenic mice using the methods described in Example 10. To test the immunogenic potential of the peptides, HLA A2.1 transgenic mice were injected with 50 ig/mouse of each HPV peptide together with 140 μg/mouse of helper peptide (HBV core 128-140 (TPPAYRPPNAPIL (SEQ ID NO:14633)). The peptides were injected in the base of the tail in a 1:1 emulsion IFA. Three mice per group were used. As a positive control, the HBV polymerase 561-570 peptide, which induced a strong CTL response in previous experiments, was utilized.

Based on these results (TABLE 179), four unrelated peptides were considered to be the most immunogenic: TLGIVCPI (SEQ ID NO:12084), LLMGTLGIV (SEQ ID NO:12330), YMLDLQPETT (SEQ ID NO:12305), and TIHDIILECV (SEQ ID NO:12310). TLGIVCPI (SEQ ID NO:12084) and YMLDLQPETT (SEQ ID NO:12305) were found to be good HLA-A2.1 binders, while LLMGTLGIV and TIHDIILECV were found to be intermediate binders in previous binding assays.

Mixtures of Selected HPV Epitopes

A combination of CTL peptides and a helper peptide were tested for the ability to provide an increased immune response. The four single peptides were injected separately in order to compare their immunogenicity to injections containing only the two good binders or only the two intermediate binders. In addition all four peptide were injected together. To further evaluate the immunogenicity of a combination of peptides with different binding affinity decreases, another control was introduced in this experiment. A mixture of the two good binders was injected in a different site than the mixture of the two intermediate binders into the base of the tail of the same mouse. All groups of CTL epitopes were injected together with the HBVc helper epitope, with the exception of two groups in which all four HPV coinjected with two different doses of a PADRE helper peptide (aKXVAAWTLKAAa, where a is d-alanine and X is cyclohexylalanine) either 1 μg or 0.05 μg per mouse.

All four peptides induced a strong CTL response when injected alone and tested using target cells labeled with the appropriate peptide (TABLE 180). TLGIVCPI (SEQ ID NO:12330) proved to be the strongest epitope, an observation confirming the results described above. When mixtures of all four peptides were injected and the responses were stimulated in vitro and tested with target cells pulsed with each single peptide, all combinations showed a strong CTL response. No significant difference was observed when the two helper epitopes were compared. This might in part be due to the fact that the highest dose of PADRE used in this experiment was 140-fold lower than the one for the HBV helper peptide.

Injection of mixtures of the two good binders together or the two intermediate binders resulted in a very low CTL response in both cases even though the single peptides were highly effective. These results, however, are due to a very low number of cell recovery after splenocyte culture of 6 days and are therefore regarded as preliminary.

TABLE 176 provides the results of searches of the following antigens cERB2, EBNA1, HBA, HCV, HIV, HPV, MAGE, p53, and PSA. Only peptides with binding affinity of at least 1% as compared to the standard peptide is shown in the far right column. The column labeled "Pos." indicates that position in the antigenic protein at which the sequence occurs.

TABLE 177 also provides the results of these searches. Binding affinities are expressed as percentage of binding compared to standard peptide in the assays as described in Example 5.

Example 45

Effects of Secondary Anchor Residues on A1 Binding

An analysis similar to that described above for A24 was also described for peptides that bear a motif correlated to binding to the HLA-A*0101 allele molecules. Briefly, previous studies have defined two different peptide binding motifs specific for HLA-A*0101: A motif defining anchors at position 2 and the C-terminus, and a motif with anchors at position 3 and the C-terminus. Such motifs for binding to the same HLA allele are referred to as "submotifs."

Thus, 9-mer and 10-mer maps of secondary interactions were derived for both A*0101 submotifs. To derive such maps of secondary interactions, the relevant A*0101 binding data of peptide sets corresponding to each of the two motifs were compiled. For each position, the relative average binding affinity of peptides carrying each particular residue was calculated. To compensate for the low occurrence of certain residues, and to obtain a more significant sampling, amino acids carrying chemically similar side chains were combined, as suggested by Ruppert et al., supra.

Figure 42:
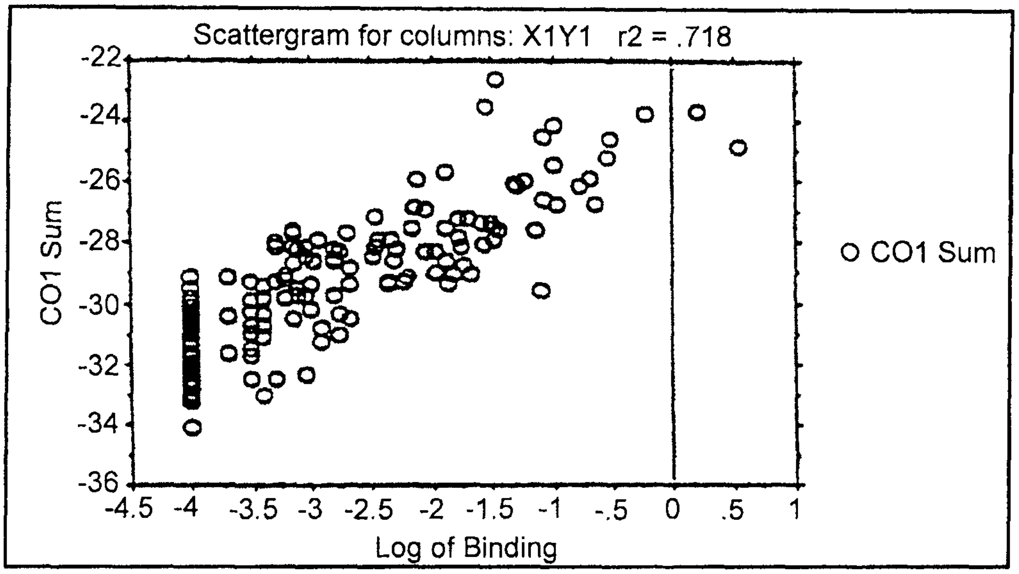

The results obtained by this type of analysis for 9-mer peptides are shown in FIG. 42A and FIG. 42B for the 2-9 and 3-9 motifs, respectively; diagrams illustrating the secondary effects detected by this analysis are also shown as FIG. 42C and FIG. 42D (for the 2-9 and 3-9 motifs, respectively). Increases or decreases in average affinity greater than four-fold are defined as significant, as described herein, and were used to determine preferred or deleterious residues.

In general, for most positions binding capacity was affected, either negatively or positively, by the presence of particular residue types. For example, in the case of the 2-9 motif, it was found that peptides carrying either D or E at position 1 bound poorly to A*0101 molecules, with an average relative binding capacity (ARBC) of 0.20. Conversely, peptides carrying aromatic residues (Y, F, or W) at the same position (position 1) bound with an affinity, on average, four-fold higher (ARBC 4-0) than the overall average binding capacity of the entire peptide set.

Inspection of the diagrams reveals some interesting features of peptide binding to A*0101. First, as noted above, the anchors at positions 2 and 3 act synergistically with each other. The affinity of peptides carrying the M, S or T anchors in position 2 is dramatically increased by the presence of D or E in 3 (and to a lesser extent by A). Conversely, the affinity of peptides carrying the D or E anchors at position 3 was dramatically increased by the presence of S, T, and M (but also other hydrophobic or short chain molecules such as L, V, I, C and A) at position 2.

The degree to which peptides bearing either the 9-mer or 10-mer motifs differ in binding to the A*0101 HLA molecule is revealed by examining other positions. Comparing the values in FIG. 42A and FIG. 42B, it is clear that there are numerous examples where residues neutral in the context of one motif had positive or negative effects in the context of the other motif. At position one, for example, in the 2-9 motif G and aromatic (Y, F, and W) residues are preferred (ARBC>4.0), A and positively charged (R, H, and K) residues are relatively neutral (ARBCs between 4.0 and 0.25), and negatively charged (D and E) residues are deleterious (ARBC <0.25). In the case of peptides carrying the 3-9 motif, a different pattern is noted for position one and, with the exception of G, which is still preferred, the preferences are shuffled. Positively charged residues at position one have a significant positive influence on peptide binding (ARBC of 8.3), negatively charged and aromatic residues are neutral (ARBCs of 1.3 and 0.61, respectively), and A is deleterious (ARBC of 0.15). Similar types of modulation are observed at each position along the motif.

Overall, the shifts in secondary anchor preference from motif to motif are set forth in the summary diagrams shown in FIG. 42A, FIG. 42B, FIG. 42C, and FIG. 42D. In this context, it can be seen that, with the lone exception of the shared preference for G in position one, and excluding the position 2 and 3 co-anchors, the extended motifs of the two A*0101 9-mer motifs are in fact completely different. Thus, in a quantitative sense, the two 9-mer motifs have only one secondary effect out of 27 (3.7%) in common. The degree to which these A*0101 motifs differ is in striking contrast to the multiple similarities noted between the extended motifs of A24, A*0201, and A3 molecules (Kondo, et al., supra, where it was observed that between 3 and 5 (13-26%) secondary effects were shared between any two extended motifs.

Effects of Secondary Residues on A1 Binding for 10-mer Peptides.

Analogous to what was described in the section above for 9-mer ligands, secondary anchor residues and secondary effects were also defined for the 2-10 and 3-10 submotifs for peptides that bind to HLA A1 molecules. The results of these analyses are presented in FIG. 43A and FIG. 43B, FIG. 43C, and FIG. 43D. Once again, it appeared the anchors present in position 2 and 3 could act synergistically with each other. The presence of D, E (and to a much lesser extent A, Q and N) in position 3, in the context of the 2-10 motif, and of hydrophobic (L, I, V, M) or short chain (S, T, C) residues in position 2, in the context of the 3-10 submotif, were associated with significant increases in average binding affinity.

Figure 5B:
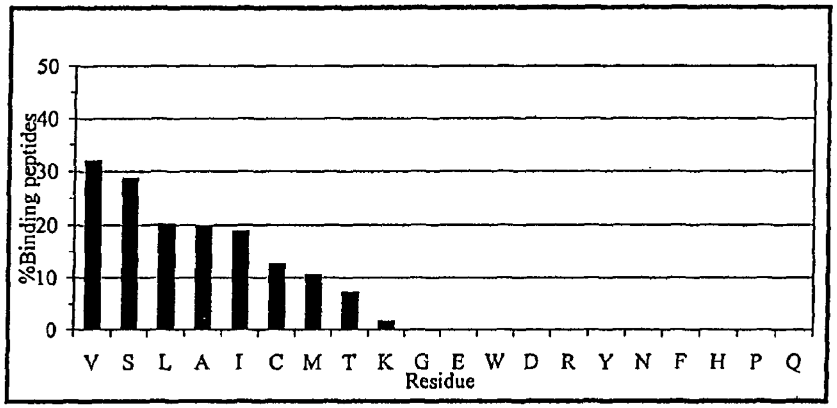
Figure 7A:
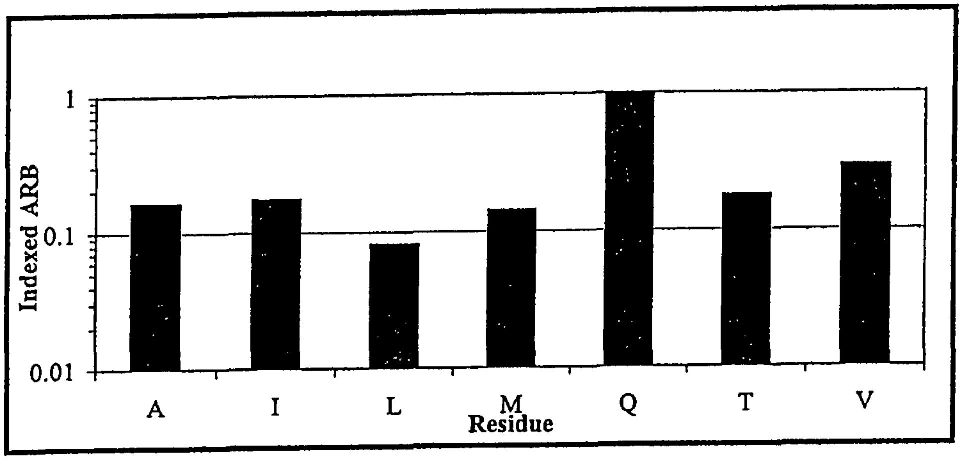
FIGS. 7A-7D. Position 2 fine specificity of HLA-A2-supertype molecules. ARB values of peptides bearing specific residues in position 2 were calculated for each A2-supertype molecule as described in the text, and indexed relative to the residue with the highest ARB for each specific molecule. The average (geometric) binding capacity of the peptides bearing the residue with the highest ARB were 55, 59, 89, and 41 nM for A*0202, A*0206, and A*6802, respectively.
Figure 7B:
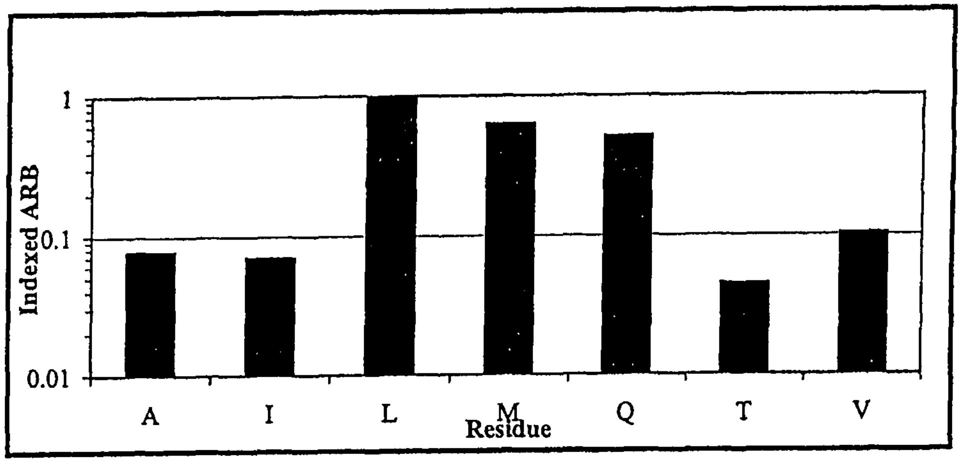
Figure 7C:
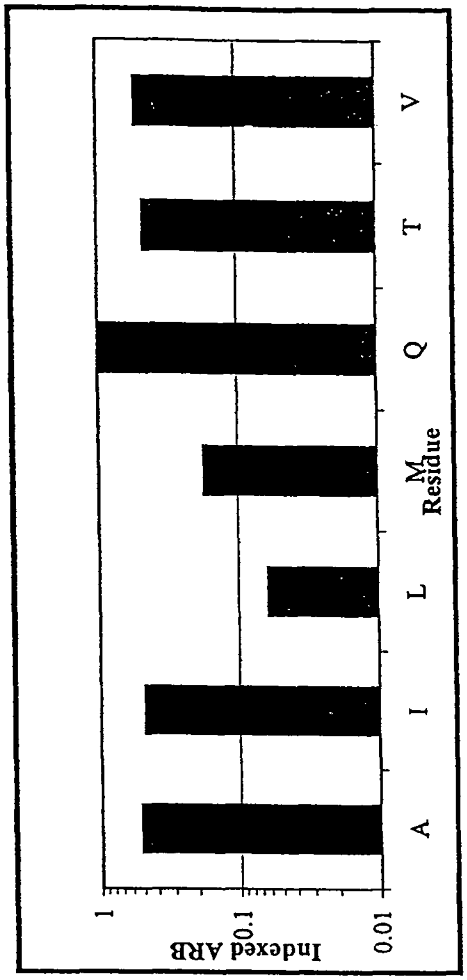
Figure 7D:
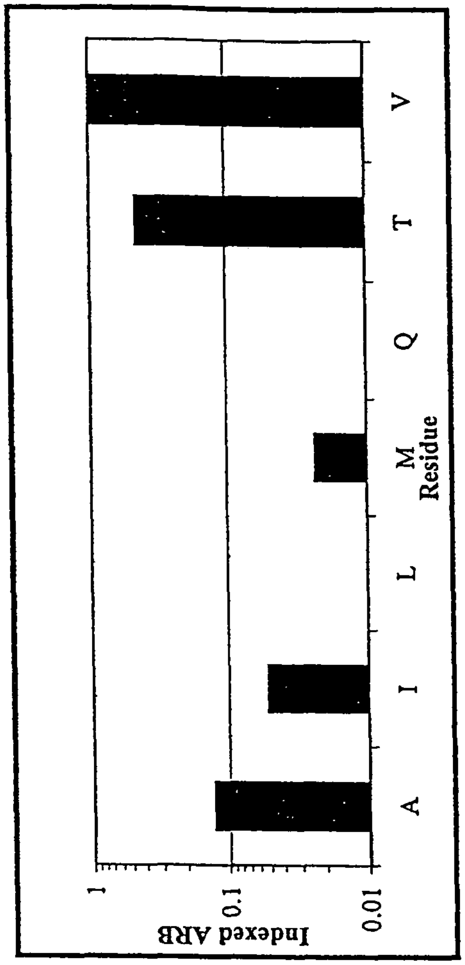
Figure 8A:
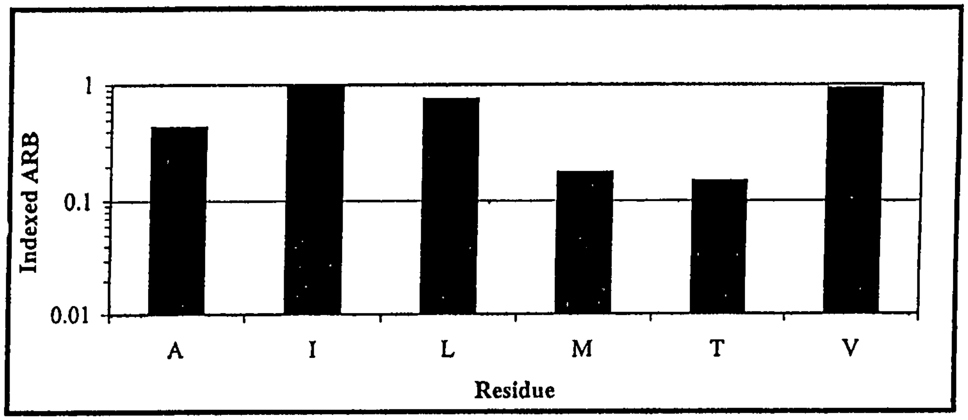
FIGS. 8A-8D. C-terminal fine specificity of HLA-A2-supertype molecules. ARB values of peptides bearing specific residues at the C-terminus were calculated for each A2-supertype molecule as described in the text, and indexed relative to the residue with the highest ARB for each specific molecule. The average (geometric) binding capacity of the peptides bearing the residue with the highest ARB were 291, 48, 250, and 553 nM for A*0202, A*0203, A*0206, and A*6802, respectively.
Figure 8B:
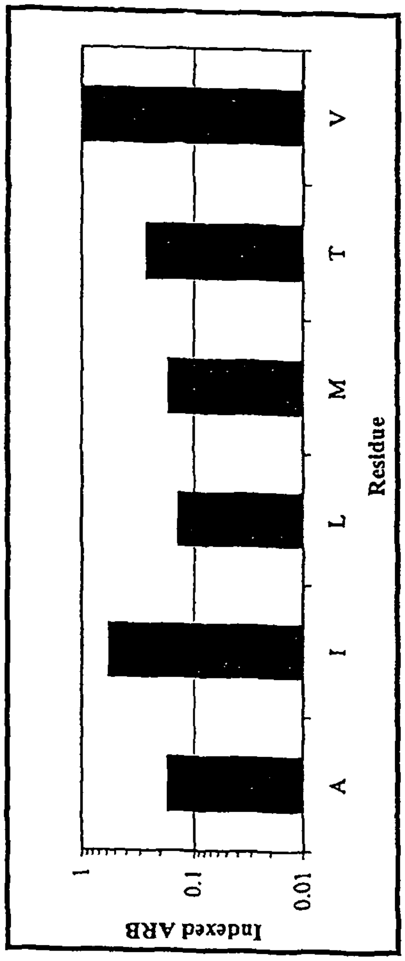
Figure 8C:
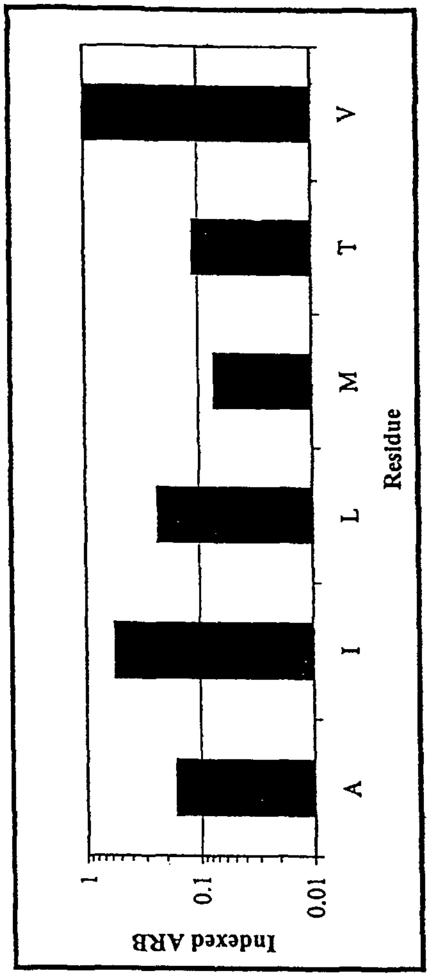
Figure 8D:
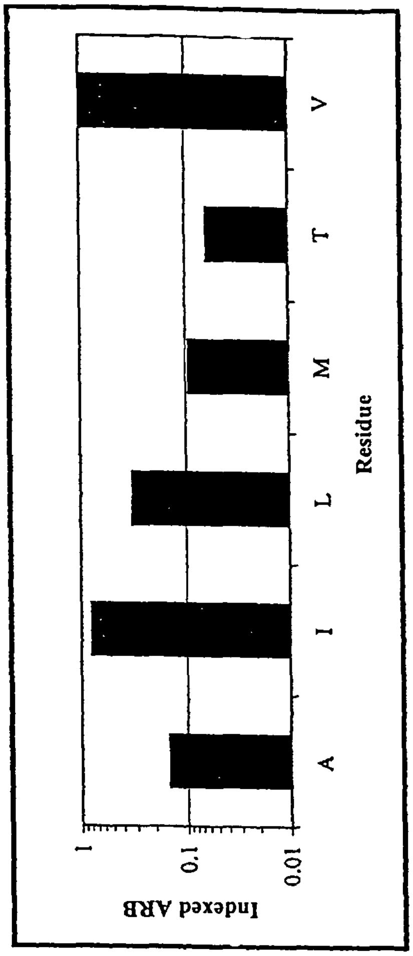
Figure 12:
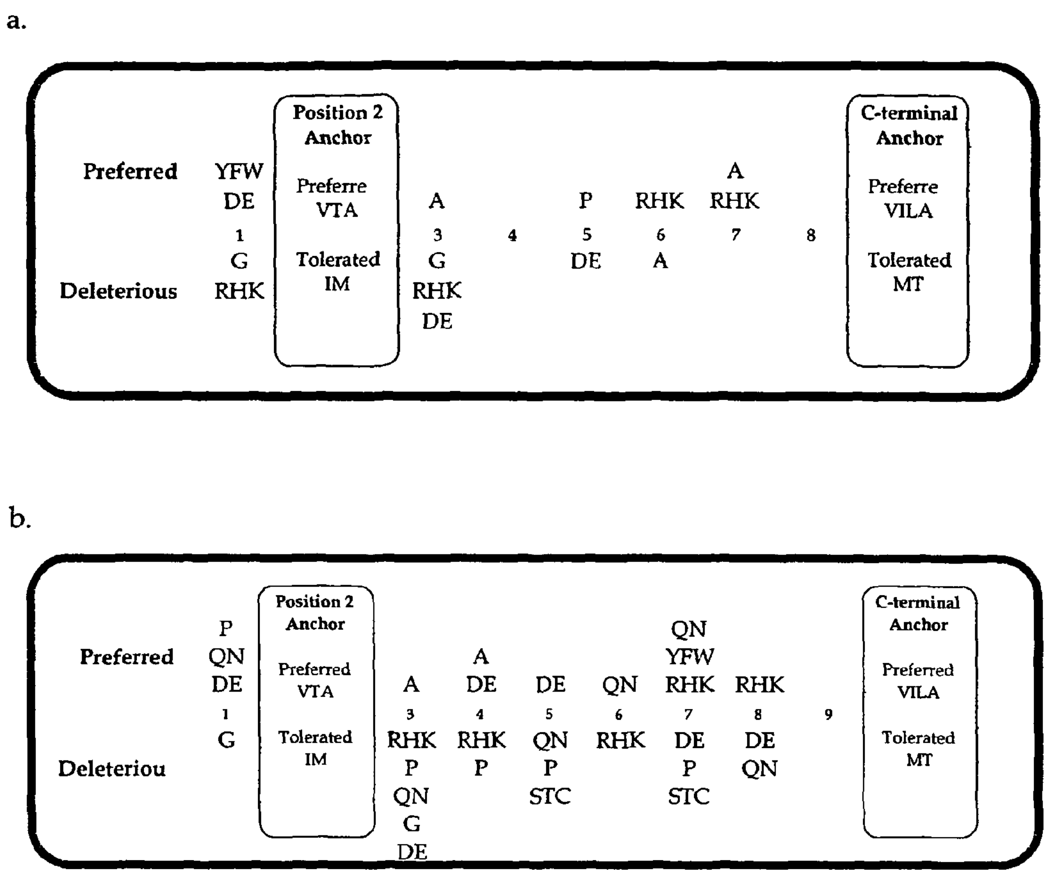
FIG. 12. Map of the A*6802 motif. Summary maps of A*6802 motif for 9-mer (a) and 10-mer (b) peptides. At secondary anchor positions, residues shown as preferred (or deleterious) are associated with an average binding capacity at least 3-fold greater than (or 3-fold less than) peptides of the same size carrying other residues at the same position. At the primary anchor positions, preferred residues are those associated with an average binding capacity within 10-fold of the optimal residue at the same position. Tolerated primary anchor residues are those associated with an average binding capacity between 10- and 100-fold of the optimal residue at the same position.

Comparison of the two 10-mer motifs at positions other than 2, 3 and the C-termini indicates that, as was the case with 9-mer peptides, modulation in secondary anchor specificity occurs dependent on what the primary anchor residues are. For example, at position 7, A and S, T, and C are preferred in the 2-10 motif, but are neutral in the 3-10 motif. Conversely, G is preferred in the 3-10 motif, but is neutral in the 2-10 motif. However, it is also evident that, in contrast to the 9-mer motifs, these differences observed in 10-mers are much less striking. In fact, the two 10-mer motifs share a number of preferences. For example, Y, F, and W in positions 1 and 5, A in 4, P in 7, and G in 8 had positive effects for both motifs. Similarly, R, H, and K in 8 were deleterious in both 10-mer motifs (FIGS. 5*c* and 5*d*). In total, the two 10-mer motifs shared 6 secondary effects out of 25 (24%).

In accordance with the principles for preparing peptide analogs disclosed herein, this information provides guidance for the preparation of 9-mer and 10-mer peptides that bind to HLA A1 molecules.

These example and equivalents thereof will become more apparent to those skilled in the art in light of the present disclosure and the accompanying claims. It should be understood, however, that the examples are designed for the purpose of illustration only and not limiting of the scope of the invention in any way. All patents and publications cited herein are fully incorporated by reference herein in their entirety.

TABLE 2

| Peptide | AA | Sequence | SEQ ID NO | Source | A*0201 |
|---|---|---|---|---|---|
| 17.0317 | 9 | LQIGNIISI | 1 | Flu.24 | 0.0130 |
| 38.0103 | 9 | NLSLSCHAA | 2 | CEA.432 | 0.0110 |
| 1233.11 | 9 | YLSGANLNV | 3 | CEA.605V9 | 0.0690 |
| 1295.03 | 9 | SMPPPGTRV | 4 | p53.149M2 | 0.0290 |
| 1295.04 | 9 | SLPPPGTRV | 5 | p53.149L2 | 0.0410 |
| 1317.24 | 9 | KTCPVQLWV | 6 | p53.139 | 0.0069 |
| 1323.02 | 9 | KLLPENNVV | 7 | p53.24V9 | 0.0130 |
| 1323.04 | 9 | ALNKMFBQV | 8 | p53.129B7V9 | 0.0260 |
| 1323.06 | 9 | KLBPVQLWV | 9 | p53.139L2B3 | 0.1100 |
| 1323.08 | 9 | BLTIHYNYV | 10 | p53.229B1L2V9 | 0.0430 |
| 1323.18 | 10 | LLPPQHLIRV | 11 | p53.188L2 | 0.0061 |
| 1323.29 | 11 | YMCNSSCMGGM | 12 | p53.236 | 0.0075 |
| 1323.31 | 11 | YLCNSSCMGGV | 13 | p53.236L2V11 | 0.2300 |
| 1323.34 | 11 | KLYQGSYGFRV | 14 | p53.101L2V11 | 0.0620 |
| 1324.07 | 9 | CQLAKTCPV | 15 | p53.135 | 0.0240 |
| 1325.01 | 9 | RLPEAAPPV | 16 | p53.65L2 | 0.0640 |
| 1325.02 | 9 | GLAPPQHLV | 17 | p53.187V9 | 0.0130 |
| 1325.04 | 9 | KMAELVHFL | 18 | MAGE3.112M2 | 0.2100 |
| 1325.05 | 9 | KLAELVHFL | 19 | MAGE3.112L2 | 0.2500 |
| 1326.01 | 9 | CLLAKTCPV | 20 | p53.135L2 | 0.0400 |
| 1326.02 | 9 | KLSQHMTEV | 21 | p53.164L2 | 0.0410 |
| 1326.04 | 9 | ELAPVVAPV | 22 | p53.68L2V9 | 0.0860 |
| 1326.06 | 10 | QLAKTCPVQV | 23 | p53.136 | 0.0320 |
| 1326.08 | 9 | HLTEVVRRV | 24 | p53.168L2 | 0.0180 |
| 1329.01 | 11 | KTYQGSYGFRL | 25 | | 0.0028 |
| 1329.03 | 10 | VVVPYEPPEV | 26 | p53.216 | 0.0081 |
| 1329.14 | 9 | BQLAKTBPV | 27 | p53.135B1B7 | 0.0490 |
| 1329.15 | 9 | BLLAKTBPV | 28 | p53.135B1L2B7 | 0.1100 |
| 1330.01 | 9 | QIIGYVIGT | 29 | CEA.78 | 0.0160 |
| 1330.02 | 9 | QLIGYVIGV | 30 | CEA.78L2V9 | 0.5300 |
| 1330.05 | 9 | YVCGIQNSV | 31 | CEA.569 | 0.0510 |

TABLE 2-continued

| Peptide | AA | Sequence | SEQ ID NO | Source | A*0201 |
|---|---|---|---|---|---|
| 1330.06 | 9 | YLCGIQNSV | 32 | CEA.569L2 | 0.1000 |
| 1330.07 | 9 | ATVGIMIGV | 33 | CEA.687 | 0.1400 |
| 1330.08 | 9 | ALVGIMIGV | 34 | CEA.687L2 | 0.5000 |
| 1330.09 | 10 | VLYGPDDPTI | 35 | CEA.411 | 0.0170 |
| 1330.10 | 10 | VLYGPDDPTV | 36 | CEA.411V10 | 0.0310 |
| 1331.02 | 9 | DLMLSPDDV | 37 | p53.42V9 | |
| 1331.03 | 9 | ALMLSPDDI | 38 | p53.42A1 | |
| 1331.04 | 9 | ALMLSPDDV | 39 | p53.42A1V9 | |
| 1331.05 | 9 | DLMLSPADI | 40 | p53.42A7 | |
| 1331.06 | 9 | DLMLSPADV | 41 | p53.42A7V9 | |
| 1331.07 | 9 | DLMLSPDAI | 42 | p53.42A8 | |
| 1331.08 | 9 | DLMLSPDAV | 43 | p53.42A8V9 | |
| 38.0007 | 9 | AILTFGSFV | 44 | KSHV.89 | 0.0850 |
| 38.0009 | 9 | HLRDFALAV | 45 | KSHV.106 | 0.0183 |
| 38.0015 | 9 | ALLGSIALL | 46 | KSHV.155 | 0.0470 |
| 38.0018 | 9 | ALLATILAA | 47 | KSHV.161 | 0.0490 |
| 38.0019 | 9 | LLATILAAV | 48 | KSHV.162 | 0.1600 |
| 38.0022 | 9 | RLFADELAA | 49 | KSHV.14 | 0.0150 |
| 38.0024 | 9 | YLSKCTLAV | 50 | KSHV.65 | 0.2000 |
| 38.0026 | 9 | LVYHIYSKI | 51 | KSHV.153 | 0.0457 |
| 38.0029 | 9 | SMYLCILSA | 52 | KSHV.208 | 0.0250 |
| 38.0030 | 9 | YLCILSALV | 53 | KSHV.210 | 0.3500 |
| 38.0033 | 9 | VMFSYLQSL | 54 | KSHV.268 | 0.5000 |
| 38.0035 | 9 | RLHVYAYSA | 55 | KSHV.285 | 0.0270 |
| 38.0039 | 9 | GLQTLGAFV | 56 | KSHV.98 | 0.0110 |
| 38.0040 | 9 | FVEEQMTWA | 57 | KSHV.105 | 0.0380 |
| 38.0041 | 9 | QMTWAQTVV | 58 | KSHV.109 | 0.0110 |
| 38.0042 | 9 | IILDTAIFV | 59 | KSHV.130 | 0.6800 |
| 38.0043 | 9 | AIFVCNAFV | 60 | KSHV.135 | 0.0910 |
| 38.0046 | 9 | AMGNRLVEA | 61 | KSHV.172 | 0.0200 |
| 38.0047 | 9 | RLVEACNLL | 62 | KSHV.176 | 0.0180 |
| 38.0059 | 9 | TLSIVTFSL | 63 | KSHV.198 | 0.2200 |
| 38.0063 | 9 | KLSVLLLEV | 64 | KSHV.292 | 0.1400 |
| 38.0064 | 9 | LLLEVNRSV | 65 | KSHV.296 | 0.0270 |
| 38.0068 | 9 | FVSSPTLPV | 66 | KSHV.78 | 0.0350 |
| 38.0070 | 9 | AMLVLLAEI | 67 | KSHV.281 | 0.0820 |
| 38.0075 | 9 | QMARLAWEA | 68 | KSHV.1116 | 0.0990 |
| 38.0131 | 10 | VLALEGIFMA | 69 | KSHV.10 | 0.0730 |
| 38.0132 | 10 | YLYHPLLSPI | 70 | KSHV.27 | 0.1400 |
| 38.0134 | 10 | SLFEAMLANV | 71 | KSHV.49 | 0.9500 |
| 38.0135 | 10 | STTGINQLGL | 72 | KSHV.62 | 0.0710 |
| 38.0137 | 10 | LAILTFGSFV | 73 | KSHV.88 | 0.0160 |
| 38.0139 | 10 | ALLGSIALLA | 74 | KSHV.155 | 0.0360 |
| 38.0141 | 10 | ALLATILAAV | 75 | KSHV.161 | 0.1100 |
| 38.0142 | 10 | LLATILAAVA | 76 | KSHV.162 | 0.0110 |
| 38.0143 | 10 | RLFADELAAL | 77 | KSHV.14 | 0.1800 |
| 38.0148 | 10 | YLSKCTLAVL | 78 | KSHV.65 | 0.0300 |
| 38.0150 | 10 | LLVYHIYSKI | 79 | KSHV.152 | 0.0130 |
| 38.0151 | 10 | SMYLCILSAL | 80 | KSHV.208 | 0.0360 |
| 38.0153 | 10 | HLHRQMLSFV | 81 | KSHV.68 | 0.0160 |
| 38.0163 | 10 | LLCGKTGAFL | 82 | KSHV.167 | 0.0100 |
| 38.0164 | 10 | ETLSIVTFSL | 83 | KSHV.197 | 0.0180 |
| 39.0063 | 9 | VMCTYSPPL | 84 | mp53.119 | 1.4000 |
| 39.0065 | 9 | KLFCQLAKT | 85 | mp53.129 | 0.0160 |
| 39.0067 | 9 | ATPPAGSRV | 86 | mp53.146 | 0.0130 |
| 39.0133 | 10 | FLQSGTAKSV | 87 | mp53.110 | 0.0180 |
| 39.0169 | 10 | CMDRGLTVFV | 88 | KSHV.311 | 0.0120 |
| 39.0170 | 10 | VLLNWWRWRL | 89 | KSHV.327 | 0.1500 |
| 40.0070 | 9 | GVFTGLTHI | 90 | HCV.1565 | 0.0110 |
| 40.0072 | 9 | QMWKCLIRL | 91 | HCV.1611 | 0.0620 |
| 40.0074 | 9 | IMTCMSADL | 92 | HCV.1650 | 0.0121 |
| 40.0076 | 9 | ALAAYCLST | 93 | HCV.1674 | 0.2500 |
| 40.0080 | 9 | VLSGKPAII | 94 | HCV.1692 | 0.0150 |
| 40.0082 | 9 | FISGIQYLA | 95 | HCV.1773 | 0.1000 |
| 40.0134 | 10 | YIMTCMSADL | 96 | HCV.1649 | 0.0300 |
| 40.0137 | 10 | AIASLMAFTA | 97 | HCV.1791 | 0.0580 |
| 40.0138 | 10 | GLAGAAIGSV | 98 | HCV.1838 | 0.0320 |
| 41.0058 | 8 | MIGVLVGV | 99 | CEA.692 | 0.0120 |
| 41.0061 | 9 | VLPLAYISL | 100 | TRP1 | 0.0110 |
| 41.0062 | 9 | SLGCIFFPL | 101 | TRP1 | 0.9700 |
| 41.0063 | 9 | PLAYISLFL | 102 | TRP1 | 0.0220 |
| 41.0065 | 9 | LMLFYQVWA | 103 | TRP1 | 0.0270 |
| 41.0071 | 9 | NLSIYNYFV | 104 | TRP1 | 0.2300 |
| 41.0072 | 9 | NISVYNYFV | 105 | TRP1 | 0.0600 |
| 41.0075 | 9 | FVWTHYYSV | 106 | TRP1 | 1.5000 |
| 41.0077 | 9 | FLTWHRYHL | 107 | TRP1 | 0.5500 |

TABLE 2-continued

| Peptide | AA | Sequence | SEQ ID NO | Source | A*0201 |
|---|---|---|---|---|---|
| 41.0078 | 9 | LTWHRYHLL | 108 | TRP1 | 0.1600 |
| 41.0082 | 9 | MLQEPSFSL | 109 | TRP1 | 0.6900 |
| 41.0083 | 9 | SLPYWNFAT | 110 | TRP1 | 0.0110 |
| 41.0088 | 9 | RLPEPQDVA | 111 | TRP1 | 0.0180 |
| 41.0090 | 9 | VTQCLEVRV | 112 | TRP1 | 0.0160 |
| 41.0096 | 9 | LLHTFTDAV | 113 | TRP1 | 0.2700 |
| 41.0100 | 9 | NMVPFWPPV | 114 | TRP1 | 0.6200 |
| 41.0104 | 9 | AVVGALLLV | 115 | TRP1 | 0.0210 |
| 41.0105 | 9 | AVVAALLLV | 116 | TRP1 | 0.0390 |
| 41.0108 | 9 | LLVAAIFGV | 117 | TRP1 | 1.9000 |
| 41.0112 | 9 | SMDEANQPL | 118 | TRP1 | 0.0770 |
| 41.0114 | 9 | VLPLAYISV | 119 | TRP1 | 0.1100 |
| 41.0115 | 9 | SLGCIFFPV | 120 | TRP1 | 3.2000 |
| 41.0116 | 9 | PLAYISLFV | 121 | TRP1 | 0.0310 |
| 41.0117 | 9 | LLLFQQARV | 122 | TRP1 | 0.1100 |
| 41.0118 | 9 | LMLFYQVWV | 123 | TRP1 | 2.4000 |
| 41.0119 | 9 | LLPSSGPGV | 124 | TRP1 | 0.3700 |
| 41.0121 | 9 | NLSIYNYFV | 125 | TRP1 | 0.9700 |
| 41.0122 | 9 | NLSVYNYFV | 126 | TRP1 | 0.8700 |
| 41.0123 | 9 | FLWTHYYSV | 127 | TRP1 | 5.6000 |
| 41.0124 | 9 | SLKKTFLGV | 128 | TRP1 | 0.0224 |
| 41.0125 | 9 | FLTWHRYHV | 129 | TRP1 | 0.3800 |
| 41.0129 | 9 | MLQEPSFSV | 130 | TRP1 | 1.6000 |
| 41.0130 | 9 | SLPYWNFAV | 131 | TRP1 | 0.5700 |
| 41.0131 | 9 | ALGKNVCDV | 132 | TRP1 | 0.0160 |
| 41.0132 | 9 | SLLISPNSV | 133 | TRP1 | 0.1300 |
| 41.0133 | 9 | SLFSQWRVV | 134 | TRP1 | 0.0740 |
| 41.0134 | 9 | TLGTLCNSV | 135 | TRP1 | 0.0330 |
| 41.0136 | 9 | RLPEPQDVV | 136 | TRP1 | 0.1000 |
| 41.0137 | 9 | VLQCLEVRV | 137 | TRP1 | 0.0360 |
| 41.0138 | 9 | SLNSFRNTV | 138 | TRP1 | 0.0140 |
| 41.0139 | 9 | SLDSFRNTV | 139 | TRP1 | 0.0440 |
| 41.0141 | 9 | FLNGTGGQV | 140 | TRP1 | 0.0220 |
| 41.0142 | 9 | VLLHTFTDV | 141 | TRP1 | 0.0180 |
| 41.0145 | 9 | ALVGALLLV | 142 | TRP1 | 0.2600 |
| 41.0146 | 9 | ALVAALLLV | 143 | TRP1 | 0.5800 |
| 41.0147 | 9 | LLVALIFGV | 144 | TRP1 | 1.0000 |
| 41.0148 | 9 | YLIRARRSV | 145 | TRP1 | 0.0170 |
| 41.0149 | 9 | SMDEANQPV | 146 | TRP1 | 0.1600 |
| 41.0151 | 10 | SLGCIFFPLL | 147 | TRP1 | 0.1800 |
| 41.0157 | 10 | GMCCPDLSPV | 148 | TRP1 | 0.0950 |
| 41.0160 | 10 | AACNQKILTV | 149 | TRP1 | 0.0120 |
| 41.0162 | 10 | FLTWHRYHLL | 150 | TRP1 | 0.0830 |
| 41.0166 | 10 | SLHNLAHLFL | 151 | TRP1 | 0.3900 |
| 41.0174 | 10 | LLLVAAIFGV | 152 | TRP1 | 0.3000 |
| 41.0177 | 10 | LLVAAIFGVA | 153 | TRP1 | 0.0820 |
| 41.0178 | 10 | ALIFGTASYL | 154 | TRP1 | 0.0230 |
| 41.0180 | 10 | SMDEANQPLL | 155 | TRP1 | 0.0250 |
| 41.0181 | 10 | LLTDQYQCYA | 156 | TRP1 | 0.0320 |
| 41.0183 | 10 | SLGCIFFPLV | 157 | TRP1 | 0.3200 |
| 41.0186 | 10 | FLMLFYQVWV | 158 | TRP1 | 0.8100 |
| 41.0189 | 10 | ALCDQRVLIV | 159 | TRP1 | 0.0530 |
| 41.0190 | 10 | ALCNQKILTV | 160 | TRP1 | 0.0770 |
| 41.0191 | 10 | FLTWHRYHLV | 161 | TRP1 | 0.0510 |
| 41.0197 | 10 | SLHNLAHLFV | 162 | TRP1 | 0.5000 |
| 41.0198 | 10 | NLAHLFLNGV | 163 | TRP1 | 0.4100 |
| 41.0199 | 10 | NMVPFWPPVV | 164 | TRP1 | 0.2800 |
| 41.0201 | 10 | ILVVAALLLV | 165 | TRP1 | 0.0190 |
| 41.0203 | 10 | LLVALIFGTV | 166 | TRP1 | 0.1200 |
| 41.0205 | 10 | ALIFGTASYV | 167 | TRP1 | 0.0900 |
| 41.0206 | 10 | SMDEANQPLV | 168 | TRP1 | 0.0350 |
| 41.0207 | 10 | LLTDQYQCYV | 169 | TRP1 | 0.2100 |
| 41.0212 | 11 | LLIQNIIQNDT | 170 | CEA.107 | 0.0140 |
| 41.0214 | 11 | IIQNDTGFYTL | 171 | CEA.112 | 0.0130 |
| 41.0221 | 11 | TLFNVTRNDTA | 172 | CEA.201 | 0.0110 |
| 41.0235 | 11 | LTLLSVTRNDV | 173 | CEA.378 | 0.0150 |
| 41.0243 | 11 | GLYTCQANNSA | 174 | CEA.473 | 0.0290 |
| 41.0268 | 11 | ATVGIMIGVLV | 175 | CEA.687 | 0.0160 |
| 44.0075 | 11 | GLVPPQHLIRV | 176 | mp53.184.V3 | 0.0370 |
| 44.0087 | 11 | GLAPPVHLIRV | 177 | mp53.184.V6 | 0.0330 |
| 44.0092 | 11 | GLAPPEHLIRV | 178 | mp53.184.E6 | 0.1600 |
| 1227.10 | 9 | ILIGVLVGV | 179 | CEA.691.L2 | 0.2300 |
| 1234.26 | 10 | YLIMVKCWMV | 180 | Her2/ neu.952.L2V10 | 0.3800 |
| 1295.06 | 9 | LLGRDSFEV | 181 | mp53.261 | 0.2000 |
| 1319.01 | 9 | FMYSDFHFI | 182 | Flu.RRP2.446 | 0.4400 |

TABLE 2-continued

| Peptide | AA | Sequence | SEQ ID NO | Source | A*0201 |
|---|---|---|---|---|---|
| 1319.06 | 9 | NMLSTVLGV | 183 | Flu.RRP2.446 | 0.1700 |
| 1319.14 | 9 | SLENFRAYV | 184 | Flu.RRP2.446 | 0.0430 |
| 1325.06 | | KMAELVHFV | 185 | Mage3.112 | 0.1900 |
| 1325.07 | | KLAELVHFV | 186 | Mage3.112 | 0.3500 |
| 1334.01 | | VLIQRNPQV | 187 | Her2/neu.153.V9 | 0.0910 |
| 1334.02 | | VLLGVVFGV | 188 | Her2/ neu.665.L2V9 | 2.1000 |
| 1334.03 | | SLISAVVGV | 189 | Her2/ neu.653.L2V9 | 0.7000 |
| 1334.04 | | YMIMVKBWMI | 190 | Her2/neu.952.B7 | 0.2700 |
| 1334.05 | | YLIMVKBWMV | 191 | Her2/ neu.952.L2B7V10 | 0.6900 |
| 1334.06 | | KLWEELSVV | 192 | Mage3.220.L2V9 | 0.4500 |
| 1334.08 | | AMBRWGLLV | 193 | Her2/ neu.5.M2B3V9 | 0.1400 |
| 1345.01 | 9 | IJIGVLVGV | 194 | CEA.691.J2 | 0.0570 |
| 1345.02 | 9 | ATVGIJIGV | 195 | CEA.687.J6 | 0.1595 |
| 1345.03 | 9 | SJPPPGTRV | 196 | p53.149.72 | 0.0545 |
| 1345.04 | 10 | LVFGIELJEV | 197 | MAGE3.160.J8 | 0.7650 |
| 918.12 | 8 | ILGFVFTL | 198 | Flu.M1.59 | 0.7900 |
| 1095.22 | 9 | KIFGSLAFL | 199 | Her2/neu | |
| 1090.01 | 10 | YLQLVFGIEV | 200 | MAGE2 | |
| 1126.01 | 9 | MMNDQLMFL | 201 | PSM | |
| 1126.02 | 10 | ALVLAGGFFL | 202 | PSM | |
| 1126.03 | 9 | WLCAGALVL | 203 | PSM | |
| 1126.05 | 9 | MVFELANSI | 204 | PSM | |
| 1126.06 | 10 | RMMNDQLMFL | 205 | PSM | |
| 1126.09 | 9 | LVLAGGFFL | 206 | PSM | |
| 1126.10 | 9 | VLAGGFFLL | 207 | PSM | |
| 1126.12 | 9 | LLHETDSAV | 208 | PSM | |
| 1126.14 | 9 | LMYSLVHNL | 209 | PSM | |
| 1126.16 | 10 | QLMFLERAFI | 210 | PSM | |
| 1126.17 | 9 | LMFLERAFI | 211 | PSM | |
| 1126.20 | 10 | KLGSGNDFEV | 212 | PSM | |
| 1129.01 | 10 | LLQERGVAYI | 213 | PSM | |
| 1129.04 | 10 | GMPEGDLVYV | 214 | PSM | |
| 1129.05 | 10 | FLDELKAENI | 215 | PSM | |
| 1129.08 | 9 | ALFDIESKV | 216 | PSM | |
| 1129.10 | 10 | GLPSIPVHPI | 217 | PSM | |

TABLE 3

| HLA-DR motifs | | | |
|---|---|---|---|
| | Anchor residues of HLA-DR core motifs | | |
| | p1 | p4 | p6 |
| DR supertype | L, I, V, M, F, W, Y | — | L, I, V, M, S, T, P, C, A |
| DR3 a | L, I, V, M, F, Y | D, E | — |
| DR3 b | L, I, V, M, F, Y, A | D, E, N, Q, S, T | K, R, H |

TABLE 4

| ANTIBODY REAGENTS | | |
|---|---|---|
| anti-HLA | Name | |
| HLA-A1 | 12/18 | |
| HLA-A3 | GAPA3 | (ATCC, HB122) |
| HLA-11, 24.1 | A11.1M | (ATCC, HB164) |
| HLA-A, B, C | W6/32 | (ATCC, HB95) |
| monomorphic | B9.12.1 | (INSERM-CNRS) |
| HLA-B, C monomorphic | B.1.23.2 | (INSERM-CNRS) |

TABLE 5

| Murine Class I Motifs | | | | |
|---|---|---|---|---|
| | Anchor residues of mouse class I motifs | | | |
| Allele | p2 | p3 | p5 | C terminus |
| Db | — | — | N | L, I, V, M |
| Dd | G | P | — | L, V, I |
| Kb | — | — | YF | L, I, V, M |
| Kd | YF | — | — | L, I, V, M |
| Kk | ED | — | — | L, I, M, V, A |
| Ld | P | — | — | L, I, M, V, F, W, Y |

TABLE 6

| Summary | |
|---|---|
| Position | HLA-A3, 2 Allele-Specific Motif Conserved Residues |
| 1 | — |
| 2 | V, L, M |
| 3 | Y, D |
| 4 | — |
| 5 | — |
| 6 | — |
| 7 | I |
| 8 | Q, N |
| 9 | K |
| 10 | K |

TABLE 7

| Summary | |
|---|---|
| Position | HLA-A1 Allele-Specific Motif Conserved Residues |
| 1 | — |
| 2 | S, T |
| 3 | D, E |
| 4 | P |
| 5 | — |
| 6 | — |
| 7 | L |
| 8 | — |
| 9 | Y |
| 10 | K |

TABLE 8

| Summary | |
|---|---|
| Position | HLA-A11 Allele-Specific Motif Conserved Residues |
| 1 | — |
| 2 | T, V |
| 3 | M, F |
| 4 | — |
| 5 | — |
| 6 | — |
| 7 | — |
| 8 | Q |
| 9 | K |
| 10 | K |

TABLE 9

| Summary | |
|---|---|
| Position | HLA-A24.1 Allele-Specific Motif Conserved Residues |
| 1 | — |
| 2 | Y |
| 3 | I, M |
| 4 | D, E, G, K, P |
| 5 | L, M, N |
| 6 | V |
| 7 | N, V |
| 8 | A, E, K, Q, S |
| 9 | F, L |
| 10 | F, A |

TABLE 10

| Peptide | Sequence | SEQ ID NO | AA | Organism | Protein | Position | Analog | A*0101 | A*2902 | A*3002 |
|---|---|---|---|---|---|---|---|---|---|---|
| 83.0155 | AYGPGPGKF | 218 | 9 | Artificial sequence | Consensus | | A | | 44854 | 3.2 |
| 1420.37 | AEIPYLAKY | 219 | 9 | Artificial sequence | pool consensus | | A | | | 144 |
| 21.0009 | AADAAAAKY | 220 | 9 | Artificial sequence | | | PolyA | 20 | | |
| 1428.08 | AYSSWMYSY | 221 | 9 | EBV | EBNA3 | 176 | | | | 4.9 |
| 26.0044 | LAEKTMKEY | 222 | 9 | FluA | POL2 | 16 | | 174 | | |
| 26.0076 | GTYDYWAGY | 223 | 9 | Gonorrhea | | | | 141 | | |
| 26.0277 | LSVHSIQNDY | 224 | 10 | Gonorrhea | | | | 279 | | |
| 26.0279 | DTGQCPELVY | 225 | 10 | Gonorrhea | | | | 129 | | |
| 1448.01 | DLLDTASALY | 226 | 10 | HBV | Core | 419 | | | 74 | 37 |
| 1142.09 | WFHISCLTF | 227 | 9 | HBV | NUC | 102 | | 85324 | 95 | 75094 |
| 83.0105 | LSLDVSAAFY | 228 | 10 | HBV | pol | 426 | | 267 | 12 | 7.1 |
| 83.0106 | LSGPGPGAFY | 229 | 10 | HBV | pol | 426 | A | 25 | 1383 | 6.6 |
| 83.0107 | LSLGPGPGFY | 230 | 10 | HBV | pol | 426 | A | 21 | 132 | 8.2 |
| 83.0108 | LSLDGPGPGY | 231 | 10 | HBV | pol | 426 | A | 266 | 274 | 181 |
| 83.0109 | KTYGRKLHLY | 232 | 10 | HBV | pol | 1098 | | 171 | 27 | 1.5 |
| 83.0110 | KTGPGPGHLY | 233 | 10 | HBV | pol | 1098 | A | 29 | 192 | 1.3 |
| 83.0111 | KTYGPGPGLY | 234 | 10 | HBV | pal | 1098 | A | 5.7 | 227 | 0.96 |
| 83.0112 | KTYGGPGPGY | 235 | 10 | HBV | pol | 1098 | A | 282 | 228 | 1.7 |
| 83.0128 | KYTSFPWL | 236 | 8 | HBV | pol | 745 | | | >172413 | 346 |
| 1448.04 | FAAPFTQCGY | 237 | 10 | HBV | pol | 631 | | | 461 | 1364 |
| 1448.07 | SYQHFRKLLL | 238 | 10 | HBV | POL | 4 | | >83333 | 28 | 3768 |
| 1448.08 | LYSHPIILGF | 239 | 10 | HBV | POL | 492 | | 3166 | 109 | 1116 |
| 1448.03 | MSTTDLEAY | 240 | 9 | HBV | X | 103 | | | 2565 | 396 |
| 83.0152 | MYVGGPGPGVF | 241 | 11 | HCV | E1 | 275 | A | | 89 | 2870 |
| 83.0126 | VMGSSYGF | 242 | 8 | HCV | NS5 | 2639 | | | 145 | 41967 |
| 1448.06 | EVDGVRLHRY | 243 | 10 | HCV | NS5 | 2129 | | | 14940 | 113 |
| 73.0002 | RTEILDLWVY | 244 | 10 | HIV | NEF | 182 | A | 99 | 10204 | 315 |
| 73.0003 | RQDILDLWVY | 245 | 10 | HIV | NEF | 182 | A | 8995 | 13928 | 95 |
| 73.0005 | RTDILDLWVY | 246 | 10 | HIV | NEF | 182 | A | 85 | 13424 | 360 |
| 73.0007 | YTDGPGIRY | 247 | 9 | HIV | NEF | 207 | A | 11 | 562 | 7911 |
| 73.0012 | ATELHPEYY | 248 | 9 | HIV | NEF | 322 | A | 43 | 6608 | 1734 |
| 73.0027 | DLWVYHTQGYY | 249 | 11 | HIV | NEF | 188 | A | 5880 | 852 | 16 |
| 73.0032 | WVYHTQGYY | 250 | 9 | HIV | NEF | 191 | A | 703 | 215 | 5.6 |
| 73.0391 | FFLKEKGGF | 251 | 9 | HIV | NEF | 116 | A | | 3015 | 141 |
| 73.0422 | LYVYHTQGY | 252 | 9 | HIV | NEF | 190 | A | | 216 | 258 |
| 73.0037 | ITKILYQSNPY | 253 | 11 | HIV | REV | 20 | A | >10060 | 64908 | 298 |
| 73.0039 | KTLYQSNPY | 254 | 9 | HIV | REV | 22 | A | 6912 | 1703 | 35 |
| 73.0044 | PVDPNLEPY | 255 | 9 | HIV | TAT | 3 | A | 195 | 13193 | 7121 |
| 66.0004 | STVKHHMY | 256 | 8 | HIV | VIF | 23 | A | 8132 | 1760 | 68 |
| 78.0019 | LSKISEYRHY | 257 | 10 | HPV | E6 | 70 | | 14306 | 55190 | 186 |
| 78.0243 | ISEYRHYNY | 258 | 9 | HPV | E6 | 73 | | 25 | 1329 | 32 |
| 78.0359 | RFHNIRGRW | 259 | 9 | HPV | E6 | 131 | | 52917 | 18 | 58 |
| 78.0365 | RFLSKISEY | 260 | 9 | HPV | E6 | 68 | | >40322 | 34623 | 23 |
| 78.0366 | RFHNISGRW | 261 | 9 | HPV | E6 | 124 | | 48564 | 174 | 37 |
| 83.0113 | TLEKLTNTGLY | 262 | 11 | HPV | E6 | 89 | | 23 | 991 | 92 |
| 83.0114 | TLGPGPGTGLY | 263 | 11 | HPV | E6 | 89 | A | 350 | 1320 | 7.4 |
| 83.0115 | TLEGPGPGGLY | 264 | 11 | HPV | E6 | 89 | A | 11 | 2320 | 40 |
| 83.0116 | TLEKGPGPGLY | 265 | 11 | HPV | E6 | 89 | A | 13 | 2036 | 40 |
| 83.0117 | TLEKLGPGPGY | 266 | 11 | HPV | E6 | 89 | A | 269 | 4473 | 1962 |
| 86.0001 | TLEKLTNTGLY | 267 | 11 | HPV | E6 | 89 | | 77 | 5500 | 154 |
| 86.0003 | TLEKITNTELY | 268 | 11 | HPV | E6 | 89 | | 17 | 8402 | 3897 |
| 86.0041 | PYGVCIMCLRF | 269 | 11 | HPV | E6 | 59 | | | 69 | 43722 |
| 86.0052 | ITDIILECVY | 270 | 10 | HPV | E6 | 30 | A | 1.8 | 7660 | 505 |
| 86.0053 | YSDISEYRHY | 271 | 10 | HPV | E6 | 77 | A | 3.8 | 1350 | 514 |
| 86.0054 | LTDIEITCVY | 272 | 10 | HPV | E6 | 25 | A | 12 | 540 | 80 |
| 86.0055 | YSDIRELRHY | 273 | 10 | HPV | E6 | 72 | A | 14 | 1137 | 740 |
| 86.0056 | ELSSALEIPY | 274 | 10 | HPV | E6 | 14 | | 171 | 6031 | 4472 |
| 86.0057 | ETSSALEIPY | 275 | 10 | HPV | E6 | 14 | A | 19 | 12026 | 7144 |
| 86.0058 | ELDSALEIPY | 276 | 10 | HPV | E6 | 14 | A | 38 | 82189 | 38284 |
| 86.0059 | YTKVSEFRWY | 277 | 10 | HPV | E6 | 70 | A | 276 | 3308 | 420 |
| 86.0060 | YSDVSEFRWY | 278 | 10 | HPV | E6 | 70 | A | 3.9 | 1842 | 1026 |

TABLE 10-continued

| Peptide | Sequence | SEQ ID NO | AA | Organism | Protein | Position | Analog | A*0101 | A*2902 | A*3002 |
|---|---|---|---|---|---|---|---|---|---|---|
| 86.0061 | LTDVSIACVY | 279 | 10 | HPV | E6 | 25 | A | 2.9 | 764 | 72 |
| 86.0062 | FTSRIRELRY | 280 | 10 | HPV | E6 | 71 | A | 4.4 | 77 | 50 |
| 86.0063 | YSDIRELRYY | 281 | 10 | HPV | E6 | 72 | A | 9.4 | 733 | 456 |
| 86.0064 | LTDLRLSCVY | 282 | 10 | HPV | E6 | 26 | A | 45 | 1783 | 613 |
| 86.0065 | FTSKVRKYRY | 283 | 10 | HPV | E6 | 72 | A | 64 | 6677 | 52 |
| 86.0066 | YSDVRKYRYY | 284 | 10 | HPV | E6 | 73 | A | 19 | 849 | 794 |
| 86.0114 | FYSKVSEFRF | 285 | 10 | HPV | E6 | 69 | A | | 79 | 18453 |
| 86.0116 | FYSRIRELRF | 286 | 10 | HPV | E6 | 71 | A | | 83 | 12598 |
| 86.0117 | PYAVCRVCLF | 287 | 10 | HPV | E6 | 62 | A | | 407 | 5226 |
| 86.0161 | ITEYRHYNY | 289 | 9 | HPV | E6 | 73 | A | 114 | 625 | 418 |
| 86.0162 | ISDYRHYNY | 289 | 9 | HPV | E6 | 73 | A | 16 | 45 | 455 |
| 86.0165 | ITEYRHYQY | 290 | 9 | HPV | E6 | 73 | A | 90 | 1030 | 526 |
| 86.0166 | ISDYRHYQY | 291 | 9 | HPV | E6 | 73 | A | 13 | 37 | 382 |
| 86.0167 | LTDLLIRCY | 292 | 9 | HPV | E6 | 99 | A | 13 | 6857 | 5515 |
| 86.0168 | KTDQRSEVY | 293 | 9 | HPV | E6 | 35 | A | 84 | 200429 | 1174 |
| 86.0316 | AYRDLCIVY | 294 | 9 | HPV | E6 | 53 | A | | 7117 | 66 |
| 86.0319 | KYYSKISEY | 295 | 9 | HPV | E6 | 75 | A | | 702 | 1.3 |
| 86.0320 | KFYSKISEF | 296 | 9 | HPV | E6 | 75 | A | | 73339 | 306 |
| 86.0322 | RYHNIRGRW | 297 | 9 | HPV | E6 | 131 | A | | 122644 | 15 |
| 86.0323 | REHNIRGRF | 298 | 9 | HPV | E6 | 131 | A | | 346 | 0.69 |
| 86.0325 | AYKDLFVVY | 299 | 9 | HPV | E6 | 48 | A | | 639 | 1.3 |
| 86.0328 | LFVVYRDSF | 300 | 9 | HPV | E6 | 52 | A | | 919 | 18 |
| 86.0329 | RYHNIAGHY | 301 | 9 | HPV | E6 | 126 | A | | 138 | 0.93 |
| 86.0330 | RFHNIAGHF | 302 | 9 | HPV | E6 | 126 | A | | 635 | 1.4 |
| 86.0331 | VYGTTLEKF | 303 | 9 | HPV | E6 | 83 | A | | 75267 | 220 |
| 86.0332 | AYADLTVVY | 304 | 9 | HPV | E6 | 46 | A | | 136 | 9.3 |
| 86.0333 | AFADLTVVF | 305 | 9 | HPV | E6 | 46 | A | | 779 | 137 |
| 86.0334 | RYLSKISEY | 306 | 9 | HPV | E6 | 68 | A | | 4247 | 1.1 |
| 86.0336 | RYHNISGRW | 307 | 9 | HPV | E6 | 124 | A | | 104884 | 13 |
| 86.0337 | AYKDLCIVY | 308 | 9 | HPV | E6 | 48 | A | | 5205 | 29 |
| 86.0341 | RYHSIAGQY | 309 | 9 | HPV | E6 | 126 | A | | 544 | 1.4 |
| 86.0342 | RFHSIAGQF | 310 | 9 | HPV | E6 | 126 | A | | 481 | 1.2 |
| 86.0343 | KYLFTDLRI | 311 | 9 | HPV | E6 | 44 | A | | 78575 | 339 |
| 86.0344 | KFLFTDLRF | 312 | 9 | HPV | E6 | 44 | A | | 44 | 152 |
| 86.0345 | LYTDLRIVY | 313 | 9 | HPV | E6 | 46 | A | | 4.8 | 2.1 |
| 86.0346 | LFTDLRIVF | 314 | 9 | HPV | E6 | 46 | A | | 164 | 2649 |
| 86.0348 | RFLSKISEF | 315 | 9 | HPV | E6 | 68 | A | | 40103 | 201 |
| 86.0349 | EYRHYQYSF | 316 | 9 | HPV | E6 | 75 | A | | 13707 | 430 |
| 86.0350 | RYHNIMGRW | 317 | 9 | HPV | E6 | 124 | A | | 106990 | 7.1 |
| 86.0351 | RFHNIMGRF | 318 | 9 | HPV | E6 | 124 | A | | 174 | 1.3 |
| 86.0354 | NFACTELKF | 319 | 9 | HPV | E6 | 47 | A | | 46 | 6826 |
| 86.0355 | PYAVCRVCF | 320 | 9 | HPV | E6 | 62 | A | | 5602 | 316 |
| 86.0356 | LYYSKVRKY | 321 | 9 | HPV | E6 | 71 | A | | 1452 | 28 |
| 86.0359 | VYADLRIVY | 322 | 9 | HPV | E6 | 46 | A | | 8.2 | 8.3 |
| 86.0360 | VFADLRIVF | 323 | 9 | HPV | E6 | 46 | A | | 87 | 24062 |
| 86.0361 | NYSLYGDTF | 324 | 9 | HPV | E6 | 80 | A | | 20945 | 64 |
| 86.0362 | RFHNISGRF | 325 | 9 | HPV | E6 | 124 | A | | 572 | 2.8 |
| 86.0371 | FTDLTIVY | 326 | 8 | HPV | E6 | 47 | | 16 | 1275 | 39043 |
| 86.0376 | FTDLRIVY | 327 | 8 | HPV | E6 | 47 | | 26 | 813 | 8060 |
| 1202.02 | TLEKLTNTGLY | 328 | 11 | HPV | E6 | 89 | | 174 | | |
| 1511.20 | LTDIEITCVY | 329 | 10 | HPV | E6 | 25 | A | 33 | | |
| 1511.22 | LTDVSIACVY | 330 | 10 | HPV | E6 | 25 | A | 57 | | |
| 1511.23 | ITDIILECVY | 331 | 10 | HPV | E6 | 30 | | 187 | | |
| 1511.25 | KTDQRSEVY | 332 | 9 | HPV | E6 | 35 | | 41 | | |
| 1511.27 | FTDLTIVY | 333 | 8 | HPV | E6 | 47 | | 34 | | |
| 1511.30 | YSDIRELRYY | 334 | 10 | HPV | E6 | 72 | A | 20 | | |
| 1511.33 | YTKVSEFRWY | 335 | 10 | HPV | E6 | 70 | A | 204 | | |
| 1511.35 | FTSRIRELRY | 336 | 10 | HPV | E6 | 71 | A | 25 | | |
| 1511.37 | FTSKVRKYRY | 337 | 10 | HPV | E6 | 72 | A | 37 | | |
| 1511.39 | ISDYRHYNY | 338 | 9 | HPV | E6 | 73 | A | 28 | | |
| 1511.40 | ISEYRHYQY | 339 | 9 | HPV | E6 | 73 | | 40 | | |
| 1511.41 | ISDYRHYQY | 340 | 9 | HPV | E6 | 73 | A | 28 | | |
| 1511.42 | EYRHYCYSLY | 341 | 10 | HPV | E6 | 82 | | 125 | 198 | 3.7 |
| 1511.43 | EYRHYNYSLY | 342 | 10 | HPV | E6 | 75 | | 111027 | 956 | 12 |
| 1511.45 | LTDLLIRCY | 343 | 9 | HPV | E6 | 99 | | 64 | | |
| 1511.55 | ETRHYCYSLY | 344 | 10 | HPV | E6 | 82 | A | 43 | 755 | 10 |
| 1511.56 | EYDHYCYSLY | 345 | 10 | HPV | E6 | 82 | A | 110081 | 799 | 77 |
| 1511.57 | KTRYYDYSVY | 346 | 10 | HPV | E6 | 78 | A | 2957 | 87841 | 0.71 |
| 1511.58 | KYDYYDYSVY | 347 | 10 | HPV | E6 | 78 | A | 186339 | 5749 | 11 |
| 1511.59 | ETRHYNYSLY | 348 | 10 | HPV | E6 | 75 | A | 445 | 5464 | 29 |
| 1511.60 | EYDHYNYSLY | 349 | 10 | HPV | E6 | 75 | A | 11251 | 777 | 93 |
| 86.0004 | PTLKEYVLDLY | 350 | 11 | HPV | E7 | 6 | | 195 | 805 | 408 |
| 86.0067 | HTDTPTLHEY | 351 | 10 | HPV | E7 | 2 | A | 20 | 1509 | 54 |
| 86.0068 | RTETPTLQDY | 352 | 10 | HPV | E7 | 2 | A | 11 | 1987 | 239 |
| 86.0069 | ETDPVDLLCY | 353 | 10 | HPV | E7 | 20 | A | 6.4 | 4110 | 52640 |
| 86.0070 | QTEQATSNYY | 354 | 10 | HPV | E7 | 46 | A | 11 | 9576 | 500 |
| 86.0071 | ATDNYYIVTY | 355 | 10 | HPV | E7 | 50 | A | 7.4 | 1918 | 65 |

TABLE 10-continued

| Peptide | Sequence | SEQ ID NO | AA | Organism | Protein | Position | Analog | A*0101 | A*2902 | A*3002 |
|---|---|---|---|---|---|---|---|---|---|---|
| 86.0169 | LTEYVLDLY | 356 | 9 | HPV | E7 | 8 | A | 6.0 | 941 | 81 |
| 86.0170 | QTEQATSNY | 357 | 9 | HPV | E7 | 46 | A | 14 | 119081 | 3247 |
| 86.0171 | RQAKQHTCY | 358 | 9 | HPV | E7 | 51 | | >135135 | 155246 | 108 |
| 86.0172 | RTAKQHTCY | 359 | 9 | HPV | E7 | 51 | A | 5647 | 130343 | 346 |
| 1511.46 | HTDTPTLHEY | 360 | 10 | HPV | E7 | 2 | A | 30 | | |
| 1511.48 | RTETPTLQDY | 361 | 10 | HPV | E7 | 2 | A | 40 | | |
| 1511.49 | PTLKEYVLDLY | 362 | 11 | HPV | E7 | 6 | | 426 | | |
| 1511.51 | LTEYVLDLY | 363 | 9 | HPV | E7 | 8 | A | 8.0 | | |
| 1511.52 | QAEQATSNY | 364 | 9 | HPV | E7 | 46 | | 132 | | |
| 1511.53 | ATSNYYIVTY | 365 | 10 | HPV | E7 | 50 | | 428 | | |
| 1511.54 | ATDNYYIVTY | 366 | 10 | HPV | E7 | 50 | A | 19 | | |
| 1428.07 | RVLPPNWKY | 367 | 9 | Human | 40s riboprot S13 | 132 | | | | 3.0 |
| 1428.06 | RLAHEVGWKY | 368 | 10 | Human | 60s ribo prot L13A | 139 | | | | 3.8 |
| 1428.04 | AYKKQFSQY | 369 | 9 | Human | 60s ribo prot L5 | 217 | | | | 5.3 |
| 57.0007 | AADNPPAQY | 370 | 9 | Human | CEA | 261 | A | 9.2 | | |
| 83.0119 | RSGPGPGNVLY | 371 | 11 | Human | CEA | 225 | A | 172 | 11270 | 6.3 |
| 83.0120 | RSDGPGPGVLY | 372 | 11 | Human | CEA | 225 | A | 12 | 13162 | 12 |
| 83.0121 | RSDSGPGPGLY | 373 | 11 | Human | CEA | 225 | A | 3.3 | 11856 | 4.2 |
| 83.0122 | RSDSVGPGPGY | 374 | 11 | Human | CEA | 225 | A | 23 | 31193 | 33 |
| 1428.09 | SLFVSNHAY | 375 | 9 | Human | fructose biphosphatealdolase | 355 | | | | 1.1 |
| 1216.01 | RWGLLLALL | 376 | 9 | Human | Her2/neu | 8 | | | 61253 | 300 |
| 83.0124 | YTGPGPGVY | 377 | 9 | Human | Jchain | 102 | A | 2.7 | 2015 | 6.4 |
| 83.0125 | YTAGPGPGY | 378 | 9 | Human | Jchain | 102 | A | 7.0 | 28 | 755 |
| 83.0099 | TQDLVQEKY | 379 | 9 | Human | MAGE1 | 240 | | 57 | 33304 | 3796 |
| 83.0100 | TQGPGPGKY | 380 | 9 | Human | MAGE1 | 240 | A | 4192 | 36746 | 3.2 |
| 83.0101 | TQDGPGPGY | 381 | 9 | Human | MAGE1 | 240 | A | 381 | 37093 | 541 |
| 83.0103 | EVGPGPGLY | 382 | 9 | Human | MAGE3 | 161 | A | 50 | 18183 | 45 |
| 83.0104 | EVDGPGPGY | 383 | 9 | Human | MAGE3 | 161 | A | 29 | 25775 | 5766 |
| 83.0141 | IYGPGPGLIF | 384 | 10 | Human | MAGE3 | 195 | A | | 58 | 6845 |
| 1428.05 | RISGVDRYY | 385 | 9 | Human | NADH ubiqoxidoreductase | 53 | | | | 3.0 |
| 1404.35 | IMVLSFLF | 386 | 8 | Pf | CSP | 427 | | | 111 | 30000 |
| 1489.22 | ALFQEYQCY | 387 | 9 | Pf | CSP | 18 | | >42016 | 149 | 1032 |
| 98.0003 | LSEYYDXDIY | 388 | 10 | Pf | | 347 | | 11 | 1647 | 489 |
| 98.0014 | FQAAESNERY | 389 | 10 | Pf | | 13 | | 8958 | 1780 | 372 |
| 98.0015 | ELEASISGKY | 390 | 10 | Pf | | 81 | | 142 | 21934 | 463 |
| 98.0016 | FVSSIFISFY | 391 | 10 | Pf | | 255 | | 118 | 22 | 84 |
| 98.0047 | KVSDEIWNY | 392 | 9 | Pf | | 182 | | 435 | 230 | 1.9 |
| 98.0059 | IMNHLMTLY | 393 | 9 | Pf | | 38 | | 150 | 1.7 | 1.8 |
| 98.0060 | LIENELMNY | 394 | 9 | Pf | | 149 | | 412 | 3936 | 169 |
| 98.0061 | NVDQQNDMY | 395 | 9 | Pf | | 182 | | 47 | 22173 | 79057 |
| 98.0062 | SSFFMNRFY | 396 | 9 | Pf | | 309 | | 239 | 36 | 7.5 |
| 98.0097 | QAAESNERY | 397 | 9 | Pf | | 14 | | 353 | 24281 | 3011 |
| 98.0098 | LEASISGKY | 398 | 9 | Pf | | 82 | | 57792 | 17824 | 87 |
| 98.0099 | NLALLYGEY | 399 | 9 | Pf | | 188 | | 275 | 138 | 102 |
| 98.0100 | SSPLFNNFY | 400 | 9 | Pf | | 14 | | 117 | 389 | 73 |
| 98.0102 | QNADKNFLY | 401 | 9 | Pf | | 145 | | 3811 | 24 | 663 |
| 98.0103 | VSSIFISFY | 402 | 9 | Pf | | 256 | | 144 | 1800 | 55 |
| 98.0193 | SYKSSKRDKF | 403 | 10 | Pf | | 225 | | | 12594 | 88 |
| 98.0196 | RYQDPQNYEL | 404 | 10 | Pf | | 21 | | | 79717 | 189 |
| 98.0197 | DFFLKSKFNI | 405 | 10 | Pf | | 3 | | | 47714 | 491 |
| 98.0237 | NYMKIMNHL | 406 | 9 | Pf | | 34 | | | 45443 | 110 |
| 98.0238 | TYKKKNNHI | 407 | 9 | Pf | | 264 | | | 21642 | 162 |
| 98.0241 | SFFMNRFYI | 408 | 9 | Pf | | 310 | | | 200 | 1022 |
| 98.0242 | FYITTRYKY | 409 | 9 | Pf | | 316 | | | 9.6 | 7.5 |
| 98.0243 | KYINFINFI | 410 | 9 | Pf | | 328 | | | 25475 | 55 |
| 98.0290 | TWKPTIFLL | 411 | 9 | Pf | | 135 | | | 21155 | 306 |
| 98.0292 | KYNYFIHFF | 412 | 9 | Pf | | 216 | | | 319 | 2.7 |
| 98.0294 | HFFTWGTMF | 413 | 9 | Pf | | 222 | | | 4.0 | 220 |
| 98.0299 | RMTSLKNEL | 414 | 9 | Pf | | 61 | | | 40270 | 14 |
| 98.0300 | YYNNFNNNY | 415 | 9 | Pf | | 77 | | | 19 | 34 |
| F020.02 | GTDEXRNXY | 416 | 9 | Unknown | Naturally processed | | A | 0.67 | | |
| F029.01 | ETDXXXDRSEY | 417 | 11 | Unknown | Naturally processed | | A | 2.0 | | |
| F029.02 | FTDVNSXXRY | 418 | 10 | Unknown | Naturally processed | | A | 0.20 | | |
| F029.05 | VXDPYNXKY | 419 | 9 | Unknown | Naturally processed | | A | 2.3 | | |
| F029.06 | VADKVHXMY | 420 | 9 | Unknown | Naturally processed | | A | 2.4 | | |
| F029.07 | ETXXPDWSY | 421 | 9 | Unknown | Naturally processed | | A | 11 | | |
| F029.08 | XTHNXVDXY | 422 | 9 | Unknown | Naturally processed | | A | 1.4 | | |

TABLE 11

| Peptide | AA | Sequence | SEQ ID NO | Source | A*0301 | A*1101 |
|---|---|---|---|---|---|---|
| 28.0719 | 10 | ILEQWVAGRK | 423 | HDV.nuc.16 | 0.0170 | 0.0012 |
| 28.0727 | 10 | LSAGGKNLSK | 424 | HDV.nuc.115 | 0.0097 | 0.0150 |
| 1259.02 | 11 | STDTVDTVLEK | 425 | Flu.HA.29 | 0.0001 | 0.0670 |
| 1259.04 | 9 | GIAPLQLGK | 426 | Flu.HA.63 | 0.6100 | 0.2000 |
| 1259.06 | 10 | VTAACSHAGK | 427 | Flu.HA.149 | 0.0380 | 0.0490 |
| 1259.08 | 9 | GIHHPSNSK | 428 | Flu.HA.195 | 0.1300 | 0.0140 |
| 1259.10 | 10 | RMNYYWTLLK | 429 | Flu.HA.243 | 2.5000 | 2.3000 |
| 1259.12 | 11 | ITNKVNSVIEK | 430 | Flu.HA.392 | 0.0200 | 0.0670 |
| 1259.13 | 11 | KMNIQFTAVGK | 431 | Flu.HA.402 | 0.0280 | 0.0092 |
| 1259.14 | 9 | NIQFTAVGK | 432 | Flu.HA.404 | 0.0017 | 0.0330 |
| 1259.16 | 11 | AVGKEFNKLEK | 433 | Flu.HA.409 | 0.0210 | 0.0460 |
| 1259.19 | 11 | KVKSQLKNNAK | 434 | Flu.HA.465 | 0.0470 | 0.0031 |
| 1259.20 | 11 | SVRNGTYDYPK | 435 | Flu.HA.495 | 0.0410 | 0.1400 |
| 1259.21 | 9 | SIIPSGPLK | 436 | Flu.VMT1.13 | 0.7800 | 8.8000 |
| 1259.25 | 10 | RMVLASTTAK | 437 | Flu.VMT1.178 | 0.5500 | 0.0350 |
| 1259.26 | 9 | MVLASTTAK | 438 | Flu.VMT1.179 | 1.7000 | 1.4000 |
| 1259.28 | 10 | RMGVQMQRFK | 439 | Flu.VMT1.243 | 0.1000 | 0.0059 |
| 1259.33 | 10 | ATEIRASVGK | 440 | Flu.VNUC.22 | 0.1400 | 0.3000 |
| 1259.37 | 11 | TMVMELVRMIK | 441 | Flu.VNUC.188 | 0.0890 | 0.0310 |
| 1259.43 | 10 | RVLSFIKGTK | 442 | Flu.VNUC.342 | 0.8000 | 0.0830 |
| F119.01 | 9 | MSLQRQFLR | 443 | ORF3P | 0.2000 | 0.7200 |
| F119.02 | 9 | LLGPGRPYR | 444 | TRP.197 | 0.0190 | 0.0091 |
| F119.03 | 9 | LLGPGRPYK | 445 | TRP.197K9 | 2.2000 | 0.6800 |
| 34.0019 | 8 | RVYPELPK | 446 | CEA.139 | 0.0130 | 0.0440 |
| 34.0020 | 8 | TVSAELPK | 447 | CEA.495 | 0.0037 | 0.0320 |
| 34.0021 | 8 | TVYAEPPK | 448 | CEA.317 | 0.0160 | 0.0220 |
| 34.0029 | 8 | TINYTLWR | 449 | MAGE2.74 | 0.0140 | 0.0550 |
| 34.0030 | 8 | LVHFLLLK | 450 | MAGE2.116 | 0.0290 | 0.1500 |
| 34.0031 | 8 | SVFAHPRK | 451 | MAGE2.237 | 0.1410 | 0.0810 |
| 34.0043 | 8 | KVLHHMVK | 452 | MAGE3.285 | 0.0580 | 0.0190 |
| 34.0050 | 8 | RVCACPGR | 453 | p53.273 | 0.3500 | 0.0490 |
| 34.0051 | 8 | KMFCQLAK | 454 | p53.132 | 0.3800 | 0.3600 |
| 34.0062 | 8 | RAHSSHLK | 455 | p53.363 | 0.5500 | 0.0071 |
| 34.0148 | 9 | FVSNLATGR | 456 | CEA.656 | 0.0019 | 0.0490 |
| 34.0152 | 9 | RLQLSNGNK | 457 | CEA.546 | 0.0250 | 0.0110 |
| 34.0153 | 9 | RINGIPQQK | 458 | CEA.628 | 0.0400 | 0.0780 |
| 34.0154 | 9 | KIRKYTMRK | 459 | HER2/neu.681 | 0.0620 | 0.0055 |
| 34.0155 | 9 | LVHFLLLKK | 460 | MAGE2.116 | 0.5220 | 1.4000 |
| 34.0156 | 9 | SMLEVFEGK | 461 | MAGE2.226 | 0.0950 | 1.6000 |
| 34.0157 | 9 | SSFSTTINK | 462 | MAGE2.69 | 0.1600 | 2.0000 |
| 34.0158 | 9 | TSYVKVLHK | 463 | MAGE2.281 | 0.5300 | 0.1500 |
| 34.0159 | 9 | VIFSKASEK | 464 | MAGE2.149 | 0.4900 | 0.0530 |
| 34.0160 | 9 | GSVVGNWQK | 465 | MAGE3.130 | 0.0040 | 0.2060 |
| 34.0161 | 9 | SSLPTTMNK | 466 | MAGE3.69 | 0.6180 | 0.7100 |
| 34.0162 | 9 | SVLEVFEGK | 467 | MAGE3.226 | 0.1330 | 0.9000 |
| 34.0171 | 9 | SSBMGGMNK | 468 | p53.240 | 0.5440 | 1.1000 |
| 34.0172 | 9 | SSCMGGMNK | 469 | p53.240 | 0.0090 | 0.0490 |
| 34.0211 | 10 | RTLTLFNVTK | 470 | CEA.554 | 0.2200 | 1.3000 |
| 34.0212 | 10 | TISPLNTSYK | 471 | CEA.241 | 0.1800 | 0.0330 |
| 34.0214 | 10 | STTINYTLWK | 472 | MAGE2.72 | 0.0870 | 0.6500 |
| 34.0215 | 10 | ASSLPTTMNK | 473 | MAGE3.68 | 0.0420 | 0.0270 |
| 34.0225 | 10 | KTYQGSYGFK | 474 | p53.101 | 0.4900 | 0.4200 |
| 34.0226 | 10 | VVRRBPHHEK | 475 | p53.172 | 0.1800 | 0.2100 |
| 34.0228 | 10 | GLAPPQHLIK | 476 | p53.187 | 0.0570 | 0.0160 |
| 34.0229 | 10 | NSSCMGGMNK | 477 | p53.239 | 0.0071 | 0.0290 |
| 34.0230 | 10 | SSBMGGMNRK | 478 | p53.240 | 0.0420 | 0.1600 |
| 34.0232 | 10 | RVCACPGRDK | 479 | p53.273 | 0.0190 | 0.0250 |
| 34.0295 | 11 | KTITVSAELPK | 480 | CEA.492 | 0.3600 | 0.1600 |
| 34.0296 | 11 | TTITVYAEPPK | 481 | CEA.314 | 0.0200 | 0.0280 |
| 34.0298 | 11 | PTISPSYTYYR | 482 | CEA.418 | (0.0002) | 0.1300 |
| 34.0301 | 11 | GLLGDNQVMPK | 483 | MAGE2.188 | 0.0780 | 0.0047 |
| 34.0306 | 11 | MVELVHFLLLK | 484 | MAGE2.113 | 0.0200 | 0.0120 |
| 34.0308 | 11 | FSTTINYTLWR | 485 | MAGE2.71 | 0.0110 | 0.0170 |
| 34.0311 | 11 | GLLGDNQIMPK | 486 | MAGE3.188 | 0.1300 | 0.0570 |
| 34.0317 | 11 | RLGFLHSGTAK | 487 | p53.110 | 0.0430 | 0.0001 |
| 34.0318 | 11 | ALNKMFCQLAK | 488 | p53.129 | 0.4400 | 0.0420 |
| 34.0323 | 11 | RVCACPGRDRR | 489 | p53.273 | 0.0290 | 0.0290 |
| 34.0324 | 11 | LSQETFSDLWK | 490 | p53.14 | (0.0009) | 0.0470 |
| 34.0328 | 11 | RAHSSHLKSKK | 491 | p53.363 | 0.0270 | 0.0038 |
| 34.0329 | 11 | VTCTYSPALNK | 492 | p53.122 | 0.0700 | 0.1200 |
| 34.0330 | 11 | GTRVRAMAIYK | 493 | p53.154 | 1.1000 | 0.3300 |
| 34.0332 | 11 | STSRHKKLMFK | 494 | p53.376 | 0.3100 | 0.1300 |
| 40.0107 | 9 | LAARNVLVK | 495 | Her2/neu.846 | 0.0580 | 0.0285 |
| 40.0109 | 9 | MALESILRR | 496 | Her2/neu.889 | 0.0034 | 0.0237 |
| 40.0145 | 10 | ISWLGLRSLR | 497 | Her2/neu.450 | 0.0410 | 0.0027 |
| 40.0147 | 10 | GSGAFGTVYK | 498 | Her2/neu.727 | 0.0660 | 0.1300 |
| 40.0153 | 10 | ASPLDSTFYR | 499 | Her2/neu.997 | 0.0003 | 0.0670 |

TABLE 12

| Peptide | Sequence | SEQ ID NO | Source |
|---|---|---|---|
| 40.0013 | SPGLSAGI | 500 | CEA.680I8 |
| 40.0022 | KPYDGIPA | 501 | Her2/neu.921 |
| 40.0023 | KPYDGIPI | 502 | Her2/neu.921I8 |
| 40.005 | APRMPEAA | 503 | p53.63 |
| 40.0051 | APRMPEAI | 504 | p53.63I8 |
| 40.0055 | APAAPTPI | 505 | p53.76I8 |
| 40.0057 | APTPAAPI | 506 | p53.79I8 |
| 40.0059 | TPAAPAPI | 507 | p53.81I8 |
| 40.0061 | APAPAPSI | 508 | p53.84I8 |
| 40.0062 | SPALNKMF | 509 | p53.127 |
| 40.0063 | SPALNKMI | 510 | p53.127I8 |
| 40.0117 | SPSAPPHRI | 511 | CEA.3I9 |
| 40.0119 | PPHRWCIPI | 512 | CEA.7I9 |
| 40.012 | GPAYSGREI | 513 | CEA.92 |
| 40.0156 | MPNQAQMRILI | 514 | Her2/neu.706I10 |
| 40.0157 | MPYGCLLDHVI | 515 | Her2/neu.801I10 |
| 40.0161 | APPHRWCIPW | 516 | CEA.6 |
| 40.0162 | APPHRWCIPI | 517 | CEA.6I10 |
| 40.0163 | IPWQRLLLTA | 518 | CEA.13 |
| 40.0164 | IPWQRLLLTI | 519 | CEA.13I10 |
| 40.0166 | LPQHLFGYSI | 520 | CEA.58I10 |
| 40.0201 | RPRFRELVSEF | 521 | Her2/neu.966 |
| 40.0202 | RPRFRELVSEI | 522 | Her2/neu.966I11 |
| 40.0205 | PPSPREGPLPA | 523 | Her2/neu.1149 |
| 40.0206 | PPSPREGPLPI | 524 | Her2/neu.1149I11 |
| 40.0207 | GPLPAARPAGA | 525 | Her2/neu.1155 |
| 40.0208 | GPLPAARPAGI | 526 | Her2/neu.1155I11 |
| 40.0231 | APAPAAPTPAA | 527 | p53.74 |
| 40.0232 | APAPAAPTPAI | 528 | p53.74I11 |
| 40.0233 | APAAPTPAAPA | 529 | p53.76 |
| 40.0234 | APAAPTPAAPI | 530 | p53.76I11 |
| 45.0003 | IPWQRLLI | 531 | CEA.13.I8 |
| 45.0004 | LPQHLFGI | 532 | CEA.58.I8 |
| 45.0007 | RPGVNLSI | 533 | CEA.428.I8 |
| 45.001 | IPQQHTQI | 534 | CEA.632.I8 |
| 45.0011 | TPNNNGTI | 535 | CEA.646.I8 |
| 45.0016 | CPLHNQEI | 536 | Her2/neu.315.I8 |
| 45.0017 | KPCARVCI | 537 | Her2/neu.336.I8 |
| 45.0019 | WPDSLPDI | 538 | Her2/neu.415.I8 |
| 45.0023 | SPYVSRLI | 539 | Her2/neu.779.I8 |
| 45.0024 | VPIKWMAI | 540 | Her2/neu.884.I8 |
| 45.0026 | RPRFRELI | 541 | Her2/neu.966.I8 |
| 45.0028 | APGAGGMI | 542 | Her2/neu.1036.I8 |
| 45.0031 | SPGKNGVI | 543 | Her2/neu.1174.I8 |
| 45.0037 | SPQGASSI | 544 | MAGE3.64.I8 |
| 45.0038 | YPLWSQSI | 545 | MAGE3.77.I8 |
| 45.0044 | SPLPSQAI | 546 | p53.33.I8 |
| 45.0046 | MPEAAPPI | 547 | p53.66.I8 |
| 45.0047 | APAPSWPI | 548 | p53.86.I8 |
| 45.0051 | KPVEDKDAI | 549 | CEA.155.I9 |
| 45.0054 | IPQQHTQVI | 550 | CEA.632.I9 |
| 45.006 | APPVAPAPI | 551 | p53.70.I9 |
| 45.0062 | APAAPTPAI | 552 | p53.76.I9 |
| 45.0064 | PPGTRVRAI | 553 | p53.152.I9 |
| 45.0065 | APPQHLIRI | 554 | p53.189.I9 |
| 45.0071 | IPQQHTQVLI | 555 | CEA.632.I10 |
| 45.0072 | SPGLSAGATI | 556 | CEA.680.I10 |
| 45.0073 | SPMCKGSRCI | 557 | Her2/neu.196.I10 |
| 45.0074 | MPNPEGRYTI | 558 | Her2/neu.282.I10 |
| 45.0076 | CPLHNQEVTI | 559 | Her2/neu.315.I10 |
| 45.0079 | KPDLSYMPII | 560 | Her2/neu.605.I10 |
| 45.008 | TPSGAMPNQI | 561 | Her2/neu.701.I10 |
| 45.0084 | GPASPLDSTI | 562 | Her2/neu.995.I10 |
| 45.0091 | APPVAPAPAI | 563 | p53.70.I10 |
| 45.0092 | APAPAAPTPI | 564 | p53.74.I10 |
| 45.0093 | APTPAAPAPI | 565 | p53.79.I10 |
| 45.0094 | APSWPLSSSI | 566 | p53.88.I10 |
| 45.0103 | APTISPLNTSI | 567 | CEA.239.I11 |
| 45.0108 | SPSYTYYRPGI | 568 | CEA.421.I11 |
| 45.0117 | CPSGVKPDLSI | 569 | Her2/neu.600.I11 |
| 45.0118 | SPLTSIISAVI | 570 | Her2/neu.649.I11 |
| 45.0119 | IPDGENVKIPI | 571 | Her2/neu.740.I11 |
| 45.0124 | SPLDSTFYRSI | 572 | Her2/neu.998.I11 |
| 45.0128 | LPAARPAGATI | 573 | Her2/neu.1157.I11 |
| 45.0134 | HPRKLLMQDLI | 574 | MAGE2.241.I11 |
| 45.0135 | GPRALIETSYI | 575 | MAGE2.274.I11 |
| 45.0139 | GPRALVETSYI | 576 | MAGE3.274.I11 |
| 45.014 | APRMPEAAPPI | 577 | p53.63.I11 |
| 45.0141 | VPSQKTYQGSI | 578 | p53.97.I11 |
| 1145.1 | FPHCLAFAY | 579 | HBV POL 541 analog |
| 1145.09 | FPVCLAFSY | 580 | HBV POL 541 analog |
| 26.057 | YPALMPLYACI | 581 | HBV.pol.645 |

TABLE 13

| Peptide | Sequence | SEQ ID NO | AA | Organism | Protein | Position | Analog | A*0201 | A*0202 | A*0203 | A*0206 | A*6802 |
|---|---|---|---|---|---|---|---|---|---|---|---|---|
| 33.0067 | FPFKYAAAV | 582 | 9 | Artificial sequence | | | A | | | | | 92 |
| 953.02 | AMAKAAAAV | 583 | 9 | Artificial sequence | | | PolyA | 181 | 196 | 6.7 | 1485 | 177 |
| 953.10 | AMAKAAAAL | 584 | 9 | Artificial sequence | | | PolyA | 413 | 123 | 3.7 | 18500 | 320 |
| 953.18 | AMAKAAAAT | 585 | 9 | Artificial sequence | | | PolyA | 15143 | 12413 | 84 | 37000 | >26666.67 |
| 953.25 | AXAKAAAAL | 586 | 9 | Artificial sequence | | | PolyA | >50000 | 469 | 3300 | 37000 | >11428.57 |
| 1.0684 | FVYGGSKTSL | 587 | 10 | EBNA | | 508 | | 296 | | | | |
| 83.0004 | ILGPGPGL | 588 | 8 | Flu | M1 | 59 | A | 672 | 45 | 530 | 1262 | 56099 |
| F198.10 | GILGFVFTL | 589 | 9 | Flu | M1 | 58 | | 1.0 | 10 | 236 | 2.1 | 1395 |
| 6.0091 | GLIYNRMGAV | 590 | 10 | Flu A | M1 | 129 | | 317 | | | | |
| 27.0267 | VLMEWLKTRPI | 591 | 11 | Flu A | M1 | 41 | | 464 | | | | |
| 70.0088 | FLPSDYFPSV | 592 | 10 | HBV | Core | 18 | A | 8.5 | 3.3 | 3.2 | 2.2 | 276 |
| 83.0030 | FLGPGPGPSV | 593 | 10 | HBV | core | 18 | A | 17 | 0.80 | 2.5 | 55 | 286 |
| 83.0031 | FLPGPGPGSV | 594 | 10 | HBV | core | 18 | A | 98 | 18 | 4.0 | 665 | 332 |
| 83.0032 | FLPSGPGPGV | 595 | 10 | HBV | core | 18 | A | 21 | 1.2 | 3.4 | 64 | 40 |
| 83.0006 | WLGPGPGFV | 596 | 9 | HBV | env | 335 | A | 171 | 4.1 | 2.2 | 530 | 293 |
| 83.0007 | WLSGPGPGV | 597 | 9 | HBV | env | 335 | A | 220 | 2.5 | 12 | 885 | 24 |
| 1369.01 | GVLGWSPQV | 598 | 9 | HBV | env | 62 | A | 22 | 157 | 389 | 28 | 9428 |
| 1369.13 | PVLPIFFCV | 599 | 9 | HBV | env | 377 | A | 8.7 | 3136 | 14286 | 22 | 1814 |
| 1369.14 | VVQAGFFLV | 600 | 9 | HBV | env | 177 | A | 440 | 79 | 2503 | 81 | 617 |
| 70.0094 | FLLAQFTSAI | 601 | 10 | HBV | Pol | 503 | | 65 | 1.9 | 4.8 | 148 | 533 |
| 83.0015 | YLLTLWKAGI | 602 | 10 | HBV | pol | 147 | | 20 | 19 | 20 | 40 | 1388 |
| 83.0016 | YLGPGPGAGI | 603 | 10 | HBV | pol | 147 | A | 161 | 1.0 | 4.2 | 548 | 315 |

TABLE 13-continued

| Peptide | Sequence | SEQ ID NO | AA | Organism | Protein | Position | Analog | A*0201 | A*0202 | A*0203 | A*0206 | A*6802 |
|---|---|---|---|---|---|---|---|---|---|---|---|---|
| 83.0017 | YLLGPGPGGI | 604 | 10 | HBV | pol | 147 | A | 180 | 12 | 3.3 | 89 | 2064 |
| 83.0018 | YLLTGPGPGI | 605 | 10 | HBV | pol | 147 | A | 42 | 15 | 59 | 60 | 5678 |
| 1369.02 | HVYSHPIIV | 606 | 9 | HBV | pol | 1076 | A | 150 | 1923 | 14 | 1199 | 123 |
| 1369.03 | FVLSLGIHV | 607 | 9 | HBV | pol | 562 | A | 45 | 399 | 2817 | 131 | 112 |
| 1369.15 | YVDDVVLGV | 608 | 9 | HBV | pol | 538 | A | 18 | 14 | 70 | 16 | 354 |
| 1369.26 | IVRGTSFVYV | 609 | 10 | HBV | pol | 773 | A | 50000 | 5301 | 69 | 5398 | 1217 |
| 83.0012 | SLGPGPGIAV | 610 | 10 | HBV | env | 814 | A | 1131 | 5.3 | 11 | 917 | 281 |
| 83.0013 | SLLGPGPGAV | 611 | 10 | HBV | env | 814 | A | 95 | 17 | 2.6 | 642 | 795 |
| 83.0014 | SLLNGPGPGV | 612 | 10 | HBV | env | 814 | A | 65 | 3.8 | 14 | 63 | 45 |
| 1505.10 | KITPLCVTL | 613 | 9 | HIV | Env | 134 | A | 461 | 36 | 528 | 59 | 883 |
| 1505.11 | KLTPLCVTM | 614 | 9 | HIV | Env | 134 | A | 340 | 3.6 | 143 | 197 | 6288 |
| 1505.12 | KLTPLCVPL | 615 | 9 | HIV | Env | 134 | A | 15 | 0.25 | 297 | 135 | 67 |
| 1505.13 | KLTPLCVSL | 616 | 9 | HIV | Env | 134 | A | 67 | 2.4 | 240 | 16 | 5947 |
| 1505.14 | KLTPLCITL | 617 | 9 | HIV | Env | 134 | A | 1.7 | 0.27 | 23 | 1.7 | 9155 |
| 1505.15 | QLTPLCVTL | 618 | 9 | HIV | Env | 134 | A | 64 | 1.5 | 57 | 368 | 933 |
| 1505.16 | KLTPRCVTL | 619 | 9 | HIV | Env | 134 | A | 597 | 150 | 20 | 1554 | >63492.06 |
| 1505.17 | ELTPLCVTL | 620 | 9 | HIV | Env | 134 | A | 7190 | 38 | 231 | 1919 | 32 |
| 1505.18 | QMTFLCVQM | 621 | 9 | HIV | Env | 134 | A | 3153 | 40 | 1127 | 232 | 1297 |
| 1505.19 | KMTFLCVQM | 622 | 9 | HIV | Env | 134 | A | 1793 | 22 | 525 | 100 | 8744 |
| 1505.20 | KLTPLCVAL | 623 | 9 | HIV | Env | 134 | A | 209 | 2.3 | 54 | 11 | 13009 |
| 1505.21 | KLTPFCVTL | 624 | 9 | HIV | Env | 134 | A | 87 | 0.37 | 28 | 78 | 11814 |
| 1211.08 | SLYNTVATL | 625 | 9 | HIV | GAG | 77 | | 290 | 6573 | 68 | 37000 | 20000 |
| 1500.24 | VLAEAMSQT | 626 | 9 | HIV | Gag | 386 | A | 290 | 2.2 | 0.65 | 236 | 447 |
| 1500.25 | VLAEAMSQA | 627 | 9 | HIV | Gag | 386 | A | 24 | 1.1 | 0.30 | 9.6 | 271 |
| 1500.26 | VLAEAMSQI | 628 | 9 | HIV | Gag | 386 | A | 71 | 0.15 | 0.87 | 70 | 207 |
| 1500.27 | ILAEAMSQV | 629 | 9 | HIV | Gag | 386 | A | 38 | 1.1 | 1.1 | 101 | 34 |
| 1500.28 | VLAEAMSKV | 630 | 9 | HIV | Gag | 386 | A | 230 | 1.8 | 1.4 | 93 | 329 |
| 1500.29 | VLAEAMSHA | 631 | 9 | HIV | Gag | 386 | A | 149 | 1.7 | 1.2 | 121 | 431 |
| 1500.30 | ILAEAMSQA | 632 | 9 | HIV | Gag | 386 | A | 29 | 1.0 | 1.1 | 8.6 | 253 |
| 1500.31 | VLAEAMSRA | 633 | 9 | HIV | Gag | 386 | A | 127 | 0.88 | 1.0 | 20 | 229 |
| 1500.32 | VLAEAMATA | 634 | 9 | HIV | Gag | 386 | A | 6.7 | 1.4 | 0.73 | 8.6 | 33 |
| 1500.33 | ILAEAMASA | 635 | 9 | HIV | Gag | 386 | A | 22 | 0.72 | 0.82 | 6.8 | 343 |
| 1505.01 | MTHNPPIPV | 636 | 9 | HIV | Gag | 271 | A | 167 | 119 | 1.4 | 158 | 1.4 |
| 1505.02 | MTNNPPVPV | 637 | 9 | HIV | Gag | 271 | A | 86 | 18 | 0.42 | 287 | 309 |
| 1505.03 | MTSNPPIPV | 638 | 9 | HIV | Gag | 271 | A | 53 | 16 | 0.39 | 250 | 3.8 |
| 1505.04 | MTSNPPVPV | 639 | 9 | HIV | Gag | 271 | A | 22 | 29 | 0.80 | 81 | 1.1 |
| 1505.05 | MTSDPPIPV | 640 | 9 | HIV | Gag | 271 | A | 107 | 13 | 0.45 | 587 | 2.5 |
| 1505.06 | MTGNPPIPV | 641 | 9 | HIV | Gag | 271 | A | 125 | 11 | 0.74 | 79 | 7.8 |
| 1505.07 | MTGNPPVPV | 642 | 9 | HIV | Gag | 271 | A | 2021 | 158 | 23 | 35 | 0.84 |
| 1505.08 | MTGNPAIPV | 641 | 9 | HIV | Gag | 271 | A | 1200 | 24 | 10 | 213 | 0.48 |
| 1505.09 | MTGNPSIPV | 644 | 9 | HIV | Gag | 271 | A | 16 | 1.1 | 0.43 | 257 | 0.57 |
| 1505.22 | MTANPPVPV | 645 | 9 | HIV | Gag | 271 | A | 20 | 5.0 | 0.62 | 134 | 4.0 |
| F200.01 | SLYNTVATL | 646 | 9 | hiv | gag | 77 | | 367 | 79 | 19 | 15072 | 247113 |
| 11.0056 | QAHCNISRA | 647 | 9 | HIV | gp160 | 332 | | 338 | | | | |
| 66.0006 | FLKEKGGV | 648 | 8 | HIV | NEF | 117 | A | 13327 | 653 | 267 | >14341.09 | >19464.72 |
| 73.0056 | GLGAVSRDL | 649 | 9 | HIV | NEF | 45 | A | 18679 | 436 | 1733 | >10393.26 | >16666.67 |
| 73.0062 | GLITSSNTA | 650 | 9 | HIV | NEF | 62 | A | 5800 | 102 | 64 | 7865 | >14311.27 |
| 73.0073 | ALEEEEVGFPV | 651 | 11 | HIV | NEF | 83 | A | 2420 | 487 | 15744 | 2988 | >13793.1 |
| 73.0103 | FLKEKGGLEGV | 652 | 11 | HIV | NEF | 117 | A | 322 | 3.5 | 6.8 | 739 | 1252 |
| 73.0105 | FLKEKGGLDGV | 653 | 11 | HIV | NEF | 117 | A | 332 | 3.7 | 11 | 3207 | 3807 |
| 73.0107 | GLIYSKKRQEV | 654 | 11 | HIV | NEF | 173 | A | 8971 | 57 | 152 | >8564.81 | >14260.25 |
| 73.0109 | LLYSKKRQEI | 655 | 10 | HIV | NEF | 174 | A | 80687 | 382 | 152 | >9438.78 | >15686.27 |
| 73.0112 | LLYSKKRQEIL | 656 | 11 | HIV | NEF | 174 | A | >38167.94 | 282 | 1569 | >8564.81 | >14260.25 |
| 73.0117 | RLDILDLWV | 657 | 9 | HIV | NEF | 182 | A | 43 | 615 | 1639 | 2635 | >17777.78 |
| 73.0120 | EILDLWVYHV | 658 | 10 | HIV | NEF | 185 | A | 496 | 569 | 1865 | 2229 | 163 |
| 73.0122 | ILDLWVYHV | 659 | 9 | HIV | NEF | 186 | A | 17 | 30 | 156 | 145 | 7414 |
| 73.0124 | ILDLWVYNV | 660 | 9 | HIV | NEF | 186 | A | 40 | 30 | 201 | 135 | 5814 |
| 73.0126 | WLNYTPGPGT | 661 | 10 | HIV | NEF | 204 | A | 547 | 124 | 231 | >31623.93 | 11808 |
| 73.0127 | WQNYTPGPGV | 662 | 10 | HIV | NEF | 204 | A | 1175 | 114 | 230 | 223 | 11993 |
| 73.0129 | WLNYTPGPGI | 663 | 10 | HIV | NEF | 204 | A | 135 | 4.6 | 46 | >31623.93 | 1196 |
| 73.0132 | YLPGPGIRYPL | 664 | 11 | HIV | NEF | 207 | A | 1026 | 20 | 1583 | 3497 | 782 |
| 73.0133 | YTPGPGIRYPV | 665 | 11 | HIV | NEF | 207 | A | 7764 | 1985 | 11126 | 1112 | 9.2 |
| 73.0138 | LLFGWCFKL | 666 | 9 | HIV | NEF | 221 | A | 18 | 4.1 | 198 | 340 | 1084 |
| 73.0139 | LTFGWCFKV | 667 | 9 | HIV | NEF | 221 | A | 15 | 33 | 1168 | 187 | 9.7 |
| 73.0141 | LLFGWCFKLV | 668 | 10 | HIV | NEF | 221 | A | 658 | 84 | 114 | 1669 | 3276 |
| 1146.03 | FGVRPQVPL | 669 | 9 | HIV | nef | 84 | A | | | | | 321 |
| 1146.04 | FTVRPQVPL | 670 | 9 | HIV | nef | 84 | A | | | | | 13 |
| 1146.05 | FSVRPQVPL | 671 | 9 | HIV | nef | 84 | A | | | | | 52 |
| F198.13 | YLKEPVHGV | 672 | 9 | HIV | pol | 476 | A | 54 | 0.65 | 1.9 | 212 | 63 |
| F198.14 | FLKEPVHGV | 673 | 9 | HIV | pol | 476 | | 44 | 0.28 | 1.9 | 140 | 135 |
| 73.0147 | PVPLQLPPV | 674 | 9 | HIV | REV | 74 | A | 10047 | >7337.88 | 12595 | 81 | >15625 |
| 73.0152 | LQLPPLERV | 675 | 9 | HIV | REV | 77 | A | 7951 | 7705 | 13517 | 203 | 1786 |
| 73.0157 | LLLPPLERLTL | 676 | 11 | HIV | REV | 77 | A | 34 | 2607 | 9010 | 45 | >12779.55 |
| 73.0158 | LQLPPLERLTV | 677 | 11 | HIV | REV | 77 | A | 159 | 4545 | 6270 | 52 | >61068.7 |
| 66.0009 | ILWQVDRM | 678 | 8 | HIV | VIF | 9 | A | 1745 | 67 | 2998 | 11332 | >19464.72 |
| 66.0012 | KLGSLQYL | 679 | 8 | HIV | VIF | 146 | A | 1862 | 14 | 298 | 9010 | >19464.72 |

TABLE 13-continued

| Peptide | Sequence | SEQ ID NO | AA | Organism | Protein | Position | Analog | A*0201 | A*0202 | A*0203 | A*0206 | A*6802 |
|---|---|---|---|---|---|---|---|---|---|---|---|---|
| 66.0013 | KVGSLQYV | 680 | 8 | HIV | VIF | 146 | A | 1650 | 441 | 703 | 1904 | 17480 |
| 1491.73 | TLHDLCQAV | 681 | 9 | HPV | E6 | 11 | A | 331 | 17 | 15 | 10585 | 2809 |
| 83.0008 | TLQDIVLHL | 682 | 9 | HPV | E7 | 7 | | 22 | 4.4 | 46 | 781 | 5088 |
| 83.0009 | TLGPGPGHL | 683 | 9 | HPV | E7 | 7 | A | 14974 | 35 | 66 | 12144 | 27910 |
| 83.0010 | TLQGPGPGL | 684 | 9 | HPV | E7 | 7 | A | 6248 | 62 | 951 | 9121 | 3809 |
| 1491.57 | TLSFVCPWCV | 685 | 10 | HPV | E7 | 94 | A | 786 | 123 | 370 | 4357 | 388 |
| 1481.25 | TLSFVCPWCA | 686 | 10 | HPV18 | E7 | 93 | | 1611 | 221 | 521 | 27321 | 13228 |
| 1481.46 | RTLHDLCQA | 687 | 9 | HPV33 | E6 | 10 | | 8121 | 34 | 678 | 96 | 61604 |
| 1481.47 | TLHDLCQAL | 688 | 9 | HPV33 | E6 | 11 | | 1404 | 2.7 | 40 | 2182 | 70390 |
| 1350.01 | YLSGADLNL | 689 | 9 | Human | CEA | 605 | A | 36 | 4.9 | 9.2 | 1605 | 51227 |
| F198.18 | YLEPGPVTA | 690 | 9 | Human | gp100 | 280 | | 466 | 10 | 27 | 20720 | >470588.24 |
| F198.24 | LLDGTATLRL | 691 | 10 | Human | gp100 | 457 | | 180 | 1.9 | 201 | 841 | >421052.63 |
| 1499.01 | KVYGLSAFV | 692 | 9 | Human | Her2/neu | 369 | A | 33 | 1.8 | 11 | 69 | 110 |
| F198.01 | IISAVVAIL | 693 | 9 | Human | Her2/neu | 654 | A | 1127 | 8.0 | 45 | 1440 | 148 |
| F198.02 | ILSAVVGIL | 694 | 9 | Human | Her2/neu | 654 | A | 1464 | 1.9 | 21 | 2539 | 11854 |
| F198.03 | IISAVVGFL | 695 | 9 | Human | Her2/neu | 654 | A | 747 | 1.0 | 4.8 | 234 | 77 |
| F198.04 | IISAVVGIV | 696 | 9 | Human | Her2/neu | 654 | A | 712 | 15 | 20 | 958 | 390 |
| F198.06 | KISAVVGIL | 697 | 9 | Human | Her2/neu | 369 | A | 6238 | 42 | 60 | 1752 | 4952 |
| F198.07 | KISAVVGIL | 698 | 9 | Human | Her2/neu | 369 | A | 3957 | 38 | 34 | 1539 | 6659 |
| F198.08 | KIFASVAIL | 699 | 9 | Human | Her2/neu | 369 | A | 1062 | 16 | 21 | 1068 | 363 |
| F198.20 | ELVSEFSRV | 700 | 9 | Human | Her2/neu | 971 | A | 8178 | 969 | 53 | 197 | 23 |
| 60.0180 | VLVHPQWVV | 701 | 9 | Human | Kallikrein2 | 53 | A | 464 | 65 | 1988 | 3224 | 14606 |
| 63.0105 | VLVHPQWVLTV | 702 | 11 | Human | Kallikrein2 | 53 | A | 11 | 1.7 | 3.0 | 13 | 3288 |
| 63.0109 | DLMLLRLSEPV | 703 | 11 | Human | Kallikrein2 | 120 | A | 69 | 66 | 32 | 118 | 2078 |
| 63.0128 | PLVCNGVLQGV | 704 | 11 | Human | Kallikrein2 | 216 | A | 91 | 424 | 36 | 212 | 3532 |
| 1419.11 | VLVHPQWVLTV | 705 | 11 | Human | Kallikrein2 | 53 | A | 11 | 1.5 | 16 | 31 | 8889 |
| 1419.17 | PLVCNGVLQGV | 706 | 11 | Human | Kallikrein2 | 216 | A | 26 | 126 | 19 | 264 | 4211 |
| 83.0020 | QLGPGPGLMEV | 707 | 11 | Human | MAGE3 | 159 | A | 194 | 9.4 | 29 | 481 | 648 |
| 83.0021 | QLVGPGPGMEV | 708 | 11 | Human | MAGE3 | 159 | A | 865 | 17 | 19 | 919 | 223 |
| 83.0022 | QLVFGPGPGEV | 709 | 11 | Human | MAGE3 | 159 | A | 2944 | 106 | 50 | 4067 | 447 |
| 83.0023 | QLVFGGPGPGV | 710 | 11 | Human | MAGE3 | 159 | A | 2153 | 96 | 242 | 3207 | 1318 |
| F063.58 | ALGIGILTV | 711 | 9 | Human | MART1 | 27 | A | 11 | | | | |
| F063.59 | AMGIGILTV | 712 | 9 | Human | MART1 | 27 | A | 15 | | | | |
| 83.0001 | LLWQPIPV | 713 | 8 | Human | PAP | 136 | | 137 | 2445 | 9.9 | 4251 | 32939 |
| 83.0002 | LLGPGPGV | 714 | 8 | Human | PAP | 136 | A | 25 | 49 | 123 | 93 | 5620 |
| 83.0024 | VLAKELKFVTL | 715 | 11 | Human | PAP | 30 | | 1298 | 23 | 194 | 5170 | 15664 |
| 83.0025 | VLGPGPGFVTL | 716 | 11 | Human | PAP | 30 | A | 1528 | 13 | 63 | 4766 | 42136 |
| 83.0026 | VLAGPGPGVTL | 717 | 11 | Human | PAP | 30 | A | 1118 | 2.4 | 94 | 7200 | 2645 |
| 83.0027 | VLAKGPGPGTL | 718 | 11 | Human | PAP | 30 | A | 11256 | 26 | 344 | 11450 | >170212.77 |
| 83.0028 | VLAKEGPGPGL | 719 | 11 | Human | PAP | 30 | A | 1890 | 6.9 | 37 | 59024 | 50993 |
| 1389.03 | TLMSAMTNV | 720 | 9 | Human | PAP | 112 | A | 636 | 14 | 35 | 2188 | 484 |
| 1389.06 | ILYSAHDTTV | 721 | 10 | Human | PAP | 384 | A | 397 | 1.1 | 13 | 1480 | 6285 |
| 1389.07 | IVYSAHDTTV | 722 | 10 | Human | PAP | 284 | A | 7643 | 91 | 627 | 356 | 737 |
| 1418.24 | VTAKELKFV | 723 | 9 | Human | PAP | 30 | A | 7143 | 2688 | 40 | 137 | 26667 |
| 1418.26 | ITYSAHDTTV | 724 | 10 | Human | PAP | 284 | A | 4167 | 115 | 238 | 154 | 82 |
| 1419.50 | SLSLGFLFV | 725 | 9 | Human | PAP | | | 77 | 25 | 21 | 93 | 26667 |
| 1419.52 | SLSLGFLFLV | 726 | 10 | Human | PAP | | | 1.9 | 3.9 | 17 | 42 | 348 |
| 1419.58 | LLALFPPEGV | 727 | 10 | Human | PAP | | | 5.0 | 0.73 | 1.6 | 148 | 163 |
| 1419.59 | LVALFPPEGV | 728 | 10 | Human | PAP | | | 156 | 17 | 4.8 | 463 | 28 |
| 1419.61 | ALFPPEGVSV | 729 | 10 | Human | PAP | | | 15 | 1.1 | 18 | 119 | 4444 |
| 1419.62 | GLHGQDLFGV | 730 | 10 | Human | PAP | | | 12 | 2.3 | 3.1 | 18 | >80000 |
| 1419.64 | LLPPYASCHV | 731 | 10 | Human | PAP | | | 88 | 15 | 16 | 97 | 5333 |
| 1419.69 | LLWQPIPVHV | 732 | 10 | Human | PAP | | | 25 | 1.8 | 18 | 285 | 62 |
| 1389.10 | MLLRLSEPV | 733 | 9 | Human | PSA | 118 | A | 47 | 29 | 48 | 689 | 433 |
| 1389.14 | ALGTTCYV | 734 | 8 | Human | PSA | 143 | A | 93 | 6.7 | 12 | 292 | 28284 |
| 99.0001 | VLRLFVCFLI | 735 | 10 | Pf | | 2 | | 2744 | 2112 | 299 | 68226 | 45639 |
| 99.0002 | FLIFHFFLFL | 736 | 10 | Pf | | 9 | | 161 | 174 | 2087 | 288 | 475 |
| 99.0003 | LIFHFFLFLL | 737 | 10 | Pf | | 10 | | 200 | 1468 | 3167 | 1562 | 460 |
| 99.0004 | FLFLLYILFL | 738 | 10 | Pf | | 15 | | 2834 | 172 | 2012 | 2113 | 8248 |
| 99.0005 | RLPVICSFLV | 739 | 10 | Pf | | 32 | | 12 | 2.5 | 33 | 19 | 9176 |
| 99.0006 | VICSFLVFLV | 740 | 10 | Pf | | 35 | | 167 | 415 | 2916 | 197 | 1949 |

TABLE 13-continued

| Peptide | Sequence | SEQ ID NO | AA | Organism | Protein | Position | Analog | A*0201 | A*0202 | A*0203 | A*0206 | A*6802 |
|---|---|---|---|---|---|---|---|---|---|---|---|---|
| 99.0007 | FLVFLVFSNV | 741 | 10 | Pf | | 39 | | 269 | 212 | 35 | 232 | 5393 |
| 99.0012 | MMIMIKFMGV | 742 | 10 | Pf | | 62 | | 123 | 19 | 25 | 109 | 39 |
| 99.0053 | FLLYILFLV | 743 | 9 | Pf | | 17 | | 346 | 279 | 3091 | 1801 | 6981 |
| 99.0054 | VICSFLVFL | 744 | 9 | Pf | | 35 | | 184 | 19 | 2331 | 236 | 4800 |
| 99.0055 | ATYGIIVPV | 745 | 9 | Pf | | 159 | | 3.2 | 2.0 | 2.8 | 5.0 | 21 |
| 99.0067 | KIYKIIIWI | 746 | 9 | Pf | | 9 | | 157 | 1179 | 638 | 101 | 2198 |
| 99.0068 | YMIKKLLKI | 747 | 9 | Pf | | 23 | | 105 | 4.6 | 4.7 | 93 | 63127 |
| 99.0069 | LMTLYQIQV | 748 | 9 | Pf | | 42 | | 14 | 1.6 | 20 | 615 | 1276 |
| 99.0070 | FMGVIYIMI | 749 | 9 | Pf | | 68 | | 13 | 2.1 | 26 | 98 | 14501 |
| 99.0072 | FMNRFYITT | 750 | 9 | Pf | | 312 | | 101 | 18 | 13 | 996 | 6543 |
| 99.0113 | YQDPQNYEL | 751 | 9 | Pf | | 22 | | 79 | 18 | 441 | 52 | 166775 |
| 99.0114 | KTWKPTIFL | 752 | 9 | Pf | | 134 | | 135 | 1242 | 7487 | 76 | 3617 |
| 99.0115 | LLNESNIFL | 753 | 9 | Pf | | 142 | | 43 | 2.5 | 24 | 143 | 4484 |
| 99.0116 | FIHFFTWGT | 754 | 9 | Pf | | 220 | | 80 | 4.7 | 64 | 60 | 383 |
| 99.0117 | VLFLQMMNV | 755 | 9 | Pf | | 180 | | 31 | 1.8 | 2.7 | 9.5 | 323 |
| 99.0118 | NQMIFVSSI | 756 | 9 | Pf | | 251 | | 250 | 21 | 3.6 | 14 | 198 |
| 99.0119 | MIFVSSIFI | 757 | 9 | Pf | | 253 | | 85 | 18 | 83 | 114 | 5.2 |
| 99.0120 | SIFISFYLI | 758 | 9 | Pf | | 258 | | 289 | 35 | 1416 | 43 | 18 |
| 99.0121 | RLFEESLGI | 759 | 9 | Pf | | 293 | | 26 | 1.9 | 5.5 | 68 | 418 |
| F198.11 | ALWGFFPVL | 760 | 9 | Un-known | A2 alloepi-tope | | A | 3.6 | 0.74 | 3.7 | 15 | 1503 |
| F096.13 | SVYDFFVWL | 761 | 9 | | TRP2 | 180 | | 36 | 169 | 226 | 10 | 0.86 |
| F198.12 | FAPGFFPYL | 762 | 9 | | | | | 48 | 0.85 | 44 | 2.3 | 7.6 |
| F198.22 | QLFEDKYAL | 763 | 9 | | | | | 646 | 1.8 | 380 | 2009 | 2982 |
| F198.23 | MLLSVPLLL | 764 | 9 | | | | | 9.0 | 79 | 41 | 8.4 | 24607 |

TABLE 14

| Peptide | Sequence | SEQ ID NO | AA | Organism | Protein | Position | Analog | A*0301 | A*1101 | A*3101 | A*3301 | A*6801 |
|---|---|---|---|---|---|---|---|---|---|---|---|---|
| 4.0060 | ALNAAAAAK | 765 | 9 | Artificial sequence | | | Poly | 74 | 21 | 10954 | >72500 | 80000 |
| 4.0075 | ALAAGAAAK | 766 | 9 | Artificial sequence | | | Poly | 19 | 37 | | | |
| 4.0080 | ALQAAAAAK | 767 | 9 | Artificial sequence | | | Poly | 57 | 65 | 51962 | >72500 | >80000 |
| 83.0057 | STGPGPGVVRR | 768 | 11 | HBV | core | 141 | A | 18695 | 367 | 95 | 5983 | 5.8 |
| 83.0058 | STLGPGPGVRR | 769 | 11 | HBV | core | 141 | A | 892 | 19 | 42 | 670 | 3.8 |
| 83.0059 | STLPGPGPGRR | 770 | 11 | HBV | core | 141 | A | 297 | 19 | 61 | 1893 | 25 |
| 83.0060 | STLPEGPGPGR | 771 | 11 | HBV | core | 141 | A | 325 | 26 | 28 | 822 | 30 |
| 1489.32 | QAGFFLLTR | 772 | 9 | HBV | ENV | 179 | | 10138 | 1678 | 302 | 182 | 5.3 |
| 1489.36 | RVHFASPLH | 773 | 9 | HBV | POL | 818 | | 12 | 60 | 572 | >122881.36 | 7620 |
| 1489.41 | AAYAAQGYK | 774 | 9 | HCV | II | 1247 | | 18 | 18 | 1175 | 14074 | 34 |
| 1489.44 | KSKFGYGAK | 775 | 9 | HCV | II | 2551 | | 36 | 596 | 116 | >122881.36 | >7626.31 |
| 1489.45 | PAAYAAQGYK | 776 | 10 | HCV | II | 1246 | | 950 | 456 | 20314 | >110687.02 | 666 |
| 1489.39 | RMYVGGVEH | 777 | 9 | HCV | IV | 635 | | 3.8 | 274 | 162 | >122881.36 | >28776.98 |
| 1489.43 | SQLSAPSLK | 778 | 9 | HCV | IV | 2209 | | 306 | 25 | 1276 | >122881.36 | 3845 |
| 13.0091 | TSCGNTLTCY | 779 | 10 | HCV | NS5 | 2740 | | >36666.67 | 5.0 | | | |
| 83.0052 | VTGPGPGPVWK | 780 | 11 | HIV | env | 48 | A | 2900 | 24 | 12964 | >102836.88 | 425 |
| 83.0053 | VTVGPGPGVWK | 781 | 11 | HIV | env | 48 | A | 174 | 2.7 | 2731 | 75360 | 21 |
| 83.0054 | VTVYGPGPGWK | 782 | 11 | HIV | env | 48 | A | 1151 | 18 | >8995.5 | >102836.88 | 206 |
| 83.0055 | VTVYYGPGPGK | 783 | 11 | HIV | env | 48 | A | 310 | 24 | 9720 | 101830 | 30 |
| 66.0063 | PVRPQVPLR | 784 | 9 | HIV | NEF | 95 | | >10901.88 | 16112 | 332 | 3439 | 7012 |
| 73.0168 | HGAITSSNTK | 785 | 10 | HIV | NEF | 61 | A | 2837 | 344 | >16143.5 | >22924.9 | 1235 |
| 73.0184 | AVDLSFFLK | 786 | 9 | HIV | NEF | 111 | A | 226 | 23 | 6207 | >27831.09 | 4038 |
| 73.0192 | DVSHFLKEK | 787 | 9 | HIV | NEF | 113 | A | >9298.39 | 5645 | >17839.44 | 232 | 135 |
| 73.0206 | GVLDGLIYSK | 788 | 10 | HIV | NEF | 124 | A | 1080 | 21 | 6007 | >25151.78 | 831 |
| 73.0208 | GVDGLIYSK | 789 | 9 | HIV | NEF | 125 | A | 10089 | 47 | >17664.38 | >29652.35 | 5100 |
| 73.0219 | EILDLWVYK | 790 | 9 | HIV | NEF | 185 | A | 1032 | 64 | >5774.78 | 288 | 93 |
| 73.0222 | ILDLWVYK | 791 | 8 | HIV | NEF | 186 | A | 1265 | 320 | 13680 | 30096 | 12092 |
| 73.0243 | RVPLTFGWCFK | 792 | 11 | HIV | NEF | 216 | A | 69 | 30 | 102 | 26651 | 571 |
| 73.0354 | QVYTPGPGTR | 793 | 10 | HIV | NEF | 205 | A | 1249 | 852 | 1764 | 3334 | 273 |
| 83.0062 | AVGPGPGLK | 794 | 9 | HIV | nef | 84 | A | 18 | 3.6 | 128 | 75754 | 444 |
| 83.0063 | AVDGPGPGK | 795 | 9 | HIV | nef | 84 | A | 179 | 19 | 36837 | >112403.1 | 2132 |
| 83.0044 | QMGPGPGNFK | 796 | 10 | HIV | pol | 1432 | A | 49 | 22 | 2682 | 100771 | 63 |
| 83.0045 | QMAGPGPGFK | 797 | 10 | HIV | pol | 1432 | A | 9.4 | 6.2 | 667 | 4784 | 30 |
| 83.0046 | QMAVGPGPGK | 798 | 10 | HIV | pol | 1432 | A | 33 | 16 | 5961 | 86676 | 22 |
| 83.0048 | TVGPGPGPEK | 799 | 10 | HIV | pol | 935 | A | 115 | 17 | 10140 | 98177 | 23 |
| 83.0049 | TVQGPGPGEK | 800 | 10 | HIV | pol | 935 | A | 218 | 3.4 | 9874 | 103379 | 195 |
| 83.0050 | TVQPGPGPGK | 801 | 10 | HIV | pol | 935 | A | 41 | 2.5 | 1335 | 68584 | 28 |

TABLE 14-continued

| Peptide | Sequence | SEQ ID NO | AA | Organism | Protein | Position | Ana-log | A*0301 | A*1101 | A*3101 | A*3301 | A*6801 |
|---|---|---|---|---|---|---|---|---|---|---|---|---|
| 1500.01 | VAHUGGQLK | 802 | 10 | HIV | Pol | 98 | A | 2593 | 151 | 46875 | 51222 | 123 |
| 1500.02 | VTVIUGGQLK | 803 | 10 | HIV | Pol | 98 | A | 296 | 61 | 24385 | 104757 | 147 |
| 1500.03 | VTIKVGGQLK | 804 | 10 | HIV | Pol | 98 | A | 188 | 59 | 6061 | 47647 | 127 |
| 1500.04 | VTIRIGGQLK | 805 | 10 | HIV | Pol | 98 | A | 51 | 14 | 4458 | 65764 | 25 |
| 1500.05 | VTVRIGGQLK | 806 | 10 | HIV | Pol | 98 | A | 226 | 15 | 5380 | 40344 | 49 |
| 1500.06 | VTVKVGGQLK | 807 | 10 | HIV | Pol | 98 | A | 206 | 54 | 21484 | 46182 | 104 |
| 1500.07 | VTIRVGGQLK | 808 | 10 | HIV | Pol | 98 | A | 43 | 13 | 3591 | 86086 | 28 |
| 1500.08 | VTVRVGGQLK | 809 | 10 | HIV | Pol | 98 | A | 216 | 19 | 8238 | >72319.2 | 141 |
| 1500.09 | VTVKIGGQLR | 810 | 10 | HIV | Pol | 98 | A | 19185 | 194 | 417 | 3833 | 52 |
| 1500.12 | VTIRIGGQLR | 811 | 10 | HIV | Pol | 98 | A | 3192 | 23 | 61 | 1352 | 16 |
| 1500.13 | VITICLGGQ1R | 812 | 10 | HIV | Pol | 98 | A | 43252 | 219 | 590 | 12965 | 104 |
| 1500.14 | VSIKVGGQIK | 813 | 10 | HIV | Pol | 98 | A | 1921 | 86 | 57069 | >72319.2 | 2026 |
| 1500.15 | VSIRVGGQIK | 814 | 10 | HIV | Pol | 98 | A | 642 | 91 | 50677 | >61702.13 | 1960 |
| 1500.17 | VTVKIEGQLK | 815 | 10 | HIV | Pol | 98 | A | 647 | 23 | 4616 | 64604 | 30 |
| 1500.18 | VTIKIEGQLK | 816 | 10 | HIV | Pol | 98 | A | 361 | 69 | 5077 | 58024 | 27 |
| 1500.19 | VTVICIEGQLR | 817 | 10 | HIV | Pol | 98 | A | 35612 | 143 | 394 | 4057 | 146 |
| 1500.20 | VSIRVGGQTK | 818 | 10 | HIV | Pol | 98 | A | 341 | 21 | 29949 | 38958 | 290 |
| 1500.21 | VSIRVGGQTR | 819 | 10 | HIV | Pol | 98 | A | 18531 | 241 | 466 | 8595 | 288 |
| 1500.22 | VTVRIGGMQK | 820 | 10 | HIV | Pol | 98 | A | 54 | 13 | 2583 | 44425 | 155 |
| 1500.23 | ITVICIGKEVR | 821 | 10 | HIV | Pol | 98 | A | >69182.39 | 12904 | 5057 | 24985 | 154 |
| 73.0263 | GTRQARRNK | 822 | 9 | HIV | REV | 36 | A | 67 | 749 | 9713 | 45966 | 59708 |
| 73.0265 | GTRQARRNRK | 823 | 10 | HIV | REV | 36 | A | 100 | 634 | 3800 | >42335.77 | 7788 |
| 73.0267 | GTRQARRNRRIC | 824 | 11 | HIV | REV | 36 | A | 404 | 2596 | 7774 | >24308.47 | 9104 |
| 73.0269 | GTRQTRKNK | 825 | 9 | HIV | REV | 37 | A | 198 | 3104 | 13373 | >29713.11 | 18657 |
| 73.0271 | GTRQTRKNRK | 826 | 10 | HIV | REV | 37 | A | 129 | 1082 | 2485 | 60183 | 5998 |
| 73.0273 | GIRQTRICNIIRK | 827 | 11 | HIV | REV | 37 | A | 478 | 4184 | 4008 | >24308.47 | >17167.38 |
| 73.0363 | RVRRRRWRAR | 828 | 10 | HIV | REV | 43 | A | 2443 | >16759.78 | 265 | 3758 | >36866.36 |
| 73.0369 | KVRRRRWRAR | 829 | 10 | HIV | REV | 43 | A | 327 | >20905.92 | 342 | 3243 | 15501 |
| 66.0028 | LTISYGRK | 830 | 8 | HIV | TAT | 46 | A | 988 | 708 | 27068 | 38162 | 482 |
| 66.0055 | KTLGISYGR | 831 | 9 | HIV | TAT | 44 | A | 53 | 9.8 | 21 | 502 | 36 |
| 66.0060 | LTISYGRICK | 832 | 9 | HIV | TAT | 46 | A | 584 | 69 | 13918 | 59654 | 63 |
| 66.0061 | GTSYGRICKR | 833 | 9 | HIV | TAT | 47 | A | 9965 | 5916 | 225 | 21588 | 5778 |
| 66.0062 | GTGISYGRK | 834 | 9 | HIV | TAT | 45 | A | 480 | 77 | 58102 | >43740.57 | 7407 |
| 66.0073 | KTLGISYGRK | 835 | 10 | HIV | TAT | 44 | A | 36 | 79 | 841 | 42378 | 1629 |
| 66.0075 | LTISYGRICKR | 836 | 10 | HIV | TAT | 46 | A | 7161 | 1229 | 71 | 2515 | 33 |
| 66.0090 | KTLGISYGRKK | 837 | 11 | HIV | TAT | 44 | A | 52 | 285 | 91 | 23401 | 647 |
| 73.0306 | TVCNNCYCK | 838 | 9 | HIV | TAT | 23 | A | 9920 | 267 | 8793 | 28481 | 876 |
| 73.0310 | LVISYGRKKRR | 839 | 11 | HIV | TAT | 46 | A | >11702.13 | 8669 | 562 | 267 | 4662 |
| 73.0314 | ISYGRKKRRQK | 840 | 11 | HIV | TAT | 48 | A | 48 | 2807 | 3147 | >20000 | 4428 |
| 73.0331 | ETGPSGQPCK | 841 | 10 | HIV | TAT | 101 | A | >14569.54 | 3501 | >22500 | >17813.27 | 50 |
| 73.0333 | KVGPGGYPRR | 842 | 10 | HIV | TAT | 101 | A | 2268 | 487 | 250 | 7904 | 721 |
| 73.0334 | KAGPGGYPRK | 843 | 10 | HIV | TAT | 101 | A | 62 | 43 | 10734 | >17813.27 | 5555 |
| 73.0336 | KVGPGGYPRRK | 844 | 11 | HIV | TAT | 101 | A | 70 | 87 | 775 | >5063.73 | 921 |
| 73.0338 | AVPGGYPRR | 845 | 9 | HIV | TAT | 102 | A | 3012 | 1215 | 1349 | 3453 | 109 |
| 73.0344 | AVPGGYPRRK | 846 | 10 | HIV | TAT | 102 | A | 819 | 60 | 39974 | >5570.5 | 846 |
| 66.0057 | KVGSLQYLK | 847 | 9 | HIV | VIF | 146 | A | 482 | 70 | 2104 | >43740.57 | 4200 |
| 66.0033 | ETVRHFPR | 848 | 8 | HIV | VPR | 29 | A | >13513.51 | 4183 | 1000 | 81 | 86 |
| 78.0048 | AACHKCIDFY | 849 | 10 | HPV | E6 | 63 | | 18824 | 261 | 20643 | >116465.86 | 32548 |
| 78.0051 | LLIRCLRCQK | 850 | 10 | HPV | E6 | 101 | | 437 | 170 | 6612 | 28936 | 78 |
| 78.0059 | KISEYRHYNY | 851 | 10 | HPV | E6 | 72 | | 42 | 112 | 1426 | 35341 | 25077 |
| 78.0068 | AVCRVCLLFY | 852 | 10 | HPV | E6 | 64 | | 77 | 21 | 1978 | 4520 | 1302 |
| 78.0103 | FAFTDLTIVY | 853 | 10 | HPV | E6 | 45 | | 40343 | 21161 | 42065 | 131202 | 346 |
| 78.0115 | FAFADLTVVY | 854 | 10 | HPV | E6 | 45 | | 18592 | 5866 | 23676 | 26768 | 402 |
| 78.0116 | RFLSKISEYR | 855 | 10 | HPV | E6 | 68 | | 1640 | 18468 | 33 | 436 | 172 |
| 78.0117 | ILIRCIICQR | 856 | 10 | HPV | E6 | 99 | | 8550 | 5012 | 377 | 2480 | 537 |
| 86.0005 | RTAMFQDPQER | 857 | 11 | HPV | E6 | 5 | | 1478 | 103 | 49 | 3459 | 19 |
| 86.0006 | AMFQDPQERPR | 858 | 11 | HPV | E6 | 7 | | 1718 | 886 | 45 | 1787 | 1478 |
| 86.0007 | MFQDPQERPRK | 859 | 11 | HPV | E6 | 8 | | 15493 | 8571 | 604 | 419 | 16729 |
| 86.0009 | DLLIRCINCQK | 860 | 11 | HPV | E6 | 105 | | 2923 | 935 | 4884 | 29 | 263 |
| 86.0011 | RFEDPTRRPYK | 861 | 11 | HPV | E6 | 3 | | 169 | 432 | 53 | 1758 | 7338 |
| 86.0012 | ELTEVFEFAFK | 862 | 11 | HPV | E6 | 40 | | 8966 | 582 | 25205 | 1733 | 15 |
| 86.0013 | GLYNLLIRCLR | 863 | 11 | HPV | E6 | 97 | | 1268 | 1568 | 250 | 401 | 1624 |
| 86.0014 | NLLIRCLRCQK | 864 | 11 | HPV | E6 | 100 | | 1565 | 854 | 3140 | 397 | 1480 |
| 86.0015 | EVLEESVHEIR | 865 | 11 | HPV | E6 | 17 | | >45643.15 | >20202.02 | 31037 | 212 | 240 |
| 86.0017 | EVYKFLFTDLR | 866 | 11 | HPV | E6 | 41 | | 31240 | 602 | 759 | 4.3 | 11 |
| 86.0018 | FLFTDLRIVYR | 867 | 11 | HPV | E6 | 45 | | 672 | 227 | 58 | 21 | 1.4 |
| 86.0020 | EVLEIPLIDLR | 868 | 11 | HPV | E6 | 20 | | >47008.55 | 16638 | 36427 | 72 | 27 |
| 86.0021 | DLRLSCVYCKK | 869 | 11 | HPV | E6 | 28 | | 3644 | 1907 | 17023 | 109 | 3002 |
| 86.0022 | EVYNFACTELK | 870 | 11 | HPV | E6 | 44 | | 1622 | 117 | 484 | 5.9 | 2.7 |
| 86.0023 | RVCLLFYSKVR | 871 | 11 | HPV | E6 | 67 | | 771 | 190 | 221 | 1061 | 1267 |
| 86.0024 | LLFYSKVRKYR | 872 | 11 | HPV | E6 | 70 | | 28 | 94 | 7.0 | 11 | 15 |
| 86.0025 | QLCDLLIRCYR | 873 | 11 | HPV | E6 | 98 | | 1240 | 700 | 450 | 106 | 489 |
| 86.0387 | TLEQTVKK | 874 | 8 | HPV | E6 | 87 | | 4766 | 203 | >100000 | >75324.68 | 21400 |
| 88.0001 | ATRDLCIVYR | 875 | 10 | HPV | E6 | 53 | A | 237 | 156 | 4.7 | 44 | 28 |
| 88.0002 | AFRDLCIVYK | 876 | 10 | HPV | E6 | 53 | A | 31 | 15 | 10 | 132 | 57 |
| 88.0003 | ATCDKCLKFY | 877 | 10 | HPV | E6 | 68 | A | 194 | 17 | 491 | 18080 | 4562 |

TABLE 14-continued

| Peptide | Sequence | SEQ ID NO | AA | Organism | Protein | Position | Analog | A*0301 | A*1101 | A*3101 | A*3301 | A*6801 |
|---|---|---|---|---|---|---|---|---|---|---|---|---|
| 88.0004 | AVCDKCLKFR | 878 | 10 | HPV | E6 | 68 | A | 77 | 15 | 11 | 45 | 34 |
| 88.0005 | KLYSKISEYR | 879 | 10 | HPV | E6 | 75 | A | 5.4 | 168 | 6.4 | 28 | 91 |
| 88.0006 | KFYSKISEYK | 880 | 10 | HPV | E6 | 75 | A | 7.6 | 674 | 27 | 329 | 208 |
| 88.0007 | KFSEYRHYCY | 881 | 10 | HPV | E6 | 79 | A | 5092 | 7485 | 308 | 49397 | 14571 |
| 88.0008 | KISEYRHYCR | 882 | 10 | HPV | E6 | 79 | A | 486 | 688 | 25 | 833 | 1488 |
| 88.0009 | LFIRCINCQK | 883 | 10 | HPV | E6 | 106 | A | 2880 | 702 | 52 | 42 | 56 |
| 88.0010 | LLIRCINCQR | 884 | 10 | HPV | E6 | 106 | A | 2818 | 686 | 30 | 50 | 14 |
| 88.0011 | KVRFHNIRGR | 885 | 10 | HPV | E6 | 129 | A | 39 | 8632 | 27 | 4500 | 3979 |
| 88.0012 | KQRFHNIRGK | 886 | 10 | HPV | E6 | 129 | A | 55 | 1953 | 573 | 35208 | 22879 |
| 88.0013 | WFGRCMSCCR | 887 | 10 | HPV | E6 | 139 | A | 16071 | 10690 | 288 | 98 | 303 |
| 88.0014 | WTGRCMSCCK | 888 | 10 | HPV | E6 | 139 | A | 6687 | 841 | 6496 | 15191 | 118 |
| 88.0015 | MTCCRSSRTR | 889 | 10 | HPV | E6 | 144 | A | 3825 | 933 | 410 | 601 | 2.2 |
| 88.0016 | MSCCRSSRTK | 890 | 10 | HPV | E6 | 144 | A | 352 | 169 | 2333 | 6916 | 12 |
| 88.0017 | STCRSSRTRR | 891 | 10 | HPV | E6 | 145 | A | 2989 | 118 | 152 | 1020 | 312 |
| 88.0018 | SCCRSSRTRK | 892 | 10 | HPV | E6 | 145 | A | 326 | 3272 | 5592 | 20916 | 8777 |
| 88.0020 | DIEITCVYCR | 893 | 10 | HPV | E6 | 27 | A | 2014 | 826 | 3780 | 448 | 422 |
| 88.0021 | FTFKDLFVVY | 894 | 10 | HPV | E6 | 47 | A | 14364 | 1208 | 10757 | 2725 | 62 |
| 88.0022 | FAFKDLFVVK | 895 | 10 | HPV | E6 | 47 | A | 783 | 71 | 525 | 1066 | 3.6 |
| 88.0023 | AVKDLFVVYR | 896 | 10 | HPV | E6 | 48 | A | 1728 | 91 | 3.1 | 9.1 | 3.3 |
| 88.0024 | AFKDLFVVYK | 897 | 10 | HPV | E6 | 48 | A | 3256 | 211 | 32 | 93 | 576 |
| 88.0026 | FVVYRDSIPK | 898 | 10 | HPV | E6 | 53 | A | 265 | 81 | 6216 | 146 | 30 |
| 88.0027 | DTIPHAACHK | 899 | 10 | HPV | E6 | 58 | A | 2366 | 701 | 1763 | 9.3 | 23 |
| 88.0028 | DSIPHAACHR | 900 | 10 | HPV | E6 | 58 | A | 2772 | 853 | 357 | 2.2 | 27 |
| 88.0029 | KFIDFYSRIR | 901 | 10 | HPV | E6 | 67 | A | 8891 | 9008 | 3.3 | 677 | 2551 |
| 88.0031 | DTVYGDTLEK | 902 | 10 | HPV | E6 | 83 | A | 50 | 15 | 28754 | 55090 | 31 |
| 88.0032 | DSVYGDTLER | 903 | 10 | HPV | E6 | 83 | A | 292 | 23 | 485 | 891 | 28 |
| 88.0033 | LFIRCLRCQK | 904 | 10 | HPV | E6 | 101 | A | 3390 | 1533 | 218 | 77 | 200 |
| 88.0034 | LLIRCLRCQR | 905 | 10 | HPV | E6 | 101 | A | 3360 | 1396 | 28 | 75 | 13 |
| 88.0035 | RVHNIAGHYR | 906 | 10 | HPV | E6 | 126 | A | 30 | 21 | 22 | 114 | 18 |
| 88.0036 | RFHNIAGHYK | 907 | 10 | HPV | E6 | 126 | A | 25 | 22 | 2.6 | 80 | 23 |
| 88.0037 | RTQCHSCCNR | 908 | 10 | HPV | E6 | 135 | A | 338 | 20 | 22 | 132 | 161 |
| 88.0038 | RGQCHSCCNK | 909 | 10 | HPV | E6 | 135 | A | 6135 | 113 | 425 | 37669 | 20340 |
| 88.0039 | ATTDLTIVYR | 910 | 10 | HPV | E6 | 46 | A | 247 | 10 | 34 | 1739 | 14 |
| 88.0040 | AFTDLTIVYK | 911 | 10 | HPV | E6 | 46 | A | 701 | 112 | 3952 | 9380 | 215 |
| 88.0041 | RLYSKVSEFR | 912 | 10 | HPV | E6 | 68 | A | 6.4 | 131 | 24 | 690 | 73 |
| 88.0042 | RFYSKVSEFK | 913 | 10 | HPV | E6 | 68 | A | 27 | 521 | 30 | 4452 | 547 |
| 88.0043 | KFSEFRWYRY | 914 | 10 | HPV | E6 | 72 | A | 4750 | 1595 | 34 | 856 | 12811 |
| 88.0044 | KVSEFRWYRR | 915 | 10 | HPV | E6 | 72 | A | 266 | 16 | 2.8 | 159 | 30 |
| 88.0045 | YFVYGTTLEK | 916 | 10 | HPV | E6 | 81 | A | 204 | 62 | 2167 | 15740 | 53 |
| 88.0046 | YSVYGTTLER | 917 | 10 | HPV | E6 | 81 | A | 430 | 96 | 2136 | 6903 | 19 |
| 88.0048 | GTTLEKLTNR | 918 | 10 | HPV | E6 | 85 | A | 3604 | 1720 | 382 | 706 | 2946 |
| 88.0049 | LVIRCITCQR | 919 | 10 | HPV | E6 | 99 | A | 2222 | 255 | 54 | 135 | 14 |
| 88.0050 | LLIRCITCQK | 920 | 10 | HPV | E6 | 99 | A | 291 | 120 | 3009 | 2165 | 40 |
| 88.0051 | WVGRCIACWR | 921 | 10 | HPV | E6 | 132 | A | 6227 | 1391 | 85 | 13 | 9.7 |
| 88.0052 | WTGRCIACWK | 922 | 10 | HPV | E6 | 132 | A | 2633 | 55 | 3078 | 169 | 24 |
| 88.0053 | RTIACWRRPR | 923 | 10 | HPV | E6 | 135 | A | 40 | 63 | 3.2 | 95 | 51 |
| 88.0054 | RCIACWRRPK | 924 | 10 | HPV | E6 | 135 | A | 1535 | 1476 | 292 | 176 | 1655 |
| 88.0055 | AVADLTVVYR | 925 | 10 | HPV | E6 | 46 | A | 489 | 11 | 31 | 892 | 7.3 |
| 88.0056 | AFADLTVVYK | 926 | 10 | HPV | E6 | 46 | A | 2365 | 107 | 1113 | 13557 | 50 |
| 88.0057 | RVLSKISEYR | 927 | 10 | HPV | E6 | 68 | A | 34 | 84 | 24 | 197 | 136 |
| 88.0058 | RFLSKISEYK | 928 | 10 | HPV | E6 | 68 | A | 31 | 287 | 42 | 10237 | 112 |
| 88.0059 | KFSEYRHYNY | 929 | 10 | HPV | E6 | 72 | A | 5819 | 5521 | 286 | 18351 | 1798 |
| 88.0060 | KISEYRHYNR | 930 | 10 | HPV | E6 | 72 | A | 58 | 140 | 17 | 161 | 1579 |
| 88.0061 | ITIRCIICQR | 931 | 10 | HPV | E6 | 99 | A | 488 | 93 | 50 | 123 | 12 |
| 88.0062 | ILIRCIICQK | 932 | 10 | HPV | E6 | 99 | A | 192 | 78 | 1383 | 1423 | 165 |
| 88.0063 | WVGRCAACWR | 933 | 10 | HPV | E6 | 132 | A | 2757 | 3973 | 360 | 24 | 19 |
| 88.0064 | WAGRCAACWK | 934 | 10 | HPV | E6 | 132 | A | 4662 | 583 | 23311 | 1491 | 50 |
| 88.0065 | CFACWRSRRR | 935 | 10 | HPV | E6 | 136 | A | 23542 | 7164 | 578 | 165 | 10206 |
| 88.0067 | DTSIACVYCK | 936 | 10 | HPV | E6 | 27 | A | 2936 | 89 | 5385 | 1968 | 216 |
| 88.0068 | DVSIACVYCR | 937 | 10 | HPV | E6 | 27 | A | 2814 | 217 | 406 | 487 | 658 |
| 88.0070 | CVYCKATLEK | 938 | 10 | HPV | E6 | 32 | A | 418 | 653 | 5307 | 17928 | 862 |
| 88.0071 | RFEVYQFAFK | 939 | 10 | HPV | E6 | 41 | A | 38 | 611 | 179 | 2867 | 2443 |
| 88.0072 | RTEVYQFAFR | 940 | 10 | HPV | E6 | 41 | A | 217 | 78 | 12 | 142 | 147 |
| 88.0073 | AVKDLCIVYR | 941 | 10 | HPV | E6 | 48 | A | 841 | 66 | 7.3 | 8.0 | 6.5 |
| 88.0074 | AFKDLCIVYK | 942 | 10 | HPV | E6 | 48 | A | 856 | 47 | 39 | 263 | 378 |
| 88.0075 | ATCHKCIDFY | 943 | 10 | HPV | E6 | 63 | A | 133 | 7.4 | 1164 | 12691 | 1386 |
| 88.0076 | AACHKCIDFK | 944 | 10 | HPV | E6 | 63 | A | 118 | 20 | 437 | 53733 | 414 |
| 88.0077 | NLVYGETLEK | 945 | 10 | HPV | E6 | 83 | A | 846 | 143 | 761 | 121 | 87 |
| 88.0078 | NSVYGETLER | 946 | 10 | HPV | E6 | 83 | A | 150 | 25 | 163 | 1333 | 18 |
| 88.0079 | LSIRCLRCQK | 947 | 10 | HPV | E6 | 101 | A | 245 | 14 | 100 | 1135 | 17 |
| 88.0080 | LLIRCLRCQY | 948 | 10 | HPV | E6 | 101 | A | 727 | 452 | 2894 | 2430 | 254 |
| 88.0081 | RVHSIAGQYR | 949 | 10 | HPV | E6 | 126 | A | 31 | 34 | 7.6 | 812 | 28 |
| 88.0082 | RFHSIAGQYK | 950 | 10 | HPV | E6 | 126 | A | 17 | 43 | 1.3 | 629 | 83 |
| 88.0083 | LVTDLRIVYR | 951 | 10 | HPV | E6 | 46 | A | 3869 | 648 | 20 | 150 | 6.8 |
| 88.0084 | LFTDLRIVYK | 952 | 10 | HPV | E6 | 46 | A | 628 | 263 | 258 | 149 | 277 |
| 88.0085 | CTMCLRFLSK | 953 | 10 | HPV | E6 | 63 | A | 1002 | 226 | 6274 | 3945 | 429 |

TABLE 14-continued

| Peptide | Sequence | SEQ ID NO | AA | Organism | Protein | Position | Analog | A*0301 | A*1101 | A*3101 | A*3301 | A*6801 |
|---|---|---|---|---|---|---|---|---|---|---|---|---|
| 88.0086 | CIMCLRFLSR | 954 | 10 | HPV | E6 | 63 | A | 41 | 101 | 167 | 83 | 155 |
| 88.0087 | RLLSKISEYR | 955 | 10 | HPV | E6 | 68 | A | 5.2 | 662 | 7.7 | 108 | 21 |
| 88.0088 | RFLSKISEYY | 956 | 10 | HPV | E6 | 68 | A | 1702 | 25535 | 14 | 41096 | 3999 |
| 88.0089 | SFYGKTLEER | 957 | 10 | HPV | E6 | 82 | A | 642 | 205 | 17 | 66 | 42 |
| 88.0090 | SLYGKTLEEK | 958 | 10 | HPV | E6 | 82 | A | 7.9 | 6.8 | 1044 | 6516 | 29 |
| 88.0091 | WFGRCSECWR | 959 | 10 | HPV | E6 | 132 | A | 1788 | 1569 | 20 | 5.5 | 26 |
| 88.0092 | WTGRCSECWK | 960 | 10 | HPV | E6 | 132 | A | 2492 | 26 | 3323 | 720 | 22 |
| 88.0093 | AFCRVCLLFY | 961 | 10 | HPV | E6 | 64 | A | 509 | 272 | 1777 | 1202 | 173 |
| 88.0094 | AVCRVCLLFR | 962 | 10 | HPV | E6 | 64 | A | 20 | 1.8 | 2.1 | 64 | 21 |
| 88.0095 | CFLFYSKVRK | 963 | 10 | HPV | E6 | 69 | A | 125 | 96 | 81 | 315 | 172 |
| 88.0096 | CLLFYSKVRR | 964 | 10 | HPV | E6 | 69 | A | 417 | 204 | 159 | 386 | 242 |
| 88.0097 | LVYSKVRKYR | 965 | 10 | HPV | E6 | 71 | A | 320 | 619 | 17 | 49 | 31 |
| 88.0098 | LFYSKVRKYK | 966 | 10 | HPV | E6 | 71 | A | 680 | 2582 | 18 | 30 | 1976 |
| 88.0099 | GTTLESITKK | 967 | 10 | HPV | E6 | 88 | A | 622 | 108 | 85182 | 132509 | 10147 |
| 88.0103 | WVGSCLGCWR | 968 | 10 | HPV | E6 | 135 | A | 48682 | 5520 | 20 | 15 | 9.3 |
| 88.0104 | WTGSCLGCWK | 969 | 10 | HPV | E6 | 135 | A | 7705 | 6.9 | 18344 | 2980 | 3.7 |
| 88.0105 | VVADLRIVYR | 970 | 10 | HPV | E6 | 46 | A | 513 | 18 | 41 | 101 | 16 |
| 88.0106 | VFADLRIVYK | 971 | 10 | HPV | E6 | 46 | A | 2086 | 127 | 402 | 200 | 273 |
| 88.0107 | RTLSKISEYR | 972 | 10 | HPV | E6 | 68 | A | 77 | 100 | 52 | 189 | 133 |
| 88.0108 | RLLSKISEYK | 973 | 10 | HPV | E6 | 68 | A | 15 | 65 | 158 | 40019 | 429 |
| 88.0109 | KVSEYRHYNY | 974 | 10 | HPV | E6 | 72 | A | 349 | 110 | 1791 | 70859 | 3498 |
| 88.0110 | KISEYRHYNK | 975 | 10 | HPV | E6 | 72 | A | 29 | 18 | 397 | 24827 | 15565 |
| 88.0111 | IVIRCIICQR | 976 | 10 | HPV | E6 | 99 | A | 984 | 217 | 52 | 529 | 28 |
| 88.0113 | WLGRCAVCWR | 977 | 10 | HPV | E6 | 132 | A | 2330 | 3002 | 356 | 40 | 112 |
| 88.0114 | WTGRCAVCWK | 978 | 10 | HPV | E6 | 132 | A | 1261 | 131 | 4176 | 3403 | 29 |
| 88.0241 | YVVCDKCLK | 979 | 9 | HPV | E6 | 67 | A | 3282 | 643 | 8.5 | 165 | 1289 |
| 88.0242 | YAVCDKCLR | 980 | 9 | HPV | E6 | 67 | A | 458 | 194 | 4261 | 26582 | 16034 |
| 88.0243 | SVCRSSRTR | 981 | 9 | HPV | E6 | 145 | A | 323 | 97 | 249 | 547 | 17 |
| 88.0244 | SCCRSSRTK | 982 | 9 | HPV | E6 | 145 | A | 21 | 3.9 | 51 | 5227 | 4.2 |
| 88.0245 | SLPHAACHK | 983 | 9 | HPV | E6 | 59 | A | 32 | 66 | 219 | 1186 | 654 |
| 88.0246 | SIPHAACHR | 984 | 9 | HPV | E6 | 59 | A | 1053 | 352 | 236 | 253 | 181 |
| 88.0249 | FVDLTIVYR | 985 | 9 | HPV | E6 | 47 | A | 29674 | 5312 | 2384 | 430 | 138 |
| 88.0250 | FTDLTIVYK | 986 | 9 | HPV | E6 | 47 | A | 557 | 16 | 24170 | 18477 | 143 |
| 88.0251 | SFYGTTLEK | 987 | 9 | HPV | E6 | 82 | A | 34 | 15 | 517 | 3385 | 498 |
| 88.0252 | SVYGTTLER | 988 | 9 | HPV | E6 | 82 | A | 28 | 6.4 | 133 | 454 | 21 |
| 88.0253 | TFLEKLTNK | 989 | 9 | HPV | E6 | 86 | A | 6839 | 815 | 451 | 148 | 918 |
| 88.0254 | TTLEKLTNR | 990 | 9 | HPV | E6 | 86 | A | 1993 | 817 | 42 | 37 | 101 |
| 88.0255 | ETNPFGICK | 991 | 9 | HPV | E6 | 56 | A | 9585 | 100 | 29103 | 804 | 14 |
| 88.0256 | EGNPFGICR | 992 | 9 | HPV | E6 | 56 | A | 11467 | 10372 | 5123 | 344 | 82 |
| 88.0258 | NTLEQTVKR | 993 | 9 | HPV | E6 | 86 | A | 20380 | 1151 | 2273 | 18 | 8.6 |
| 88.0259 | ALCWRSRRR | 994 | 9 | HPV | E6 | 137 | A | 959 | 9748 | 72 | 1289 | 7416 |
| 88.0260 | AACWRSRRK | 995 | 9 | HPV | E6 | 137 | A | 75 | 770 | 3022 | 45341 | 12877 |
| 88.0262 | VSIACVYCR | 996 | 9 | HPV | E6 | 28 | A | 3236 | 143 | 42 | 1347 | 185 |
| 88.0264 | SIACVYCKK | 997 | 9 | HPV | E6 | 29 | A | 271 | 83 | 9114 | 19632 | 96 |
| 88.0265 | ILYRDCIAY | 998 | 9 | HPV | E6 | 54 | A | 261 | 1832 | 53232 | 44670 | >19607.84 |
| 88.0266 | IVYRDCIAR | 999 | 9 | HPV | E6 | 54 | A | 465 | 106 | 27 | 325 | 64 |
| 88.0267 | CTAYAACHK | 1000 | 9 | HPV | E6 | 59 | A | 726 | 196 | 2956 | 771 | 167 |
| 88.0268 | CIAYAACHR | 1001 | 9 | HPV | E6 | 59 | A | 3625 | 1905 | 502 | 115 | 262 |
| 88.0269 | SFYGETLEK | 1002 | 9 | HPV | E6 | 84 | A | 288 | 108 | 947 | 885 | 1074 |
| 88.0270 | SVYGETLER | 1003 | 9 | HPV | E6 | 84 | A | 44 | 11 | 235 | 160 | 17 |
| 88.0272 | LIRCLRCQR | 1004 | 9 | HPV | E6 | 102 | A | 21335 | 12648 | 695 | 810 | 200 |
| 88.0273 | RTQCVQCKK | 1005 | 9 | HPV | E6 | 27 | A | 234 | 20 | 127 | 8147 | 3066 |
| 88.0274 | RLQCVQCKR | 1006 | 9 | HPV | E6 | 27 | A | 2535 | 6081 | 65 | 1829 | 11479 |
| 88.0275 | KFLEERVKK | 1007 | 9 | HPV | E6 | 86 | A | 5344 | 2229 | 30 | 9740 | 17674 |
| 88.0276 | KTLEERVKR | 1008 | 9 | HPV | E6 | 86 | A | 1957 | 159 | 37 | 1360 | 17685 |
| 88.0277 | NVMGRWTGR | 1009 | 9 | HPV | E6 | 127 | A | 3884 | 794 | 40 | 18 | 20 |
| 88.0278 | NIMGRWTGK | 1010 | 9 | HPV | E6 | 127 | A | 52 | 54 | 3274 | 86 | 173 |
| 88.0279 | LTYRDDFPY | 1011 | 9 | HPV | E6 | 55 | A | 8265 | 82 | >71146.25 | 20186 | 1529 |
| 88.0280 | LVYRDDFPK | 1012 | 9 | HPV | E6 | 55 | A | 317 | 13 | 3009 | 1970 | 130 |
| 88.0281 | RFCLLFYSK | 1013 | 9 | HPV | E6 | 67 | A | 1156 | 484 | 83 | 450 | 232 |
| 88.0282 | RVCLLFYSR | 1014 | 9 | HPV | E6 | 67 | A | 439 | 111 | 51 | 2176 | 689 |
| 88.0283 | LTFYSKVRK | 1015 | 9 | HPV | E6 | 70 | A | 3.8 | 8.0 | 87 | 3382 | 13 |
| 88.0284 | LLFYSKVRR | 1016 | 9 | HPV | E6 | 70 | A | 56 | 73 | 38 | 276 | 11 |
| 88.0288 | ATLESITKR | 1017 | 9 | HPV | E6 | 89 | A | 1437 | 16 | 100 | 851 | 188 |
| 88.0289 | KVLCDLLIR | 1018 | 9 | HPV | E6 | 97 | A | 363 | 169 | 66 | 5896 | 9053 |
| 88.0290 | KQLCDLLIK | 1019 | 9 | HPV | E6 | 97 | A | 226 | 65 | 340 | 46426 | 11897 |
| 88.0291 | TFVHEIELK | 1020 | 9 | HPV | E6 | 21 | A | 4431 | 217 | 8412 | 4130 | 172 |
| 88.0292 | TSVHEIELR | 1021 | 9 | HPV | E6 | 21 | A | >64327.49 | 872 | 1039 | 5948 | 12 |
| 88.0293 | YTFVFADLR | 1022 | 9 | HPV | E6 | 43 | A | 3633 | 8.1 | 20 | 6.6 | 2.9 |
| 88.0295 | DFLEQTLKK | 1023 | 9 | HPV | E6 | 86 | A | >57591.62 | 18809 | 34365 | 174 | 14376 |
| 88.0296 | DTLEQTLKR | 1024 | 9 | HPV | E6 | 86 | A | 31347 | 12909 | 38127 | 9.2 | 110 |
| 88.0297 | LVRCIICQR | 1025 | 9 | HPV | E6 | 100 | A | 677 | 358 | 59 | 109 | 201 |
| 88.0298 | LIRCIICQK | 1026 | 9 | HPV | E6 | 100 | A | 445 | 252 | 639 | 834 | 285 |
| 88.0299 | RVAVCWRPR | 1027 | 9 | HPV | E6 | 135 | A | 5.3 | 8.5 | 7.0 | 102 | 33 |
| 88.0300 | RCAVCWRPK | 1028 | 9 | HPV | E6 | 135 | A | 285 | 340 | 382 | 131 | 1297 |
| 88.0301 | AFCWRPRRR | 1029 | 9 | HPV | E6 | 137 | A | 273 | 17907 | 60 | 75 | 1087 |

TABLE 14-continued

| Peptide | Sequence | SEQ ID NO | AA | Organism | Protein | Position | Analog | A*0301 | A*1101 | A*3101 | A*3301 | A*6801 |
|---|---|---|---|---|---|---|---|---|---|---|---|---|
| 88.0302 | AVCWRPRRK | 1030 | 9 | HPV | E6 | 137 | A | 34 | 101 | 263 | 7950 | 1810 |
| 78.0306 | LSFVCPWCA | 1031 | 9 | HPV | E7 | 94 | | 38337 | 10864 | 4289 | 4603 | 341 |
| 86.0026 | TFCCKCDSTLR | 1032 | 11 | HPV | E7 | 56 | | 21772 | 8043 | 332 | 91 | 260 |
| 86.0030 | LVVESSADDLR | 1033 | 11 | HPV | E7 | 74 | | >47008.55 | 2170 | 26410 | 5624 | 28 |
| 86.0031 | TLQVVCPGCAR | 1034 | 11 | HPV | E7 | 88 | | 20997 | 1395 | 67 | 63 | 147 |
| 86.0032 | YLIHVPCCECK | 1035 | 11 | HPV | E7 | 59 | | 1748 | 1534 | 33044 | 8066 | 177 |
| 86.0033 | FVVQLDIQSTK | 1036 | 11 | HPV | E7 | 70 | | 3682 | 853 | 48593 | 31350 | 2.7 |
| 86.0390 | HTCNTTVR | 1037 | 8 | HPV | E7 | 59 | | 4862 | 1792 | 726 | 4490 | 25 |
| 88.0115 | GLVCPICSQK | 1038 | 10 | HPV | E7 | 88 | A | 428 | 814 | 45293 | 70317 | 3568 |
| 88.0117 | GFNHQHLPAR | 1039 | 10 | HPV | E7 | 43 | A | >46610.17 | 27889 | 173 | 5572 | 34617 |
| 88.0118 | GVNHQHLPAK | 1040 | 10 | HPV | E7 | 43 | A | 42 | 11 | 3337 | 76239 | 9347 |
| 88.0119 | NVVTFCCQCK | 1041 | 10 | HPV | E7 | 53 | A | 790 | 303 | 4757 | 87 | 13 |
| 88.0120 | NIVTFCCQCR | 1042 | 10 | HPV | E7 | 53 | A | 1507 | 1070 | 2731 | 766 | 93 |
| 88.0122 | GVSHAQLPAK | 1043 | 10 | HPV | E7 | 44 | A | 42 | 12 | 36011 | >74935.4 | 20590 |
| 88.0124 | LIHVPCCECR | 1044 | 10 | HPV | E7 | 60 | A | 5326 | 5925 | 385 | 387 | 228 |
| 88.0303 | AVLQDIVLH | 1045 | 9 | HPV | E7 | 6 | A | 1922 | 101 | 6307 | 25776 | 27035 |
| 88.0304 | ATLQDIVLK | 1046 | 9 | HPV | E7 | 6 | A | 37 | 8.6 | 65 | 17121 | 3231 |
| 88.0306 | GVNHQHLPK | 1047 | 9 | HPV | E7 | 43 | A | 26 | 7.7 | 353 | 15615 | 1192 |
| 88.0307 | HVMLCMCCK | 1048 | 9 | HPV | E7 | 59 | A | 282 | 79 | 772 | 825 | 99 |
| 88.0308 | HTMLCMCCR | 1049 | 9 | HPV | E7 | 59 | A | 405 | 92 | 11 | 14 | 24 |
| 88.0310 | LSFVCPWCR | 1050 | 9 | HPV | E7 | 94 | A | 31676 | 200 | 47 | 231 | 152 |
| 88.0312 | AQPATADYK | 1051 | 9 | HPV | E7 | 45 | A | 3500 | 109 | 10413 | 58871 | 24173 |
| 88.0313 | VVHAQLPAR | 1052 | 9 | HPV | E7 | 45 | A | 423 | 127 | 3.4 | 12 | 201 |
| 88.0314 | VSHAQLPAK | 1053 | 9 | HPV | E7 | 45 | A | 378 | 9.5 | 46 | 1401 | 13502 |
| 88.0317 | QLARQAKQH | 1054 | 9 | HPV | E7 | 48 | A | 8423 | 6862 | 945 | 1665 | 243 |
| 88.0320 | KQHTCYLIR | 1055 | 9 | HPV | E7 | 54 | A | 135 | 213 | 13 | 2275 | 12177 |
| 88.0321 | VTLDIQSTK | 1056 | 9 | HPV | E7 | 72 | A | 78 | 13 | 2046 | 1954 | 237 |
| 88.0322 | VQLDIQSTR | 1057 | 9 | HPV | E7 | 72 | A | 15105 | 2917 | 162 | 4588 | 10341 |
| 83.0038 | SLGPGPGTK | 1058 | 9 | Human | MAGE1 | 96 | A | 7.8 | 5.8 | 4392 | 152133 | 3517 |
| 83.0039 | SLFGPGPGK | 1059 | 9 | Human | MAGE1 | 96 | A | 3.4 | 2.3 | 1085 | 82275 | 36 |
| 83.0034 | LVGPGPGK | 1060 | 8 | Human | MAGE2 | 116 | A | 1004 | 291 | 23907 | >125541.13 | 598 |
| 83.0035 | KMFLQLAK | 1061 | 8 | Human | p53 | 132 | | 45 | 62 | 677 | >125541.13 | 8384 |
| 83.0036 | KMGPGPGK | 1062 | 8 | Human | p53 | 132 | A | 84 | 242 | 1144 | 106362 | 4156 |
| 1489.51 | KQENWYSLKK | 1063 | 10 | Pf | CSP | 58 | | 608 | 178 | 6327 | >136150.23 | 4794 |
| 83.0041 | GVGPGPGLK | 1064 | 9 | Pf | LSA1 | 105 | A | 47 | 4.0 | 1367 | >111538.46 | 3972 |
| 83.0042 | GVSGPGPGK | 1065 | 9 | Pf | LSA1 | 105 | A | 13 | 5.8 | >11221.95 | >111538.46 | 209 |
| 99.0198 | FLLYILFLVK | 1066 | 10 | Pf | | 17 | | 446 | 1431 | 54496 | 3254 | 2266 |
| 99.0199 | LVFSNVLCFR | 1067 | 10 | Pf | | 43 | | 120 | 19 | 33 | 19 | 7.7 |
| 99.0202 | SSFDIKSEVK | 1068 | 10 | Pf | | 116 | | 1900 | 19 | 19829 | 70344 | 31 |
| 99.0206 | TLYQIQVMKR | 1069 | 10 | Pf | | 44 | | 361 | 164 | 397 | 558 | 90 |
| 99.0207 | KQVQMMIMIK | 1070 | 10 | Pf | | 58 | | 264 | 112 | 4627 | 1231 | 2247 |
| 99.0208 | GVIYIMIISK | 1071 | 10 | Pf | | 70 | | 777 | 18 | 18811 | 1567 | 1134 |
| 99.0209 | ELFDKDTFFK | 1072 | 10 | Pf | | 158 | | 144 | 109 | 3676 | 13 | 3.6 |
| 99.0235 | ALERLLSLKK | 1073 | 10 | Pf | | 50 | | 147 | 822 | 33559 | 18255 | 22391 |
| 99.0236 | KILIKIPVTK | 1074 | 10 | Pf | | 109 | | 13 | 60 | 1661 | 24992 | 19571 |
| 99.0237 | RLPLLPKTWK | 1075 | 10 | Pf | | 128 | | 11 | 67 | 340 | 11392 | 2889 |
| 99.0239 | SQVSNSDSYK | 1076 | 10 | Pf | | 161 | | 1656 | 83 | 24559 | >17448.86 | 1384 |
| 99.0240 | QQNQESKIMK | 1077 | 10 | Pf | | 197 | | 3469 | 77 | 28120 | >17448.86 | 21310 |
| 99.0241 | IIALLIIPPK | 1078 | 10 | Pf | | 249 | | 30 | 5.3 | 23822 | 8426 | 82 |
| 99.0243 | SSPLFNNFYK | 1079 | 10 | Pf | | 14 | | 100 | 0.7 | 1608 | 1728 | 6.3 |
| 99.0244 | FLYLLNKKNK | 1080 | 10 | Pf | | 151 | | 177 | 475 | 4313 | 780 | 155 |
| 99.0245 | LQMMNVNLQK | 1081 | 10 | Pf | | 183 | | 25 | 7.2 | 435 | 1113 | 320 |
| 99.0246 | LTNHLINTPK | 1082 | 10 | Pf | | 195 | | 11 | 5.9 | 62 | 373 | 10 |
| 99.0247 | IFISFYLINK | 1083 | 10 | Pf | | 259 | | 1987 | 1056 | 462 | 394 | 363 |
| 99.0248 | RLFEESLGIR | 1084 | 10 | Pf | | 293 | | 64 | 1096 | 297 | 788 | 409 |
| 99.0303 | LLYILFLVK | 1085 | 9 | Pf | | 18 | | 13 | 207 | 90687 | 13261 | 5545 |
| 99.0304 | KSMLKELIK | 1086 | 9 | Pf | | 129 | | 189 | 151 | 450 | >46548.96 | >37037.04 |
| 99.0305 | PVLTSLFNK | 1087 | 9 | Pf | | 166 | | 1949 | 25 | 5107 | 18271 | 29928 |
| 99.0317 | KTMNNYMIK | 1088 | 9 | Pf | | 18 | | 17 | 5.5 | 24 | 12743 | 29 |
| 99.0318 | LFDKDTFFK | 1089 | 9 | Pf | | 159 | | 931 | 167 | 5706 | 1189 | 101 |
| 99.0319 | YLFNQHIKK | 1090 | 9 | Pf | | 287 | | 14 | 7.8 | 4919 | 7974 | 14 |
| 99.0320 | MQSSFFMNR | 1091 | 9 | Pf | | 307 | | 13 | 1.1 | 29 | 75 | 3.8 |
| 99.0321 | RFYITTRYK | 1092 | 9 | Pf | | 315 | | 1.9 | 67 | 15 | 98 | 17468 |
| 99.0322 | TTRYKYLNK | 1093 | 9 | Pf | | 319 | | 117 | 848 | 416 | 652 | 2565 |
| 99.0359 | AVIFTPIYY | 1094 | 9 | Pf | | 34 | | 25 | 9.5 | 42321 | 10068 | 1352 |
| 99.0360 | ALERLLSLK | 1095 | 9 | Pf | | 50 | | 233 | 369 | 3433 | 12786 | 13708 |
| 99.0361 | SISGKYDIK | 1096 | 9 | Pf | | 85 | | 2086 | 50 | 28249 | 12437 | 1745 |
| 99.0363 | EQRLPLLPK | 1097 | 9 | Pf | | 126 | | 1088 | 765 | 423 | 987 | 1911 |
| 99.0365 | IALLIIPPK | 1098 | 9 | Pf | | 250 | | 1241 | 108 | 2926 | 1404 | 1965 |
| 99.0366 | PVVCSMEYK | 1099 | 9 | Pf | | 270 | | 1940 | 80 | 330791 | 22608 | 414 |
| 99.0367 | VVCSMEYKK | 1100 | 9 | Pf | | 271 | | 443 | 54 | 891 | 14328 | 167 |
| 99.0368 | FSYDLRLNK | 1101 | 9 | Pf | | 308 | | 29 | 4.9 | 461 | 1264 | 15 |
| 99.0369 | HLNEPIGFK | 1102 | 9 | Pf | | 323 | | 2.3 | 1.3 | 183 | 97 | 2.8 |
| 99.0370 | PLFNNFYKR | 1103 | 9 | Pf | | 16 | | 2635 | 1890 | 520 | 1258 | 132 |
| 99.0371 | YQNFQNADK | 1104 | 9 | Pf | | 141 | | 2712 | 177 | 44698 | >18447.84 | 19830 |
| 99.0372 | QMMNVNLQK | 1105 | 9 | Pf | | 184 | | 20 | 7.0 | 504 | 6649 | 243 |

TABLE 14-continued

| Peptide | Sequence | SEQ ID NO | AA | Organism | Protein | Position | Analog | A*0301 | A*1101 | A*3101 | A*3301 | A*6801 |
|---|---|---|---|---|---|---|---|---|---|---|---|---|
| 99.0373 | AVSEIQNNK | 1106 | 9 | Pf | | 222 | | 25 | 11 | 1429 | 25449 | 14 |
| 99.0374 | GTMYILLKK | 1107 | 9 | Pf | | 236 | | 2.2 | 1.2 | 29 | 8453 | 3.1 |
| 99.0375 | FISFYLINK | 1108 | 9 | Pf | | 260 | | 19 | 9.0 | 2192 | 1456 | 18 |
| 99.0376 | YLINKHWQR | 1109 | 9 | Pf | | 264 | | 1034 | 676 | 4.4 | 7.7 | 3.7 |
| 99.0377 | ALKISQLQK | 1110 | 9 | Pf | | 273 | | 15 | 96 | 3203 | 23800 | >54794.52 |
| 99.0378 | KINSNFLLK | 1111 | 9 | Pf | | 282 | | 17 | 6.4 | 68 | 47740 | 2737 |
| F020.05 | AAMXDPTTFK | 1112 | 10 | Unknown | Naturally processed | | A | 50 | 7.2 | | | |
| F029.10 | GTMTTSXYK | 1113 | 9 | Unknown | Naturally processed | | A | 4.0 | 4.5 | | | |
| F029.12 | SXXPAXFQK | 1114 | 9 | Unknown | Naturally processed | | A | 14 | 2.0 | | | |
| F029.13 | ATAGDGXXEXRK | 1115 | 12 | Unknown | Naturally processed | | A | 184 | 19 | | | |

TABLE 15

| Peptide | Sequence | SEQ ID NO | AA | Organism | Protein | Position | Analog | A*2402 | A*2301 | A*2902 | A*3002 |
|---|---|---|---|---|---|---|---|---|---|---|---|
| 83.0155 | AYGPGPGKF | 1116 | 9 | Artificial sequence | Consensus | | A | 2.4 | 9.7 | 44854 | 3.2 |
| 83.0156 | AYIGPGPGF | 1117 | 9 | Artificial sequence | Consensus | | A | 217 | 12 | 15887 | 5728 |
| 996.07 | AYAAAAAAL | 1118 | 9 | Artificial sequence | | | Poly | 443 | | | |
| 1428.08 | AYSSWMYSY | 1119 | 9 | EBV | EBNA3 | 176 | | | 21 | | 4.9 |
| 1448.01 | DLLDTASALY | 1120 | 10 | HBV | Core | 419 | | | | 74 | 37 |
| 1142.09 | WFHISCLTF | 1121 | 9 | HBV | NUC | 102 | | 204 | 11 | 95 | 75094 |
| 83.0128 | KYTSFPWL | 1122 | 8 | HBV | pol | 745 | | 208 | 177 | >172413.79 | 346 |
| 1448.04 | FAAPFTQCGY | 1123 | 10 | HBV | pol | 631 | | | | 461 | 1364 |
| 1448.07 | SYQHFRKLLL | 1124 | 10 | HBV | POL | 4 | | 418 | 39 | 28 | 3768 |
| 1448.08 | LYSHPIILGF | 1125 | 10 | HBV | POL | 492 | | 2.6 | 5.4 | 109 | 1116 |
| 1448.03 | MSTTDLEAY | 1126 | 9 | HBV | X | 103 | | | | 2565 | 396 |
| 83.0149 | MYVGDLCGSVF | 1127 | 11 | HCV | E1 | 275 | | 26 | 0.91 | 612 | 1460 |
| 83.0150 | MYGPGPGGSVF | 1128 | 11 | HCV | E1 | 275 | A | 35 | 5.4 | 48442 | 31980 |
| 83.0151 | MYVGPGPGSVF | 1129 | 11 | HCV | E1 | 275 | A | 35 | 4.4 | 1527 | 28177 |
| 83.0152 | MYVGGPGPGVF | 1130 | 11 | HCV | E1 | 275 | A | 381 | 85 | 89 | 2870 |
| 83.0153 | MYVGDGPGPGF | 1131 | 11 | HCV | E1 | 275 | A | 90 | 11 | 8656 | 39608 |
| 83.0126 | VMGSSYGF | 1132 | 8 | HCV | NS5 | 2639 | | 36 | 159 | 145 | 41967 |
| 1448.06 | EVDGVRLHRY | 1133 | 10 | HCV | NS5 | 2129 | | | | 14940 | 113 |
| 73.0375 | KYSKSSIVGW | 1134 | 10 | HIV | NEF | 4 | A | 4061 | 491 | >69444.44 | >34482.76 |
| 73.0376 | KWSKSSIVGF | 1135 | 10 | HIV | NEF | 4 | A | 1674 | 84 | >56179.78 | 30367 |
| 73.0391 | FFLKEKGGF | 1136 | 9 | HIV | NEF | 116 | A | 3456 | 655 | 3015 | 141 |
| 73.0393 | IYSKKRQEF | 1137 | 9 | HIV | NEF | 175 | A | 306 | 421 | 29353 | 727 |
| 73.0395 | IYSKKRQEIF | 1138 | 10 | HIV | NEF | 175 | A | 238 | 360 | >131578.95 | 21001 |
| 73.0397 | LYVYHTQGYF | 1139 | 10 | HIV | NEF | 190 | A | 38 | 23 | 1696 | 1222 |
| 73.0400 | VYHTQGYFPDF | 1140 | 11 | HIV | NEF | 192 | A | 149 | 68 | 14923 | >22556.39 |
| 73.0406 | RYPLTFGW | 1141 | 8 | HIV | NEF | 216 | | 127 | 3836 | 13889 | 6251 |
| 73.0407 | RYPLTFGF | 1142 | 8 | HIV | NEF | 216 | A | 3.3 | 6.4 | 9704 | 6328 |
| 73.0411 | RFPLTFGF | 1143 | 8 | HIV | NEF | 216 | A | 178 | 124 | 12759 | 13472 |
| 73.0413 | TYGWCFKL | 1144 | 8 | HIV | NEF | 222 | A | 2181 | 333 | 25658 | >8042.9 |
| 73.0414 | TFGWCFKF | 1145 | 8 | HIV | NEF | 222 | A | 3424 | 462 | 4449 | >10135.14 |
| 73.0422 | LYVYHTQGY | 1146 | 9 | HIV | NEF | 190 | A | 7140 | 6088 | 216 | 258 |
| 73.0425 | NYTPDPGIRF | 1147 | 10 | HIV | NEF | 206 | A | 483 | 37 | 8334 | >9646.3 |
| 73.0430 | QYPPLERLTL | 1148 | 10 | HIV | REV | 78 | A | 211 | 22 | >11520.74 | >9646.3 |
| 73.0431 | QLPPLERLTF | 1149 | 10 | HIV | REV | 78 | A | 2507 | 338 | >37313.43 | >36585.37 |
| 66.0082 | KYGSLQYLAL | 1150 | 10 | HIV | VIF | 146 | A | 2800 | 147 | >69444.44 | 6957 |
| 78.0019 | LSKISEYRHY | 1151 | 10 | HPV | E6 | 70 | | >93023.26 | >23671.5 | 55190 | 186 |
| 78.0243 | ISEYRHYNY | 1152 | 9 | HPV | E6 | 73 | | 125794 | >23557.69 | 1329 | 32 |
| 78.0359 | RFHNIRGRW | 1153 | 9 | HPV | E6 | 131 | | 53237 | 11416 | 18 | 58 |
| 78.0365 | RFLSKISEY | 1154 | 9 | HPV | E6 | 68 | | 472 | 121 | 34623 | 23 |
| 78.0366 | RFHNISGRW | 1155 | 9 | HPV | E6 | 124 | | >80536.91 | 22871 | 174 | 37 |
| 86.0034 | VYDFAFRDLCI | 1156 | 11 | HPV | E6 | 49 | | 44 | 8.9 | 62242 | 35724 |
| 86.0035 | PYAVCDKCLKF | 1157 | 11 | HPV | E6 | 66 | | 99 | 8.1 | 118249 | >60000 |
| 86.0036 | QYNKPLCDLLI | 1158 | 11 | HPV | E6 | 98 | | 303 | 36 | >166666.67 | 6680 |
| 86.0037 | PFGICKLCLRF | 1159 | 11 | HPV | E6 | 59 | | 137 | 19 | 1249 | 32803 |
| 86.0038 | VYQFAFKDLCI | 1160 | 11 | HPV | E6 | 44 | | 30 | 1.9 | 49276 | 3477 |
| 86.0039 | AYAACHKCIDF | 1161 | 11 | HPV | E6 | 61 | | 91 | 14 | 1264 | 4699 |
| 86.0040 | VYKFLFTDLRI | 1162 | 11 | HPV | E6 | 42 | | 37 | 14 | 30216 | 1865 |
| 86.0041 | PYGVCIMCLRF | 1163 | 11 | HPV | E6 | 59 | | 380 | 100 | 69 | 43722 |
| 86.0042 | PYAVCRVCLLF | 1164 | 11 | HPV | E6 | 62 | | 226 | 150 | 2711 | 53351 |
| 86.0043 | VYDFVFADLRI | 1165 | 11 | HPV | E6 | 42 | | 47 | 8.0 | 8904 | 7585 |

TABLE 15-continued

| Peptide | Sequence | SEQ ID NO | AA | Organism | Protein | Position | Analog | A*2402 | A*2301 | A*2902 | A*3002 |
|---|---|---|---|---|---|---|---|---|---|---|---|
| 86.0112 | QYNKPLCDLF | 1166 | 10 | HPV | E6 | 98 | A | 115 | 21 | 7658 | 525 |
| 86.0113 | VYEFAFKDLF | 1167 | 10 | HPV | E6 | 44 | A | 15 | 1.7 | 1973 | 2038 |
| 86.0114 | FYSKVSEFRF | 1168 | 10 | HPV | E6 | 69 | A | 7.1 | 2.2 | 79 | 18453 |
| 86.0115 | VYREGNPFGF | 1169 | 10 | HPV | E6 | 53 | A | 197 | 91 | 11120 | 21947 |
| 86.0116 | FYSRIRELRF | 1170 | 10 | HPV | E6 | 71 | A | 11 | 1.6 | 83 | 12598 |
| 86.0117 | PYAVCRVCLF | 1171 | 10 | HPV | E6 | 62 | A | 12 | 4.5 | 407 | 5226 |
| 86.0118 | FYSKVRKYRF | 1172 | 10 | HPV | E6 | 72 | A | 18 | 13 | 3042 | 1232 |
| 86.0119 | LYGDTLEQTF | 1173 | 10 | HPV | E6 | 83 | A | 91 | 24 | 40871 | 42025 |
| 86.0315 | VYDFAFRDF | 1174 | 9 | HPV | E6 | 49 | A | 9.6 | 19 | 47381 | 8490 |
| 86.0316 | AYRDLCIVY | 1175 | 9 | HPV | E6 | 53 | A | 2094 | 1479 | 7117 | 66 |
| 86.0317 | AFRDLCIVF | 1176 | 9 | HPV | E6 | 53 | A | 1005 | 369 | 6722 | 3305 |
| 86.0318 | PYAVCDKCF | 1177 | 9 | HPV | E6 | 66 | A | 216 | 183 | 122025 | 9884 |
| 86.0319 | KYYSKISEY | 1178 | 9 | HPV | E6 | 75 | A | 10951 | 2165 | 702 | 1.3 |
| 86.0320 | KFYSKISEF | 1179 | 9 | HPV | E6 | 75 | A | 174 | 138 | 73339 | 306 |
| 86.0321 | CYSLYGTTF | 1180 | 9 | HPV | E6 | 87 | A | 28 | 11 | 2088 | 7823 |
| 86.0322 | RYHNIRGRW | 1181 | 9 | HPV | E6 | 131 | A | 145 | 14 | 122644 | 15 |
| 86.0323 | RFHNIRGRF | 1182 | 9 | HPV | E6 | 131 | A | 29 | 2.4 | 346 | 0.69 |
| 86.0324 | VYCKTVLEF | 1183 | 9 | HPV | E6 | 33 | A | 50 | 4.7 | 610 | 1139 |
| 86.0325 | AYKDLFVVY | 1184 | 9 | HPV | E6 | 48 | A | 1549 | 905 | 639 | 1.3 |
| 86.0326 | AFKDLFVVF | 1185 | 9 | HPV | E6 | 48 | A | 294 | 6.8 | 3051 | 829 |
| 86.0327 | LYVVYRDSI | 1186 | 9 | HPV | E6 | 52 | A | 982 | 242 | 148359 | 3483 |
| 86.0328 | LFVVYRDSF | 1187 | 9 | HPV | E6 | 52 | A | 268 | 134 | 919 | 18 |
| 86.0329 | RYHNIAGHY | 1188 | 9 | HPV | E6 | 126 | A | 1227 | 195 | 138 | 0.93 |
| 86.0330 | RFHNIAGHF | 1189 | 9 | HPV | E6 | 126 | A | 37 | 17 | 635 | 1.4 |
| 86.0331 | VYGTTLEKF | 1190 | 9 | HPV | E6 | 83 | A | 19 | 13 | 75267 | 220 |
| 86.0332 | AYADLTVVY | 1191 | 9 | HPV | E6 | 46 | A | 369 | 1384 | 136 | 9.3 |
| 86.0333 | AFADLTVVF | 1192 | 9 | HPV | E6 | 46 | A | 203 | 30 | 779 | 137 |
| 86.0334 | RYLSKISEY | 1193 | 9 | HPV | E6 | 68 | A | 142 | 98 | 4247 | 1.1 |
| 86.0335 | NYSVYGNTF | 1194 | 9 | HPV | E6 | 80 | A | 28 | 29 | 9121 | 2559 |
| 86.0336 | RYHNISGRW | 1195 | 9 | HPV | E6 | 124 | A | 47 | 15 | 104884 | 13 |
| 86.0337 | AYKDLCIVY | 1196 | 9 | HPV | E6 | 48 | A | 33798 | 3036 | 5205 | 29 |
| 86.0338 | AFKDLCIVF | 1197 | 9 | HPV | E6 | 48 | A | 284 | 16 | 5846 | 2305 |
| 86.0339 | AYAACHKCF | 1198 | 9 | HPV | E6 | 61 | A | 200 | 159 | 10972 | 3393 |
| 86.0340 | VYGETLEKF | 1199 | 9 | HPV | E6 | 85 | A | 45 | 14 | 91902 | 20009 |
| 86.0341 | RYHSIAGQY | 1200 | 9 | HPV | E6 | 126 | A | 3170 | 1904 | 544 | 1.4 |
| 86.0342 | RFHSIAGQF | 1201 | 9 | HPV | E6 | 126 | A | 28 | 2.9 | 481 | 1.2 |
| 86.0343 | KYLFTDLRI | 1202 | 9 | HPV | E6 | 44 | A | 108 | 1.9 | 78575 | 339 |
| 86.0344 | KFLFTDLRF | 1203 | 9 | HPV | E6 | 44 | A | 12 | 0.74 | 44 | 152 |
| 86.0345 | LYTDLRIVY | 1204 | 9 | HPV | E6 | 46 | A | 1986 | 1216 | 4.8 | 2.1 |
| 86.0346 | LFTDLRIVF | 1205 | 9 | HPV | E6 | 46 | A | 169 | 2.6 | 164 | 2649 |
| 86.0347 | PYGVCIMCF | 1206 | 9 | HPV | E6 | 59 | A | 190 | 147 | 144402 | 38850 |
| 86.0348 | RFLSKISEF | 1207 | 9 | HPV | E6 | 68 | A | 58 | 2.5 | 40103 | 201 |
| 86.0349 | EYRHYQYSF | 1208 | 9 | HPV | E6 | 75 | A | 21 | 2.3 | 13707 | 430 |
| 86.0350 | RYHNIMGRW | 1209 | 9 | HPV | E6 | 124 | A | 29 | 12 | 106990 | 7.1 |
| 86.0351 | RFHNIMGRF | 1210 | 9 | HPV | E6 | 124 | A | 39 | 2.6 | 174 | 1.3 |
| 86.0352 | VYNFACTEF | 1211 | 9 | HPV | E6 | 45 | A | 14 | 2.1 | 774 | 784 |
| 86.0353 | NYACTELKL | 1212 | 9 | HPV | E6 | 47 | A | 1741 | 131 | 77844 | 49107 |
| 86.0354 | NFACTELKF | 1213 | 9 | HPV | E6 | 47 | A | 211 | 13 | 46 | 6826 |
| 86.0355 | PYAVCRVCF | 1214 | 9 | HPV | E6 | 62 | A | 429 | 257 | 5602 | 316 |
| 86.0356 | LYYSKVRKY | 1215 | 9 | HPV | E6 | 71 | A | 21942 | 2735 | 1452 | 28 |
| 86.0357 | LFYSKVRKF | 1216 | 9 | HPV | E6 | 71 | A | 2008 | 277 | 11172 | 632 |
| 86.0358 | VYDFVFADF | 1217 | 9 | HPV | E6 | 42 | A | 9.9 | 2.2 | 1230 | 3961 |
| 86.0359 | VYADLRIVY | 1218 | 9 | HPV | E6 | 46 | A | 28 | 122 | 8.2 | 8.3 |
| 86.0360 | VFADLRIVF | 1219 | 9 | HPV | E6 | 46 | A | 23 | 2.5 | 87 | 24062 |
| 86.0361 | NYSLYGDTF | 1220 | 9 | HPV | E6 | 80 | A | 6.4 | 142 | 20945 | 64 |
| 86.0362 | RFHNISGRF | 1221 | 9 | HPV | E6 | 124 | A | 34 | 5.5 | 572 | 2.8 |
| 86.0363 | LYNLLIRCF | 1222 | 9 | HPV | E6 | 98 | A | 47 | 15 | 17958 | 2255 |
| 86.0392 | FYSKVSEF | 1223 | 8 | HPV | E6 | 69 | | 21 | 18 | 3774 | 66667 |
| 86.0393 | VYREGNPF | 1224 | 8 | HPV | E6 | 53 | | 554 | 147 | 10001 | 65970 |
| 1090.64 | VFEFAFKDLF | 1225 | 10 | HPV | E6 | 44 | | 400 | | | |
| 1511.42 | EYRHYCYSLY | 1226 | 10 | HPV | E6 | 82 | | | | 198 | 3.7 |
| 1511.43 | EYRHYNYSLY | 1227 | 10 | HPV | E6 | 75 | | | | 956 | 12 |
| 1511.55 | ETRHYCYSLY | 1228 | 10 | HPV | E6 | 82 | A | | | 755 | 10 |
| 1511.56 | EYDHYCYSLY | 1229 | 10 | HPV | E6 | 82 | A | | | 799 | 77 |
| 1511.57 | KTRYYDYSVY | 1230 | 10 | HPV | E6 | 78 | A | | | 87841 | 0.71 |
| 1511.58 | KYDYYDYSVY | 1231 | 10 | HPV | E6 | 78 | A | | | 5749 | 11 |
| 1511.59 | ETRHYNYSLY | 1232 | 10 | HPV | E6 | 75 | A | | | 5464 | 29 |
| 1511.60 | EYDHYNYSLY | 1233 | 10 | HPV | E6 | 75 | A | | | 777 | 93 |
| 86.0120 | TYCCKCDSTL | 1234 | 10 | HPV | E7 | 56 | A | 206 | 30 | 145803 | 16588 |
| 86.0121 | TFCCKCDSTF | 1235 | 10 | HPV | E7 | 56 | A | 25 | 14 | 501 | 1167 |
| 86.0122 | TYCHSCDSTF | 1236 | 10 | HPV | E7 | 58 | A | 14 | 2.9 | 5236 | 3580 |
| 86.0123 | CYTCGTTVRF | 1237 | 10 | HPV | E7 | 59 | A | 41 | 18 | 7744 | 38331 |
| 86.0364 | LYPEPTDLF | 1238 | 9 | HPV | E7 | 15 | A | 38 | 17 | 1150 | 30732 |
| 86.0365 | NYYIVTCCF | 1239 | 9 | HPV | E7 | 52 | A | 27 | 12 | 2675 | 8398 |
| 86.0395 | LFLNTLSF | 1240 | 8 | HPV | E7 | 89 | | 587 | 104 | 1013 | 118217 |
| 86.0396 | LFLSTLSF | 1241 | 8 | HPV | E7 | 90 | | 2283 | 160 | 1034 | >75000 |
| 1428.07 | RVLPPNWKY | 1242 | 9 | Human | 40s ribo prot S13 | 132 | | | >49000 | | 3.0 |

TABLE 15-continued

| Peptide | Sequence | SEQ ID NO | AA | Organism | Protein | Position | Analog | A*2402 | A*2301 | A*2902 | A*3002 |
|---|---|---|---|---|---|---|---|---|---|---|---|
| 1428.06 | RLAHEVGWKY | 1243 | 10 | Human | 60s ribo prot L13A | 139 | | | 4631 | | 3.8 |
| 1428.04 | AYKKQFSQY | 1244 | 9 | Human | 60s ribo prot L5 | 217 | | | 10669 | | 5.3 |
| 1428.01 | KTKDIVNGL | 1245 | 9 | Human | Factin capping protein | 235 | | | >49000 | | 164 |
| 1428.09 | SLFVSNHAY | 1246 | 9 | Human | fructose biphosphate | 355 | | | 30295 | | 1.1 |
| 83.0145 | TYGPGPGSLSF | 1247 | 11 | Human | Her2/neu | 63 | A | 7.1 | 1.7 | 9853 | 47246 |
| 83.0146 | TYLGPGPGLSF | 1248 | 11 | Human | Her2/neu | 63 | A | 23 | 0.65 | 600 | 26889 |
| 83.0147 | TYLPGPGPGSF | 1249 | 11 | Human | Her2/neu | 63 | A | 8.8 | 2.2 | 56183 | 7275 |
| 83.0148 | TYLPTGPGPGF | 1250 | 11 | Human | Her2/neu | 63 | A | 39 | 8.6 | 56574 | 32985 |
| 1216.01 | RWGLLLALL | 1251 | 9 | Human | Her2/neu | 8 | | 106 | 100 | 61253 | 300 |
| 1216.02 | PYVSRLLGI | 1252 | 9 | Human | Her2/neu | 780 | | 11 | 18 | 200160 | 65465 |
| 1216.09 | TYLPTNASL | 1253 | 9 | Human | Her2/neu | 63 | | 141 | 7.8 | 106153 | 8244 |
| 83.0141 | IYGPGPGLIF | 1254 | 10 | Human | MAGE3 | 195 | A | 7.4 | 8.0 | 58 | 6845 |
| 83.0142 | IYPGPGPGIF | 1255 | 10 | Human | MAGE3 | 195 | A | 58 | 12 | 18659 | 17959 |
| 83.0143 | IYPKGPGPGF | 1256 | 10 | Human | MAGE3 | 195 | A | 7.5 | 4.9 | 53603 | 61283 |
| 1428.05 | RISGVDRYY | 1257 | 9 | Human | NADH ubiqoxidore | 53 | | | >49000 | | 3.0 |
| F185.01 | LYSACFWWL | 1258 | 9 | Human | OA1 | 194 | | 28 | | | |
| F185.02 | LYSACFWWF | 1259 | 9 | Human | OA1 | 194 | A | 28 | | | |
| 83.0136 | TYSVSFDSLF | 1260 | 10 | Human | PSM | 624 | | 10 | 12 | 521 | 5218 |
| 83.0137 | TYGPGPGSLF | 1261 | 10 | Human | PSM | 624 | A | 3.9 | 8.7 | 7228 | 10871 |
| 83.0138 | TYSGPGPGLF | 1262 | 10 | Human | PSM | 624 | A | 50 | 92 | 7726 | 3461 |
| 83.0139 | TYSVGPGPGF | 1263 | 10 | Human | PSM | 624 | A | 332 | 340 | 120913 | 55200 |
| 83.0133 | AYPNVSAKI | 1264 | 9 | *Lysteria* | listeriolysin | 196 | | 14 | 45 | 56905 | 4456 |
| 83.0134 | AYGPGPGKI | 1265 | 9 | *Lysteria* | listeriolysin | 196 | A | 36 | 169 | >156250 | 5427 |
| 1404.35 | IMVLSFLF | 1266 | 8 | Pf | CSP | 427 | | 469 | 7.5 | 111 | 30000 |
| 1404.48 | YYGKQENW | 1267 | 8 | Pf | CSP | 55 | | 85 | 951 | >50000 | >30000 |
| 1404.66 | VFNVVNSSI | 1268 | 9 | Pf | CSP | 416 | | 403 | 35 | 24001 | 15737 |
| 1489.22 | ALFQEYQCY | 1269 | 9 | Pf | CSP | 18 | | | | 149 | 1032 |
| 1404.90 | LYNTEKGRHPF | 1270 | 11 | Pf | EXP | 100 | | 175 | 1947 | >50000 | >30000 |
| 1404.47 | YFILVNLL | 1271 | 8 | Pf | LSA | 10 | | 96 | 82 | 4050 | 30000 |
| 1404.55 | KFFDKDKEL | 1272 | 9 | Pf | LSA | 76 | | 269 | >49000 | >50000 | 3012 |
| 1404.56 | KFIKSLFHI | 1273 | 9 | Pf | LSA | 1876 | | 4.1 | 2.0 | >50000 | 3495 |
| 1404.79 | YFILVNLLIF | 1274 | 10 | Pf | LSA | 10 | | 577 | 12 | 764 | 3388 |
| 1404.84 | FYFILVNLLIF | 1275 | 11 | Pf | LSA | 9 | | 599 | 50 | 902 | 9826 |
| 1404.92 | SFYFILVNLLI | 1276 | 11 | Pf | LSA | 8 | | 229 | 35 | 3066 | 2096 |
| 1404.65 | VFLIFFDLF | 1277 | 9 | Pf | SSP2 | 13 | | 40 | 12 | 1510 | 13554 |
| 1404.89 | LYLLMDCSGSI | 1278 | 11 | Pf | SSP2 | 49 | | 154 | 10 | 5893 | 1469 |
| 98.0047 | KVSDEIWNY | 1279 | 9 | Pf | | 182 | | 52169 | >11980.44 | 230 | 1.9 |
| 98.0193 | SYKSSKRDKF | 1280 | 10 | Pf | | 225 | | 256 | 797 | 12594 | 88 |
| 98.0196 | RYQDPQNYEL | 1281 | 10 | Pf | | 21 | | 212 | 124 | 79717 | 189 |
| 98.0197 | DFFLKSKFNI | 1282 | 10 | Pf | | 3 | | 1648 | 304 | 47714 | 491 |
| 98.0217 | IFHFFLFLL | 1283 | 9 | Pf | | 11 | | 208 | 80 | 1405 | 837 |
| 98.0221 | VFLVFSNVL | 1284 | 9 | Pf | | 41 | | 26 | 4.9 | 33675 | 37689 |
| 98.0222 | TYGIIVPVL | 1285 | 9 | Pf | | 160 | | 248 | 20 | 30056 | 1519 |
| 98.0237 | NYMKIMNHL | 1286 | 9 | Pf | | 34 | | 16 | 1.7 | 45443 | 110 |
| 98.0238 | TYKKKNNHI | 1287 | 9 | Pf | | 264 | | 30 | 81 | 21642 | 162 |
| 98.0239 | VYYNILIVL | 1288 | 9 | Pf | | 277 | | 265 | 52 | >192307.69 | 1127 |
| 98.0240 | LYYLFNQHI | 1289 | 9 | Pf | | 285 | | 33 | 1.4 | 20130 | 11035 |
| 98.0241 | SFFMNRFYI | 1290 | 9 | Pf | | 310 | | 172 | 11 | 200 | 1022 |
| 98.0242 | FYITTRYKY | 1291 | 9 | Pf | | 316 | | 350 | 11 | 9.6 | 7.5 |
| 98.0243 | KYINFINFI | 1292 | 9 | Pf | | 328 | | 11 | 0.72 | 25475 | 55 |
| 98.0245 | KYEALIKLL | 1293 | 9 | Pf | | 380 | | 2856 | 484 | 17296 | 16098 |
| 98.0288 | IYYFDGNSW | 1294 | 9 | Pf | | 40 | | 80 | 6.1 | 3101 | 3025 |
| 98.0289 | VYRHCEYIL | 1295 | 9 | Pf | | 94 | | 2200 | 64 | 117851 | 3326 |
| 98.0290 | TWKPTIFLL | 1296 | 9 | Pf | | 135 | | 148 | 11 | 21155 | 306 |
| 98.0291 | SYKVNCINF | 1297 | 9 | Pf | | 168 | | 27 | 15 | 2535 | 572 |
| 98.0292 | KYNYFIHFF | 1298 | 9 | Pf | | 216 | | 2.5 | 0.49 | 319 | 2.7 |
| 98.0293 | NYFIHFFTW | 1299 | 9 | Pf | | 218 | | 9.3 | 1.3 | 9774 | 3020 |
| 98.0294 | HFFTWGTMF | 1300 | 9 | Pf | | 222 | | 83 | 5.7 | 4.0 | 220 |
| 98.0295 | MFVPKYFEL | 1301 | 9 | Pf | | 229 | | 266 | 11 | 2560 | 8560 |
| 98.0296 | IYTIIQDQL | 1302 | 9 | Pf | | 295 | | 72 | 45 | >37313.43 | 14124 |
| 98.0297 | FFLKSKFNI | 1303 | 9 | Pf | | 4 | | 1434 | 49 | 43105 | >83333.33 |
| 98.0299 | RMTSLKNEL | 1304 | 9 | Pf | | 61 | | 12711 | 1807 | 40270 | 14 |
| 98.0300 | YYNNFNNNY | 1305 | 9 | Pf | | 77 | | 817 | 126 | 19 | 34 |
| 98.0301 | YYNKSTEKL | 1306 | 9 | Pf | | 87 | | 109 | 106 | 55636 | 21751 |
| 98.0302 | EYEPTANLL | 1307 | 9 | Pf | | 109 | | 127 | 44 | >37313.43 | >26086.96 |
| F029.14 | VYXKHPVSX | 1308 | 9 | Unknown | Naturally processed | | A | 4.3 | | | |
| F029.16 | TYGNXTVTV | 1309 | 9 | Unknown | Naturally processed | | A | 26 | | | |
| F029.18 | KYPDRVVPX | 1310 | 9 | Unknown | Naturally processed | | A | 224 | | | |
| F029.23 | VYVXSXVTX | 1311 | 9 | Unknown | Naturally processed | | A | 5.3 | | | |
| F029.24 | DAQXXXNTX | 1312 | 9 | Unknown | Naturally processed | | A | 5.9 | | | |
| 83.0130 | KYQAVTTTL | 1313 | 9 | Unknown | Tumor p198 | 197 | | 22 | 16 | >156250 | 625 |
| 83.0131 | KYGPGPGTTTL | 1314 | 11 | Unknown | Tumor p198 | 197 | A | 103 | 130 | 9180 | 7056 |
| 83.0132 | KYQGPGPGTTL | 1315 | 11 | Unknown | Tumor p198 | 197 | A | 543 | 438 | 74453 | 5999 |

TABLE 16

| Peptide | Sequence | SEQ ID NO | AA | Organism | Protein | Position | Analog | B*0702 | B*3501 | B*5101 | B*5301 | B*5401 |
|---|---|---|---|---|---|---|---|---|---|---|---|---|
| 83.0093 | APGPGPGLL | 1316 | 9 | Artificial sequence | Consensus | | A | 299 | 7481 | 1614 | 18117 | 15613 |
| 83.0094 | APRGPGPGL | 1317 | 9 | Artificial sequence | Consensus | | A | 4.9 | 974 | 633 | 19779 | 1120 |
| 1196.01 | QPRAPIRPI | 1318 | 9 | EBNA | | 881 | | 6770 | >72000 | >55000 | 12 | >100000 |
| 1196.04 | YPLHEQHGM | 1319 | 9 | EBNA | | 458 | | >55000 | 20785 | >55000 | 10 | >100000 |
| 1489.62 | CPTVQASKL | 1320 | 9 | HBV | NUC | 14 | | 3247 | 645 | 448 | 1861 | 21643 |
| 83.0066 | SPTYKAFL | 1321 | 8 | HBV | pol | 659 | | 109 | 31169 | 4665 | 54879 | 58651 |
| 83.0067 | SPGPGPGL | 1322 | 8 | HBV | pol | 659 | A | 173 | 2337 | 3535 | 25607 | 53272 |
| 83.0076 | TPAGPGPGVF | 1323 | 10 | HBV | pol | 354 | A | 334 | 374 | 296 | 2629 | 351 |
| 83.0077 | TPARGPGPGF | 1324 | 10 | HBV | pol | 354 | A | 144 | 1678 | 2418 | 2742 | 31768 |
| 1489.64 | TPTGWGLAI | 1325 | 9 | HBV | POL | 691 | | 76 | 5145 | 103 | 1343 | 172 |
| 1489.63 | APCNFFTSA | 1326 | 9 | HBV | X | 146 | | 43 | 8087 | 1045 | >22409.64 | 0.61 |
| 1292.06 | GPGHKARVI | 1327 | 9 | HIV | GAG | 390 | A | 1686 | >72000 | >55000 | 2.2 | >50000 |
| 66.0094 | RPQVPLRPMTI | 1328 | 11 | HIV | NEF | 98 | A | 47009 | >18997.36 | 8081 | 21518 | 129 |
| 73.0439 | FPVRPQVPI | 1329 | 9 | HIV | NEF | 94 | A | 94 | 124 | 39 | 222 | 9.1 |
| 73.0441 | RPQVPLRPI | 1330 | 9 | HIV | NEF | 98 | A | 367 | >23225.81 | >9001.64 | 85335 | 1215 |
| 73.0443 | RPQVPLRPMTI | 1331 | 11 | HIV | NEF | 98 | A | 140 | 10455 | 5045 | 21538 | >15128.59 |
| 73.0459 | YPLTFGWCI | 1332 | 9 | HIV | NEF | 217 | A | 54283 | 1378 | 153 | 154 | 79 |
| 73.0461 | FPLTFGWCI | 1333 | 9 | HIV | NEF | 217 | A | 47951 | 164 | 63 | 36 | 14 |
| 73.0463 | FPLTFGWCFKI | 1334 | 11 | HIV | NEF | 217 | A | 52567 | 4991 | 590 | 188 | 105 |
| 83.0071 | FPVRPQVPL | 1335 | 9 | HIV | nef | 94 | | 17 | 3.8 | 18 | 49 | 21 |
| 83.0072 | FPGPGPGPL | 1336 | 9 | HIV | nef | 94 | A | 1584 | 426 | 2330 | 21036 | 29900 |
| 83.0073 | FPVGPGPGL | 1337 | 9 | HIV | nef | 94 | A | 106 | 14 | 138 | 32 | 246 |
| 1292.05 | GPKVKQWPI | 1338 | 9 | HIV | POL | 197 | A | 5500 | >72000 | >55000 | 2.3 | >50000 |
| 73.0471 | LPPLERLTI | 1339 | 9 | HIV | REV | 79 | A | 24398 | 13399 | 359 | 2624 | 11243 |
| 78.0396 | CPEEKQRHL | 1340 | 9 | HPV | E6 | 118 | | 10 | >52554.74 | >35483.87 | >109411.76 | >76923.08 |
| 83.0065 | VPGPGPGL | 1341 | 8 | Human | Her2/neu | 884 | A | 1517 | 447 | 537 | 4094 | 46405 |
| 83.0088 | RPGPGPGVSEF | 1342 | 11 | Human | Her2/neu | 966 | A | 119 | 18115 | 16774 | 20988 | 3360 |
| 83.0089 | RPRGPGPGSEF | 1343 | 11 | Human | Her2/neu | 966 | A | 11 | 24871 | >14824.8 | 19336 | 2745 |
| 83.0090 | RPRFGPGPGEF | 1344 | 11 | Human | Her2/neu | 966 | A | 14 | >30901.29 | >14824.8 | 76844 | 15470 |
| 83.0091 | RPRFRGPGPGF | 1345 | 11 | Human | Her2/neu | 966 | A | 9.7 | >30901.29 | >14824.8 | 49682 | 60095 |
| 83.0083 | APGPGPGAAPA | 1346 | 11 | Human | p53 | 76 | A | 1112 | 1252 | 1317 | 4366 | 361 |
| 83.0084 | APAGPGPGAPA | 1347 | 11 | Human | p53 | 76 | A | 161 | >28915.66 | 11947 | >39743.59 | 43 |
| 83.0085 | APAAGPGPGPA | 1348 | 11 | Human | p53 | 76 | A | 173 | 12845 | 12470 | 28574 | 204 |
| 83.0086 | APAAPGPGPGA | 1349 | 11 | Human | p53 | 76 | A | 811 | 3484 | 15814 | >39240.51 | 158 |
| 83.0068 | RPRGDNFAV | 1350 | 9 | Pf | SSP2 | 305 | | 12 | 20386 | 1681 | >46268.66 | 212 |
| 83.0069 | RPGPGPGAV | 1351 | 9 | Pf | SSP2 | 305 | A | 23 | 48487 | 2899 | >46268.66 | 1891 |
| 83.0070 | RPRGPGPGV | 1352 | 9 | Pf | SSP2 | 305 | A | 11 | 2368 | 52 | 34831 | 47 |
| 83.0078 | APRTVALTAL | 1353 | 10 | Unknown | Naturally procesed | | | 12 | 4351 | 14601 | 61596 | 16804 |
| 83.0079 | APGPGPGTAL | 1354 | 10 | Unknown | Naturally procesed | | A | 81 | 16315 | 16462 | >43661.97 | 35965 |
| 83.0080 | APRGPGPGAL | 1355 | 10 | Unknown | Naturally procesed | | A | 11 | 23381 | 12732 | >43661.97 | 1665 |
| 83.0081 | APRTGPGPGL | 1356 | 10 | Unknown | Naturally procesed | | A | 15 | 1414 | 1559 | 22012 | 2043 |
| F029.04 | XVXDNATEY | 1357 | 9 | Unknown | Naturally procesed | | A | >55000 | 444 | | | >100000 |
| 1143.05 | LGFVFTLTV | 1358 | 9 | unknown | | | | 849 | >72000 | 27500 | >93000 | 464 |

TABLE 17

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 1420.32 | SEAAYAKKI | 1359 | 9 | Artificial sequence | pool consensus | | A | 8609 | 308 | 129 | 1685 | 61 | 287 |
| 1420.33 | GEFPYKAAA | 1360 | 9 | Artificial sequence | pool consensus | | A | 286 | 170 | 3.9 | 746 | 2537 | 11 |
| 1420.34 | SEAPYKAIL | 1361 | 9 | Artificial sequence | pool consensus | | A | 2258 | 29 | 8.8 | 440 | 170 | 262 |
| 1420.35 | SEAPKYAIL | 1362 | 9 | Artificial sequence | pool consensus | | A | 2263 | 113 | 7.8 | 762 | 2260 | 479 |
| 1420.36 | AEFKYIAAV | 1363 | 9 | Artificial sequence | pool consensus | | A | 48 | 2.8 | 6.5 | 28 | 21 | 4.9 |
| 1420.37 | AEIPYLAKY | 1364 | 9 | Artificial sequence | pool consensus | | A | 116 | 7258 | 3159 | 44 | 30 | 668 |
| 1420.38 | AEIPKLAYF | 1365 | 9 | Artificial sequence | pool consensus | | A | 1641 | 57 | 5.6 | 229 | 57 | 608 |
| 33.0053 | FPFDYAAAF | 1366 | 9 | Artificial sequence | | | A | 141 | | | | | |
| 33.0055 | FPFKYKAAF | 1367 | 9 | Artificial sequence | | | A | 155 | | | | | |
| 33.0056 | FPFKYAKAF | 1368 | 9 | Artificial sequence | | | A | 86 | | | | | |
| 33.0059 | FPFKYAAAF | 1369 | 9 | Artificial sequence | | | A | 16 | | | | | |
| 33.0060 | FAFKYAAAF | 1370 | 9 | Artificial sequence | | | A | 95 | | | | | |
| 33.0064 | FQFKYAAAF | 1371 | 9 | Artificial sequence | | | A | 22 | | | | | |
| 33.0065 | FDFKYAAAF | 1372 | 9 | Artificial sequence | | | A | 187 | | | | | |
| 1420.09 | SENDRYRLL | 1373 | 9 | EBV | BZLF1 | 209 | A | 18281 | 271 | 23 | 183 | 164 | 1073 |
| 1420.08 | IEDPPYNSL | 1374 | 9 | EBV | lmp2 | 200 | A | 35457 | 16 | 688 | 15833 | 40075 | 18697 |
| 1420.29 | YEANGNLI | 1375 | 8 | Flu | HA | 259 | A | 191 | 7.9 | 7.0 | 516 | 3085 | 10342 |
| 1420.23 | YEDLRVLSF | 1376 | 9 | Flu | NP | 338 | A | 20 | 67 | 71 | 24 | 212 | 18697 |
| 1420.30 | SDYEGRLI | 1377 | 8 | Flu | NP | 50 | | >24800 | 27150 | 86 | 851 | 228 | 10469 |
| 1420.24 | GEISPYPSL | 1378 | 9 | Flu | NS1 | 158 | A | 19361 | 24 | 1.8 | 3564 | 293 | 115 |
| 1479.23 | MDIDPYKEF | 1379 | 9 | HBV | NUC | 30 | | 169477 | 3700 | 382 | 21744 | 1949 | 2615 |
| 1479.14 | LDKGIKPY | 1380 | 8 | HBV | POL | 125 | | >100000 | 17884 | 468 | >43192.49 | 19311 | 23609 |
| 1420.01 | ADLMGYIPL | 1381 | 9 | HCV | core | 131 | | >7616.71 | 959 | 4.7 | >21395.35 | 10292 | >49000 |
| 1420.07 | LDPYARVAI | 1382 | 9 | HCV | NS5b | 2663 | A | >24409.45 | >88888.89 | 372 | >41628.96 | >39766.08 | >49000 |
| 72.0527 | AENLWVTVY | 1383 | 9 | HIV | gp120 | 1 | | 155 | 1053 | 547 | 522 | 284 | 200 |
| 72.0528 | KENLWVTVY | 1384 | 9 | HIV | gp120 | 1 | A | 184 | 2738 | 373 | 308 | 306 | 6215 |
| 72.0530 | AEKLWVTVY | 1385 | 9 | HIV | gp120 | 1 | A | 286 | 18278 | 306 | 168 | 287 | 219 |
| 72.0531 | AENKWVTVY | 1386 | 9 | HIV | gp120 | 1 | A | 781 | 11303 | 534 | 294 | 540 | 297 |
| 72.0532 | AENLKVTVY | 1387 | 9 | HIV | gp120 | 1 | A | 138 | 7746 | 1075 | 253 | 487 | 9624 |
| 72.0533 | AENLWKTVY | 1388 | 9 | HIV | gp120 | 1 | A | 913 | 850 | 406 | 139 | 383 | 245 |
| 72.0534 | AENLWVKVY | 1389 | 9 | HIV | gp120 | 1 | A | 2735 | 1482 | 1696 | 708 | 105 | 132 |
| 72.0535 | AENLWVTKY | 1390 | 9 | HIV | gp120 | 1 | A | 511 | 1010 | 1998 | 355 | 1064 | 201 |
| 72.0536 | AENLWVTVK | 1391 | 9 | HIV | gp120 | 1 | A | 29464 | 853 | 2004 | 6305 | 2133 | 186 |
| 72.0537 | FENLWVTVY | 1392 | 9 | HIV | gp120 | 1 | A | 59 | 943 | 1336 | 4179 | 1312 | 21403 |
| 72.0538 | VENLWVTVY | 1393 | 9 | HIV | gp120 | 1 | A | 25 | 5499 | 5586 | 13454 | 4856 | 15654 |
| 72.0539 | PENLWVTVY | 1394 | 9 | HIV | gp120 | 1 | A | 190 | >72727.27 | >154545.45 | >167272.73 | >425000 | >49000 |
| 72.0540 | NENLWVTVY | 1395 | 9 | HIV | gp120 | 1 | A | 38 | >72727.27 | 11774 | 453 | 224 | 1668 |
| 72.0541 | DENLWVTVY | 1396 | 9 | HIV | gp120 | 1 | A | 26 | >72727.27 | 41098 | 4589 | 988 | 49000 |
| 72.0542 | TENLWVTVY | 1397 | 9 | HIV | gp120 | 1 | A | 14 | 14040 | 1415 | 291 | 364 | 5296 |
| 72.0543 | YENLWVTVY | 1398 | 9 | HIV | gp120 | 1 | A | 29 | 552 | 324 | 640 | 369 | 10701 |
| 72.0558 | ATNLWVIVY | 1399 | 9 | HIV | gp120 | 1 | A | 17615 | 487 | >154545.45 | 8912 | >43037.97 | >49000 |
| 72.0562 | AEFLWVTVY | 1400 | 9 | HIV | gp120 | 1 | A | 131 | 183 | 240 | 1013 | 156 | 472 |
| 72.0563 | AEVLWVTVY | 1401 | 9 | HIV | gp120 | 1 | A | 142 | 1549 | 436 | 1520 | 390 | 1244 |
| 72.0564 | AEPLWVTVY | 1402 | 9 | HIV | gp120 | 1 | A | 310 | 1727 | 2484 | 1322 | 96 | 1384 |
| 72.0565 | AEDLWVTVY | 1403 | 9 | HIV | gp120 | 1 | A | 354 | 423 | 3521 | 2329 | 469 | 1845 |
| 72.0566 | AENLWVTVY | 1404 | 9 | HIV | gp120 | 1 | | 122 | 1581 | 552 | 308 | 132 | 301 |
| 72.0567 | AETLWVTVY | 1405 | 9 | HIV | gp120 | 1 | A | 199 | 1052 | 198 | 501 | 221 | 774 |
| 72.0568 | AENFWVTVY | 1406 | 9 | HIV | gp120 | 1 | A | 182 | 1394 | 542 | 171 | 268 | 289 |
| 72.0569 | AENVWVTVY | 1407 | 9 | HIV | gp120 | 1 | A | 262 | 2238 | 386 | 1112 | 744 | 737 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 72.0570 | AENPWVTVY | 1408 | 9 | HIV | gp120 | 1 | A | 27 | 843 | 224 | 18 | 53 | 202 |
| 72.0571 | AENDWVTVY | 1409 | 9 | HIV | gp120 | 1 | A | 324 | 954 | 742 | 96 | 165 | 365 |
| 72.0572 | AENNWVTVY | 1410 | 9 | HIV | gp120 | 1 | A | 167 | 1161 | 357 | 214 | 162 | 99 |
| 72.0573 | AENTWVTVY | 1411 | 9 | HIV | gp120 | 1 | A | 213 | 1451 | 1793 | 386 | 166 | 442 |
| 72.0574 | AENLFVTVY | 1412 | 9 | HIV | gp120 | 1 | A | 29 | 970 | 334 | 357 | 125 | 232 |
| 72.0575 | AENLVVTVY | 1413 | 9 | HIV | gp120 | 1 | A | 62 | 876 | 1344 | 1030 | 203 | 718 |
| 72.0576 | AENLPVTVY | 1414 | 9 | HIV | gp120 | 1 | A | 20 | 205 | 566 | 356 | 126 | 246 |
| 72.0577 | AENLDVTVY | 1415 | 9 | HIV | gp120 | 1 | A | 517 | 220 | 12081 | 673 | 340 | 1291 |
| 72.0578 | AENLNVTVY | 1416 | 9 | HIV | gp120 | 1 | A | 198 | 564 | 3544 | 447 | 358 | 2445 |
| 72.0579 | AENLTVTVY | 1417 | 9 | HIV | gp120 | 1 | A | 153 | 689 | 1269 | 327 | 208 | 793 |
| 72.0580 | AENLWFTVY | 1418 | 9 | HIV | gp120 | 1 | A | 360 | 699 | 668 | 227 | 62 | 90 |
| 72.0581 | AENLWLTVY | 1419 | 9 | HIV | gp120 | 1 | A | 666 | 1702 | 884 | 647 | 226 | 227 |
| 72.0582 | AENLWPTVY | 1420 | 9 | HIV | gp120 | 1 | A | 661 | 690 | 688 | 157 | 50 | 116 |
| 72.0583 | AENLWDTVY | 1421 | 9 | HIV | gp120 | 1 | A | 775 | 1145 | 2090 | 414 | 68 | 263 |
| 72.0584 | AENLWNTVY | 1422 | 9 | HIV | gp120 | 1 | A | 336 | 1338 | 957 | 66 | 81 | 257 |
| 72.0585 | AENLWTTVY | 1423 | 9 | HIV | gp120 | 1 | A | 196 | 246 | 625 | 51 | 50 | 118 |
| 72.0586 | AENLWVFVY | 1424 | 9 | HIV | gp120 | 1 | A | 242 | 857 | 375 | 348 | 310 | 237 |
| 72.0587 | AENLWVVVY | 1425 | 9 | HIV | gp120 | 1 | A | 326 | 2728 | 1688 | 599 | 632 | 468 |
| 72.0588 | AENLWVPVY | 1426 | 9 | HIV | gp120 | 1 | A | 303 | 175 | 183 | 96 | 47 | 106 |
| 72.0589 | AENLWVDVY | 1427 | 9 | HIV | gp120 | 1 | A | 415 | 700 | 3440 | 334 | 92 | 242 |
| 72.0590 | AENLWVNVY | 1428 | 9 | HIV | gp120 | 1 | A | 317 | 1156 | 952 | 159 | 76 | 266 |
| 72.0591 | AENLWVSVY | 1429 | 9 | HIV | gp120 | 1 | A | 232 | 1251 | 1347 | 351 | 178 | 292 |
| 72.0592 | AENLWVTFY | 1430 | 9 | HIV | gp120 | 1 | A | 1299 | 1201 | 295 | 124 | 222 | 347 |
| 72.0593 | AENLWVTLY | 1431 | 9 | HIV | gp120 | 1 | A | 392 | 463 | 731 | 199 | 119 | 349 |
| 72.0594 | AENLWVTPY | 1432 | 9 | HIV | gp120 | 1 | A | 41 | 274 | 189 | 127 | 44 | 122 |
| 72.0595 | AENLWVTDY | 1433 | 9 | HIV | gp120 | 1 | A | 1001 | 930 | 1208 | 191 | 103 | 328 |
| 72.0596 | AENLWVTNY | 1434 | 9 | HIV | gp120 | 1 | A | 730 | 865 | 948 | 149 | 74 | 215 |
| 72.0597 | AENLWVTTY | 1435 | 9 | HIV | gp120 | 1 | A | 28 | 280 | 191 | 37 | 26 | 48 |
| 72.0598 | AENLWVTVA | 1436 | 9 | HIV | gp120 | 1 | A | 9689 | 557 | 4.8 | 1543 | 296 | 9.1 |
| 72.0599 | AENLWVTVC | 1437 | 9 | HIV | gp120 | 1 | A | 178026 | 157 | 1425 | 5593 | 2267 | 146 |
| 72.0601 | AENLWVTVE | 1438 | 9 | HIV | gp120 | 1 | A | >258333.33 | 3888 | 1362 | 8910 | 2573 | 246 |
| 72.0602 | AENLWVTVF | 1439 | 9 | HIV | gp120 | 1 | A | 365 | 162 | 20 | 346 | 162 | 262 |
| 72.0603 | AENLWVTVG | 1440 | 9 | HIV | gp120 | 1 | A | 39743 | 861 | 47 | 1812 | 245 | 35 |
| 72.0604 | AENLWVTVH | 1441 | 9 | HIV | gp120 | 1 | A | 16516 | 493 | 151 | 966 | 387 | 120 |
| 72.0605 | AENLWVTVI | 1442 | 9 | HIV | gp120 | 1 | A | 11224 | 14 | 7.3 | 237 | 88 | 54 |
| 72.0606 | AENLWVTVL | 1443 | 9 | HIV | gp120 | 1 | A | 6198 | 14 | 13 | 68 | 208 | 114 |
| 72.0607 | AENLWVTVM | 1444 | 9 | HIV | gp120 | 1 | A | 508 | 13 | 6.1 | 195 | 35 | 50 |
| 72.0608 | AENLWVTVN | 1445 | 9 | HIV | gp120 | 1 | A | 129167 | 6701 | 481 | 2623 | 414 | 169 |
| 72.0609 | AENLWVTVP | 1446 | 9 | HIV | gp120 | 1 | A | 38441 | 9711 | 339 | 7715 | 2473 | 187 |
| 72.0610 | AENLWVTVQ | 1447 | 9 | HIV | gp120 | 1 | A | 49640 | 522 | 85 | 1223 | 188 | 100 |
| 72.0611 | AENLWVTVR | 1448 | 9 | HIV | gp120 | 1 | A | 32979 | 1246 | 1744 | 4857 | 1474 | 233 |
| 72.0612 | AENLWVTVS | 1449 | 9 | HIV | gp120 | 1 | A | 25726 | 2163 | 103 | 4221 | 417 | 34 |
| 72.0613 | AENLWVTVT | 1450 | 9 | HIV | gp120 | 1 | A | 12331 | 947 | 7.8 | 2696 | 343 | 10 |
| 72.0614 | AENLWVTVV | 1451 | 9 | HIV | gp120 | 1 | A | 10709 | 84 | 19 | 5757 | 1432 | 35 |
| 72.0615 | AENLWVTVW | 1452 | 9 | HIV | gp120 | 1 | A | 22610 | 1304 | 135 | 423 | 324 | 204 |
| 1420.20 | AENLWVTVY | 1453 | 9 | HIV | gp120 | 1 | | 51 | 1358 | 90 | 66 | 43 | 68 |
| 1420.21 | AENLYVTVF | 1454 | 9 | HIV | gp120 | 1 | A | 61 | 17 | 3.1 | 39 | 47 | 69 |
| 73.0510 | TEPAAVGVGAV | 1455 | 11 | HIV | NEF | 33 | | >8115.18 | 930 | 391 | 1938 | 459 | 8235 |
| 73.0511 | AEPAAEGV | 1456 | 8 | HIV | NEF | 34 | | >8115.18 | 2070 | 2675 | >22604.42 | 402 | 6590 |
| 73.0512 | AEPAAEGVGA | 1457 | 10 | HIV | NEF | 34 | | >8115.18 | 4116 | 1655 | >22604.42 | >11447.81 | 104 |
| 73.0513 | AEPAAEGVGAV | 1458 | 11 | HIV | NEF | 34 | | >8611.11 | 20364 | 242 | >23896.1 | >11447.81 | 1499 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 73.0515 | QEEEEVGFPV | 1459 | 10 | HIV | NEF | 84 | | >8611.11 | 13117 | 2596 | 15203 | >11447.81 | 86 |
| 73.0516 | EEEEVGFPV | 1460 | 9 | HIV | NEF | 86 | | 3691 | 3340 | 417 | 7440 | 10313 | 37 |
| 73.0517 | EEEVGFPV | 1461 | 8 | HIV | NEF | 87 | | 427 | 9578 | 2605 | 6372 | >10461.54 | 227 |
| 73.0518 | EEVGFPVRPQV | 1462 | 11 | HIV | NEF | 88 | | >22794.12 | 9905 | 108 | 23777 | 6553 | 808 |
| 73.0519 | DEEVGFPV | 1463 | 8 | HIV | NEF | 89 | | 7.1 | >32000 | 4260 | 9305 | >10461.54 | 916 |
| 73.0522 | KEKGGLDGL | 1464 | 9 | HIV | NEF | 120 | | >22794.12 | 55 | 174 | >81415.93 | >10461.54 | 9926 |
| 73.0523 | KEKGGLDGLI | 1465 | 10 | HIV | NEF | 120 | | >22794.12 | 843 | 233 | 14726 | 3626 | 9986 |
| 73.0525 | QEILDLWV | 1466 | 8 | HIV | NEF | 184 | | >22794.12 | 142 | 1717 | >81415.93 | 5919 | 5504 |
| 73.0526 | QEILDLWVY | 1467 | 9 | HIV | NEF | 184 | | 52 | 740 | 4522 | 264 | 172 | 6261 |
| 64.0048 | AETFYVDGA | 1468 | 9 | HIV | POL | 629 | | >6709.96 | 21630 | 1923 | >21198.16 | 6924 | 38 |
| 78.0217 | EEKPRTLHDL | 1469 | 10 | HPV | E6 | 6 | | >81578.95 | 36208 | 34027 | 15236 | 30010 | 419 |
| 78.0425 | NEILIRCII | 1470 | 9 | HPV | E6 | 97 | | 5672 | 291 | 59 | 2722 | 258 | 3248 |
| 78.0426 | QEKKRHVDL | 1471 | 9 | HPV | E6 | 113 | | 7.3 | 15984 | 63093 | 443 | 211 | 12613 |
| 9002.0021 | AEGKEVLL | 1472 | 8 | Human | CEA | 46 | | 11455 | 1311 | 5303 | 17268 | 129 | 14165 |
| 9002.0025 | QELFIPNI | 1473 | 8 | Human | CEA | 282 | | 127 | 5815 | 147 | 752 | 8.5 | 1319 |
| 9002.0028 | QELFISNI | 1474 | 8 | Human | CEA | 460 | | 889 | 6396 | 1175 | 2282 | 70 | 1172 |
| 9002.0029 | TEKNSGLY | 1475 | 8 | Human | CEA | 468 | | 211 | 9851 | 7117 | 1868 | 605 | 10248 |
| 9002.0030 | AELPKPSI | 1476 | 8 | Human | CEA | 498 | | 7423 | 6697 | 131 | 1164 | 19 | 2608 |
| 9002.0031 | PEAQNTTY | 1477 | 8 | Human | CEA | 525 | | 149 | 2594 | 2437 | 2204 | 76 | 3255 |
| 9002.0055 | IESTPFNVA | 1478 | 9 | Human | CEA | 38 | | 69 | 1234 | 66 | 18749 | 0.97 | 15 |
| 9002.0056 | AEGKEVLLL | 1479 | 9 | Human | CEA | 46 | | 1080 | 72 | 147 | 178 | 1.7 | 199 |
| 9002.0057 | EEATGQFRV | 1480 | 9 | Human | CEA | 132 | | 805 | 5563 | 470 | 1691 | 95 | 18 |
| 9002.0058 | VEDKDAVAF | 1481 | 9 | Human | CEA | 157 | | 94 | 121 | 1583 | 1661 | 1443 | 21204 |
| 9002.0059 | CEPETQDAT | 1482 | 9 | Human | CEA | 167 | | 4009 | 3646 | 410 | 23421 | 50 | 97 |
| 9002.0060 | PETQDATYL | 1483 | 9 | Human | CEA | 169 | | 9473 | 1240 | 33745 | >34586.47 | 301 | 13430 |
| 9002.0061 | CETQNPVSA | 1484 | 9 | Human | CEA | 215 | | 73 | 7016 | 261 | 20023 | 10.0 | 15 |
| 9002.0062 | QELFIPNIT | 1485 | 9 | Human | CEA | 282 | | 125 | 4361 | 172 | 1217 | 3.0 | 18 |
| 9002.0063 | AEPPKPFIT | 1486 | 9 | Human | CEA | 320 | | 12850 | 7067 | 7170 | >34586.47 | 232 | 1813 |
| 9002.0064 | VEDEDAVAL | 1487 | 9 | Human | CEA | 335 | | 840 | 11 | 2665 | 30667 | 51 | 27810 |
| 9002.0065 | CEPEIQNTT | 1488 | 9 | Human | CEA | 345 | | 6889 | 5709 | 3081 | 31834 | 120 | 2732 |
| 9002.0066 | PEIQNTTYL | 1489 | 9 | Human | CEA | 347 | | 923 | 138 | 2786 | 16816 | 231 | 1825 |
| 9002.0067 | YECGIQNEL | 1490 | 9 | Human | CEA | 391 | | 82 | 71 | 53 | 452 | 5.3 | 855 |
| 9002.0068 | QELFISNIT | 1491 | 9 | Human | CEA | 460 | | 530 | 6571 | 58 | 2334 | 3.9 | 80 |
| 9002.0069 | TEKNSGLYT | 1492 | 9 | Human | CEA | 468 | | 1113 | 7522 | 3195 | 10097 | 101 | 1963 |
| 9002.0158 | AEGKEVLLLV | 1493 | 10 | Human | CEA | 46 | | 5135 | 1019 | 408 | 479 | 8.6 | 994 |
| 9002.0159 | KEVLLLVHNL | 1494 | 10 | Human | CEA | 49 | | 893 | 3.1 | 4.4 | 414 | 2.3 | 2512 |
| 9002.0160 | GERVDGNRQI | 1495 | 10 | Human | CEA | 70 | | 9395 | 1933 | 369 | 3900 | 13 | 19464 |
| 9002.0161 | REIIYPNASL | 1496 | 10 | Human | CEA | 98 | | 741 | 2.3 | 7.5 | 374 | 1.7 | 954 |
| 9002.0162 | NEEATGQFRV | 1497 | 10 | Human | CEA | 131 | | 998 | 29086 | 22678 | 4365 | 471 | 405 |
| 9002.0163 | EEATGQFRVY | 1498 | 10 | Human | CEA | 132 | | 64 | >33333.33 | 55956 | 29 | 1041 | 1374 |
| 9002.0167 | GENLNLSCHA | 1499 | 10 | Human | CEA | 252 | | 14373 | 1341 | 357 | 8610 | 5.3 | 271 |
| 9002.0168 | QELFIPNITV | 1500 | 10 | Human | CEA | 282 | | 81 | 121 | 27 | 93 | 2.6 | 14 |
| 9002.0170 | CEPEIQNTTY | 1501 | 10 | Human | CEA | 345 | | 1459 | >10322.58 | 35697 | 49 | 14596 | 43739 |
| 9002.0171 | PEIQNTTYLW | 1502 | 10 | Human | CEA | 347 | | 819 | 3301 | 9423 | 13 | 6173 | 10011 |
| 9002.0172 | CEPEAQNTTY | 1503 | 10 | Human | CEA | 523 | | 9525 | >12903.23 | >48571.43 | 61 | >4268.68 | 17330 |
| 9002.0173 | PEAQNTTYLW | 1504 | 10 | Human | CEA | 525 | | 17082 | >9248.55 | >12592.59 | 27 | 21243 | >28654.97 |
| 9002.0257 | MESPSAPPHRW | 1505 | 11 | Human | CEA | 1 | | 12 | 943 | 1915 | 5.3 | 41 | 359 |
| 9002.0258 | IESTPFNVAEG | 1506 | 11 | Human | CEA | 38 | | 87 | 1074 | 352 | 89 | 8.7 | 84 |
| 9002.0259 | GERVDGNRQII | 1507 | 11 | Human | CEA | 70 | | 764 | 278 | 18 | 871 | 1.3 | 27084 |
| 9002.0260 | REIIYPNASLL | 1508 | 11 | Human | CEA | 98 | | 1788 | 2.4 | 12 | 57 | 0.38 | 1777 |
| 9002.0261 | NEEATGQFRVY | 1509 | 11 | Human | CEA | 131 | | 7.7 | 3252 | 999 | 9.6 | 69 | 3986 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 9002.0262 | CEPETQDATYL | 1510 | 11 | Human | CEA | 167 | | 831 | 311 | 3388 | 398 | 807 | 62150 |
| 9002.0264 | GENLNLSCHAA | 1511 | 11 | Human | CEA | 252 | | 7838 | 4557 | 63 | 1907 | 9.0 | 32 |
| 9002.0265 | CEPEIQNTTYL | 1512 | 11 | Human | CEA | 345 | | 129 | 287 | 1603 | 1245 | 60 | 11981 |
| 9002.0266 | PEIQNTTYLWW | 1513 | 11 | Human | CEA | 347 | | 172 | 749 | 1045 | 17 | 227 | 1365 |
| 9002.0267 | YECGIQNELSV | 1514 | 11 | Human | CEA | 391 | | 9.2 | 33 | 26 | 1714 | 0.46 | 155 |
| 9002.0268 | NELSVDHSDPV | 1515 | 11 | Human | CEA | 397 | | 49 | 2554 | 1128 | 1615 | 38 | 78 |
| 9002.0269 | CEPEAQNTTYL | 1516 | 11 | Human | CEA | 523 | | 962 | 2184 | 11723 | 3419 | 131 | 2450 |
| 9002.0270 | PEAQNTTYLWW | 1517 | 11 | Human | CEA | 525 | | 147 | 2096 | 3090 | 121 | 79 | 2005 |
| 9002.0336 | PEIQNTTYLWWV | 1518 | 12 | Human | CEA | 347 | | 644 | 1808 | 1539 | 481 | 93 | 994 |
| 9002.0337 | PEAQNTTYLWWV | 1519 | 12 | Human | CEA | 525 | | 20 | 1694 | 646 | 5.1 | | 3.3 |
| 9002.0356 | CEPEIQNTTYLWW | 1520 | 13 | Human | CEA | 345 | | 84 | 858 | 3168 | 7.9 | 409 | 1243 |
| 1420.25 | AEMGKGSFKY | 1521 | 10 | Human | elong. Factor Tu | 48 | | 1618 | 6427 | 3820 | 112 | 90 | 305 |
| 9002.0003 | SEDCQSL | 1522 | 7 | Human | Her2/neu | 209 | | 18245 | 2691 | 14258 | 8248 | 431 | 19225 |
| 9002.0004 | REVRAVT | 1523 | 7 | Human | Her2/neu | 351 | | 8564 | 3136 | 725 | 31615 | 29 | 23544 |
| 9002.0005 | FETLEEI | 1524 | 7 | Human | Her2/neu | 400 | | 1518 | 7621 | 2110 | 42991 | 69 | 67957 |
| 9002.0007 | TELVEPL | 1525 | 7 | Human | Her2/neu | 694 | | 162 | 14164 | 1258 | 8854 | 66 | >148484.85 |
| 9002.0010 | SECRPRF | 1526 | 7 | Human | Her2/neu | 963 | | 926 | 18181 | 1157 | 852 | 48 | 8856 |
| 9002.0032 | PETHLDML | 1527 | 8 | Human | Her2/neu | 39 | | 1954 | 8387 | 6118 | >17523.81 | 83 | 20257 |
| 9002.0033 | QEVQGYVL | 1528 | 8 | Human | Her2/neu | 78 | | 3.4 | 28 | 5.0 | 1210 | 0.92 | 33 |
| 9002.0034 | RELQLRSL | 1529 | 8 | Human | Her2/neu | 138 | | 42 | 49 | 5.9 | 2025 | 0.62 | 1372 |
| 9002.0035 | CELHCPAL | 1530 | 8 | Human | Hea/neu | 264 | | 150 | 871 | 259 | 4361 | 39 | 30089 |
| 9002.0036 | LEEITGYL | 1531 | 8 | Human | Her2/neu | 403 | | 242 | 830 | 1805 | 5913 | 403 | 35502 |
| 9002.0037 | EEITGYLY | 1532 | 8 | Human | Her2/neu | 404 | | 20 | 5713 | 1223 | 11 | 83 | 238 |
| 9002.0038 | DECVGEGL | 1533 | 8 | Human | Her2/neu | 502 | | 49 | 4864 | 481 | 938 | 34 | 14244 |
| 9002.0039 | AEQRASPL | 1534 | 8 | Human | Her2/neu | 644 | | 16 | 73 | 13 | 211 | 0.38 | 120 |
| 9002.0040 | KEILDEAY | 1535 | 8 | Human | Her2/neu | 765 | | 82 | 921 | 430 | 1081 | 74 | 2646 |
| 9002.0041 | EEAPRSPL | 1536 | 8 | Human | Her2/neu | 1068 | | 1191 | 3489 | 1611 | 1593 | 171 | 1926 |
| 9002.0042 | SEDPTVPL | 1537 | 8 | Human | Her2/neu | 1113 | | 103 | 71 | 161 | 12267 | 2.0 | 308 |
| 9002.0072 | MELAALCRW | 1538 | 9 | Human | Her2/neu | 1 | | 7.0 | 4833 | 138 | 16 | 9.9 | 1183 |
| 9002.0073 | QEVQGYVLI | 1539 | 9 | Human | Her2/neu | 78 | | 77 | 206 | 39 | 30 | 0.50 | 96 |
| 9002.0074 | FEDNYALAV | 1540 | 9 | Human | Her2/neu | 108 | | 12 | 34 | 5.1 | 13470 | 0.17 | 131 |
| 9002.0075 | RELQLRSLT | 1541 | 9 | Human | Her2/neu | 138 | | 638 | 316 | 13 | 465 | 0.20 | 162 |
| 9002.0076 | TEILKGGVL | 1542 | 9 | Human | Her2/neu | 146 | | 125 | 30 | 14 | 1377 | 0.28 | 2480 |
| 9002.0077 | HEQCAAGCT | 1543 | 9 | Human | Her2/neu | 237 | | 1995 | 42164 | 7377 | 19048 | 178 | 2974 |
| 9002.0078 | CELHCPALV | 1544 | 9 | Human | Her2/neu | 264 | | 136 | 4805 | 319 | 2308 | 52 | 1110 |
| 9002.0079 | FESMPNPEG | 1545 | 9 | Human | Her2/neu | 279 | | 6068 | 30237 | 59 | 16458 | 14 | 155 |
| 9002.0081 | QEVTAEDGT | 1546 | 9 | Human | Her2/neu | 320 | | 5207 | 31081 | 3122 | 7886 | 66 | 1843 |
| 9002.0082 | CEKCSKPCA | 1547 | 9 | Human | Her2/neu | 331 | | 3740 | 27386 | 2703 | 19957 | 342 | 8007 |
| 9002.0083 | MEHLREVRA | 1548 | 9 | Human | Her2/neu | 347 | | 233 | 44754 | 386 | 38 | 3.2 | 19 |
| 9002.0084 | REVRAVTSA | 1549 | 9 | Human | Her2/neu | 351 | | 626 | 427 | 0.71 | 3160 | 0.18 | 9.3 |
| 9002.0085 | QEFAGCKKI | 1550 | 9 | Human | Her2/neu | 362 | | 1120 | 736 | 131 | 81 | 44 | 2684 |
| 9002.0090 | EEITGYLYI | 1551 | 9 | Human | Her2/neu | 404 | | 86 | 906 | 916 | 12 | 121 | 94 |
| 9002.0091 | RELGSGLAL | 1552 | 9 | Human | Her2/neu | 459 | | 359 | 3.7 | 0.85 | 457 | 0.97 | 2262 |
| 9002.0094 | GEGLACHQL | 1553 | 9 | Human | Her2/neu | 506 | | 13766 | 187 | 88 | 112 | 11 | 340 |
| 9002.0095 | QECVEECRV | 1554 | 9 | Human | Her2/neu | 538 | | 15799 | 8755 | 1664 | 7150 | 210 | 4542 |
| 9002.0096 | VEECRVLQG | 1555 | 9 | Human | Her2/neu | 541 | | 1528 | 8947 | 7622 | 14202 | 305 | 20142 |
| 9002.0097 | EECRVLQGL | 1556 | 9 | Human | Her2/neu | 542 | | 890 | 7076 | 2029 | 717 | 434 | 1185 |
| 9002.0098 | AEQRASPLT | 1551 | 9 | Human | Her2/neu | 644 | | 346 | 874 | 183 | 103 | 1.8 | 10 |
| 9002.0099 | QETELVEPL | 1558 | 9 | Human | Her2/neu | 692 | | 12 | 62 | 85 | 681 | 3.5 | 1232 |
| 9002.0100 | VEPLTPSGA | 1559 | 9 | Human | Her2/neu | 697 | | 7321 | >9638.55 | 11 | 8516 | 191 | 17037 |
| 9002.0101 | TELRKVKVL | 1560 | 9 | Human | Her2/neu | 718 | | 1514 | 4698 | 54 | 2128 | 2.5 | 14147 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 9002.0102 | GENVKIPVA | 1561 | 9 | Human | Her2/neu | 743 | | 10755 | 14510 | 7.5 | 20309 | 2.7 | 7.0 |
| 9002.0103 | KEILDEAYV | 1562 | 9 | Human | Her2/neu | 765 | | 1358 | 62 | 146 | 6466 | 8.4 | 42 |
| 9002.0104 | DEAYVMAGV | 1563 | 9 | Human | Her2/neu | 769 | | 58 | 5327 | 1245 | 8006 | 138 | 161 |
| 9002.0105 | DETEYHADG | 1564 | 9 | Human | Her2/neu | 873 | | 159 | >11940.3 | >65384.62 | >24403.18 | 1397 | 13353 |
| 9002.0106 | LESILRRRF | 1565 | 9 | Human | Her2/neu | 891 | | 29 | >11940.3 | 3475 | 4.7 | 101 | 12918 |
| 9002.0107 | GERLPQPPI | 1566 | 9 | Human | Her2/neu | 938 | | 62 | 71 | 15 | 63 | 1.1 | 15 |
| 9002.0108 | LEDDDMGDL | 1567 | 9 | Human | Her2/neu | 1009 | | 191 | 556 | 351 | 947 | 900 | 6251 |
| 9002.0109 | EEYLVPQQG | 1568 | 9 | Human | Her2/neu | 1021 | | 66 | 10344 | 136 | 651 | 126 | 131 |
| 9002.0110 | EEEAPRSPL | 1569 | 9 | Human | Her2/neu | 1067 | | 902 | 4490 | 2881 | 342 | 362 | 307 |
| 9002.0111 | EEAPRSPLA | 1570 | 9 | Human | Her2/neu | 1068 | | 486 | 10707 | 4900 | 180 | 294 | 4.5 |
| 9002.0112 | SEGAGSDVF | 1571 | 9 | Human | Her2/neu | 1078 | | 74 | 5627 | 6525 | 69 | 192 | 6960 |
| 9002.0113 | PEYVNQPDV | 1572 | 9 | Human | Her2/neu | 1137 | | 831 | 3437 | 1581 | 1109 | 48 | 2536 |
| 9002.0114 | PEYLTPQGG | 1573 | 9 | Human | Her2/neu | 1194 | | 1456 | 18951 | 13860 | 6532 | 284 | 18990 |
| 9002.0115 | PERGAPPST | 1574 | 9 | Human | Her2/neu | 1228 | | 385 | 4744 | 7679 | 1116 | 178 | 7767 |
| 9002.0116 | AENPEYLGL | 1575 | 9 | Human | Her2/neu | 1243 | | 17 | 81 | 271 | 44 | 2.5 | 155 |
| 9002.0174 | MELAALCRWG | 1576 | 10 | Human | Her2/neu | 1 | | 102 | 8684 | 1840 | 5.7 | 135 | 408 |
| 9002.0175 | LELTYLPTNA | 1577 | 10 | Human | Her2/neu | 60 | | 332 | 325 | 10.4 | 6428 | 3.1 | 24 |
| 9002.0176 | QEVQGYVLIA | 1578 | 10 | Human | Her2/neu | 78 | | 61 | 772 | 64 | 1871 | 15 | 11 |
| 9002.0177 | FEDNYALAVL | 1512 | 10 | Human | Her2/neu | 108 | | 321 | 6.2 | 48 | 2844 | 3.8 | 3095 |
| 9002.0178 | TEILKGGVLI | 1580 | 10 | Human | Her2/neu | 146 | | 1021 | 241 | 294 | 24 | 21 | 7600 |
| 9002.0179 | GESSEDCQSL | 1581 | 10 | Human | Her2/neu | 206 | | 138636 | 8.1 | 23 | 427 | 5.1 | 2491 |
| 9002.0180 | SEDCQSLTRT | 1582 | 10 | Human | Her2/neu | 209 | | 335 | 8550 | 11529 | 518 | 2857 | 4726 |
| 9002.0182 | CELHCPALVT | 1583 | 10 | Human | Her2/neu | 264 | | 80 | >9248.55 | 65 | 933 | 18 | 477 |
| 9002.0183 | MEHLREVRAV | 1584 | 10 | Human | Her2/neu | 347 | | 72 | 20684 | 160 | 180 | 13 | 140 |
| 9002.0184 | QEFAGCKKIF | 1585 | 10 | Human | Her2/neu | 362 | | 53 | 3686 | 12 | 4.0 | 3.6 | 115 |
| 9002.0186 | FETLEEITGY | 1586 | 10 | Human | Her2/neu | 400 | | 671 | 53363 | 36302 | 262 | 1679 | >28488.37 |
| 9002.0187 | LEEITGYLYI | 1587 | 10 | Human | Her2/neu | 403 | | 143 | 914 | 2996 | 222 | 143 | 1488 |
| 9002.0188 | RELGSGLALI | 1588 | 10 | Human | Her2/neu | 459 | | 4810 | 22 | 4.4 | 32 | 0.78 | 173 |
| 9002.0189 | PEDECVGEGL | 1589 | 10 | Human | Her2/neu | 500 | | 1257 | 278 | 257 | 6331 | 49 | 24019 |
| 9002.0190 | QECVEECRVL | 1590 | 10 | Human | Her2/neu | 538 | | 315 | 444 | 399 | 606 | 22 | 2863 |
| 9002.0191 | VEECRVLQGL | 1591 | 10 | Human | Her2/neu | 541 | | 270 | 227 | 5815 | 237 | 189 | 16094 |
| 9002.0192 | REYVNARHCL | 1592 | 10 | Human | Her2/neu | 552 | | 1327 | 39 | 4.8 | 106 | 0.97 | 126 |
| 9002.0193 | PECQPQNGSV | 1593 | 10 | Human | Her2/neu | 565 | | 7962 | 35957 | 20374 | 12964 | 472 | >28488.37 |
| 9002.0195 | EEGACQPCPI | 1594 | 10 | Human | Her2/neu | 619 | | 119 | 40113 | 340 | 52 | 80 | 401 |
| 9002.0196 | QETELVEPLT | 1595 | 10 | Human | Her2/neu | 692 | | 15 | 293 | 338 | 1619 | 13 | 288 |
| 9002.0197 | VEPLTPSGAM | 1596 | 10 | Human | Her2/neu | 697 | | 4649 | 1667 | 584 | 4368 | 108 | 20167 |
| 9002.0198 | KETELRKVKV | 1597 | 10 | Human | Her2/neu | 716 | | 11925 | 26700 | 68 | 2936 | 4.5 | 1603 |
| 9002.0199 | TELRKVKVLG | 1598 | 10 | Human | Her2/neu | 718 | | 721 | 20312 | 601 | 3650 | 14 | 12816 |
| 9002.0200 | GENVKIPVAI | 1599 | 10 | Human | Her2/neu | 743 | | 563 | 314 | 28 | 230 | 6.7 | 198 |
| 9002.0201 | KEILDEAYVM | 1600 | 10 | Human | Her2/neu | 765 | | 0.14 | 10 | 153 | 35 | 7.5 | 234 |
| 9002.0202 | DEAYVMAGVG | 1601 | 10 | Human | Her2/neu | 769 | | 122 | 203 | 154 | 4033 | 4102 | 218 |
| 9002.0203 | DETEYHADGG | 1602 | 10 | Human | Her2/neu | 873 | | 613 | 45291 | 16801 | 3891 | 269 | 29025 |
| 9002.0204 | TEYHADGGKV | 1603 | 10 | Human | Her2/neu | 875 | | 239 | 5246 | 2003 | 2911 | 15 | 1571 |
| 9002.0205 | LESILRRRFT | 1604 | 10 | Human | Her2/neu | 891 | | 82 | 28476 | 1189 | 34 | 87 | 2251 |
| 9002.0206 | REIPDLLEKG | 1605 | 10 | Human | Her2/neu | 929 | | 649 | 4493 | 814 | 1270 | 13 | 1977 |
| 9002.0207 | SECRPRFREL | 1606 | 10 | Human | Her2/neu | 963 | | 80 | 307 | 18 | 11 | 0.20 | 25 |
| 9002.0208 | RELVSEFSRM | 1607 | 10 | Human | Her2/neu | 970 | | 9.1 | 28 | 4.3 | 33 | 0.12 | 1726 |
| 9002.0209 | NEDLGPASPL | 1608 | 10 | Human | Her2/neu | 991 | | 107 | 281 | 150 | 40 | 6.0 | 231 |
| 9002.0211 | AEEYLVPQQG | 1609 | 10 | Human | Her2/neu | 1020 | | 723 | 66699 | 24424 | 417 | 479 | 127 |
| 9002.0212 | EEYLVPQQGF | 1610 | 10 | Human | Her2/neu | 1021 | | 2.1 | 26569 | 2551 | 6.9 | 11 | 73 |
| 9002.0213 | SEEEAPRSPL | 1611 | 10 | Human | Her2/neu | 1066 | | 151 | 155 | 217 | 37 | 8.4 | 84 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 9002.0214 | EEEAPRSPLA | 1612 | 10 | Human | Her2/neu | 1067 | | 6611 | 49549 | 38943 | 425 | 960 | 14 |
| 9002.0215 | SETDGYVAPL | 1613 | 10 | Human | Her2/neu | 1122 | | 94 | 214 | 184 | 386 | 2.4 | 302 |
| 9002.0218 | PERGAPPSTF | 1614 | 10 | Human | Her2/neu | 1228 | | 1062 | 14884 | 3437 | 6871 | 208 | 15700 |
| 9002.0219 | PEYLGLDVPV | 1615 | 10 | Human | Her2/neu | 1246 | | 613 | 352 | 35 | 1371 | 1.7 | 610 |
| 9002.0271 | MELAALCRWGL | 1616 | 11 | Human | Her2/neu | 1 | | 6.4 | 24 | 30 | 17 | 0.92 | 116 |
| 9002.0272 | PETHLDMLRHL | 1617 | 11 | Human | Her2/neu | 39 | | 1322 | 700 | 2971 | 11534 | 70 | 4329 |
| 9002.0273 | RELQLRSLTEI | 1618 | 11 | Human | Her2/neu | 138 | | 261 | 2.8 | 3.7 | 125 | 0.99 | 269 |
| 9002.0274 | GESSEDCQSLT | 1619 | 11 | Human | Her2/neu | 206 | | 742 | 48 | 180 | 14386 | 40 | 2158 |
| 9002.0275 | SEDCQSLTRTV | 1620 | 11 | Human | Her2/neu | 209 | | 101 | 4322 | 311 | 943 | 21 | 10 |
| 9002.0276 | CELHCPALVTY | 1621 | 11 | Human | Her2/neu | 264 | | 12 | 3469 | 3198 | 140 | 89 | 2779 |
| 9002.0277 | FESMPNPEGRY | 1622 | 11 | Human | Her2/neu | 279 | | 74 | 3666 | 3533 | 59 | 70 | 1394 |
| 9002.0278 | CEKCSKPCARV | 1623 | 11 | Human | Her2/neu | 331 | | 1167 | 4103 | 2079 | 9594 | 101 | 1561 |
| 9002.0279 | MEHLREVRAVT | 1624 | 11 | Human | Her2/neu | 347 | | 1064 | 3614 | 2207 | 795 | 111 | 74 |
| 9002.0280 | REVRAVTSANI | 1625 | 11 | Human | Her2/neu | 351 | | 4491 | 17 | 30 | 1680 | 1.8 | 421 |
| 9002.0281 | QEFAGCKKIFG | 1626 | 11 | Human | Her2/neu | 362 | | 211 | 314 | 477 | 37 | 2.1 | 138 |
| 9002.0282 | FETLEEITGYL | 1627 | 11 | Human | Her2/neu | 400 | | 133 | 78 | 649 | 7490 | 42 | 2200 |
| 9002.0283 | EEITGYLYISA | 1628 | 11 | Human | Her2/neu | 404 | | 0.94 | 1440 | 52 | 4.5 | 2.1 | 0.9 |
| 9002.0285 | GEGLACHQLCA | 1629 | 11 | Human | Her2/neu | 506 | | 62 | 39 | 97 | 159 | 2.7 | 196 |
| 9002.0287 | DEEGACQPCPI | 1630 | 11 | Human | Her2/neu | 618 | | 451 | 5517 | 7293 | 968 | 438 | 1323 |
| 9002.0288 | AEQRASPLTSI | 1631 | 11 | Human | Her2/neu | 644 | | 467 | 19 | 58 | 5.1 | 2.5 | 11 |
| 9002.0289 | TELVEPLTPSG | 1632 | 11 | Human | Her2/neu | 694 | | 601 | 2978 | 3703 | >21052.63 | 269 | 14079 |
| 9002.0290 | KETELRKVKVL | 1633 | 11 | Human | Her2/neu | 716 | | 9529 | 2973 | 1868 | 7136 | 71 | 12237 |
| 9002.0291 | KEILDEAYVMA | 1634 | 11 | Human | Her2/neu | 765 | | 731 | 252 | 95 | 11514 | 64 | 123 |
| 9002.0292 | LEDVRLVHRDL | 1635 | 11 | Human | Her2/neu | 836 | | 729 | 325 | 641 | 818 | 59 | 2382 |
| 9002.0293 | WELMTFGAKPY | 1636 | 11 | Human | Her2/neu | 913 | | 13 | 509 | 778 | 24 | 75 | 1216 |
| 9002.0294 | GERLPQPPICT | 1637 | 11 | Human | Her2/neu | 938 | | 12486 | 24270 | 23 | 9094 | 3.9 | 15 |
| 9002.0295 | SECRPRFRELV | 1638 | 11 | Human | Her2/neu | 963 | | 1996 | 3673 | 121 | 927 | 18 | 118 |
| 9002.0296 | RELVSEFSRMA | 1639 | 11 | Human | Her2/neu | 970 | | 168 | 389 | 143 | 2613 | 3.5 | 32 |
| 9002.0297 | AEEYLVPQQGF | 1640 | 11 | Human | Her2/neu | 1020 | | 125 | 584 | 1831 | 21 | 99 | 268 |
| 9002.0298 | EEYLVPQQGFF | 1641 | 11 | Human | Her2Jneu | 1021 | | 94 | 4291 | 1695 | 78 | 168 | 154 |
| 9002.0299 | SEEEAPRSPLA | 1642 | 11 | Human | Her2/neu | 1066 | | 1318 | 3604 | 5110 | 8550 | 158 | 27 |
| 9002.0300 | SEGAGSDVFDG | 1643 | 11 | Human | Her2/neu | 1078 | | 928 | 3751 | 5695 | 374 | 286 | 3008 |
| 9002.0301 | SETDGYVAPLT | 1644 | 11 | Human | Her2/neu | 1122 | | 66 | 125 | 224 | 1225 | 2.2 | 45 |
| 9002.0302 | REGPLPAARPA | 1645 | 11 | Human | Her2/neu | 1153 | | 157 | 543 | 78 | 32906 | 4.2 | 347 |
| 9002.0303 | VENPEYLTPQG | 1646 | 11 | Human | Her2/neu | 1191 | | 8386 | 56393 | 42593 | 17337 | 11 | 4188 |
| 9002.0304 | PEYLTPQGGAA | 1647 | 11 | Human | Her2/neu | 1194 | | 1724 | 41026 | 200 | >17829.46 | 354 | 1382 |
| 9002.0305 | AENPEYLGLDV | 1648 | 11 | Human | Her2/neu | 1243 | | 11934 | 28 | 139 | 69 | 3.0 | 24 |
| 9002.0338 | LELTYLPTNASL | 1649 | 12 | Human | Her2/neu | 60 | | 12 | 25 | 102 | 386 | 6.8 | 11 |
| 9002.0339 | RELQLRSLTEIL | 1650 | 12 | Human | Her2/neu | 138 | | 5954 | 151 | 600 | 3778 | 1.1 | 1371 |
| 9002.0340 | PEGRYTFGASCV | 1651 | 12 | Human | Her2/neu | 285 | | 4071 | 2.9 | 4.4 | 778 | | 116 |
| 9002.0341 | LEEITGYLYISA | 1652 | 12 | Human | Her2/neu | 403 | | 209 | 28 | 31 | 263 | 18 | 694 |
| 9002.0342 | EEITGYLYISAW | 1653 | 12 | Human | Her2/neu | 404 | | 746 | 478 | 1800 | 252 | | 1492 |
| 9002.0343 | PEADQCVACAHY | 1654 | 12 | Human | Her2/neu | 579 | | 901 | 4050 | 5127 | 213 | | 463 |
| 9002.0344 | TELVEPLTPSGA | 1655 | 12 | Human | Her2/neu | 694 | | 236 | 2059 | 59 | 2132 | | 206 |
| 9002.0345 | TEYHADGGKVPI | 1656 | 12 | Human | Her2/neu | 875 | | 680 | 22 | 4.4 | 2177 | | 61 |
| 9002.0346 | GERLPQPPICTI | 1657 | 12 | Human | Her2/neu | 938 | | 17769 | 162 | 3.9 | 292 | | 2.5 |
| 9002.0347 | AEEYLVPQQGFF | 1658 | 12 | Human | Her2/neu | 1020 | | 144 | 228 | 45 | 16 | | 13 |
| 9002.0357 | PEGRYTFGASCVT | 1659 | 13 | Human | Her2/neu | 285 | | 5228 | 3793 | 737 | 1419 | 267 | 673 |
| 9002.0358 | CEKCSKPCARVCY | 1660 | 13 | Human | Her2/neu | 331 | | 701 | >53333.33 | 406 | 302 | 44 | 1315 |
| 9002.0359 | MEHLREVRAVTSA | 1661 | 13 | Human | Her2/neu | 347 | | 70 | 669 | 72 | 144 | 18 | 12 |
| 9002.0361 | DECVGEGLACHQL | 1662 | 13 | Human | Her2/neu | 502 | | 464 | 2635 | 3668 | 2544 | 212 | 2063 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 9002.0362 | PECQPQNGSVTCF | 1663 | 13 | Human | Her2/neu | 565 | | 6293 | 381 | 5338 | 3564 | 375 | >22374.43 |
| 9002.0363 | RENTSPKANKEIL | 1664 | 13 | Human | Her2/neu | 756 | | 7750 | 3.7 | 77 | >2540.03 | 3.9 | 1510 |
| 9002.0364 | REIPDLLEKGERL | 1665 | 13 | Human | Her2/neu | 929 | | 7636 | 40 | 136 | 3050 | 16 | 2710 |
| 9002.0365 | SEFSRMARDPQRF | 1666 | 13 | Human | Her2/neu | 974 | | 61 | 350 | 57 | 23 | 12 | 247 |
| 9002.0366 | SEGAGSDVFDGDL | 1667 | 13 | Human | Her2/neu | 1078 | | 5172 | 45 | 2059 | 1303 | 711 | 2458 |
| 1420.10 | GEFGGYGSV | 1668 | 9 | Human | Histactranf | 127 | A | 307 | 112 | 6.4 | 2335 | 534 | 40 |
| 9001.0074 | LWQLNGRLEYTLKI | 1669 | 15 | Human | IFN-B | 21 | A | | | | | 0.11 | |
| 9002.0012 | SEFQAAI | 1670 | 7 | Human | MAGE2 | 103 | | 181 | 6830 | 779 | 2660 | 33 | 9597 |
| 9002.0013 | SEYLQLV | 1671 | 7 | Human | MAGE2 | 155 | | 1375 | 7777 | 658 | 733 | 21 | 930 |
| 9002.0014 | WEELSML | 1672 | 7 | Human | MAGE2 | 222 | | 1288 | 781 | 740 | >28482.97 | 151 | 82009 |
| 9002.0017 | GEPHISY | 1673 | 7 | Human | MAGE2 | 295 | | 8833 | 12272 | 6716 | 36116 | 272 | >33333.33 |
| 9002.0043 | LEARGEAL | 1674 | 8 | Human | MAGE2 | 16 | | 163 | 99 | 65 | 29495 | 2.9 | 31463 |
| 9002.0044 | QEEEGPRM | 1675 | 8 | Human | MAGE2 | 90 | | 298 | 11598 | 1608 | 19255 | 118 | 6730 |
| 9002.0045 | EEEGPRMF | 1676 | 8 | Human | MAGE2 | 91 | | 723 | 12281 | 32093 | 2406 | 213 | 943 |
| 9002.0046 | VELVHFLL | 1677 | 8 | Human | MAGE2 | 114 | | 5.0 | 69 | 31 | 3322 | 1.2 | 2427 |
| 9002.0047 | AEMLESVL | 1678 | 8 | Human | MAGE2 | 133 | | 968 | 14 | 31 | 327 | 0.88. | 302 |
| 9002.0048 | SEYLQLVF | 1679 | 8 | Human | MAGE2 | 155 | | 0.97 | 765 | 6.0 | 284 | 0.70 | 122 |
| 9002.0049 | EEKIWEEL | 1680 | 8 | Human | MAGE2 | 218 | | 753 | 9084 | 2599 | 98976 | 104 | 171 |
| 9002.0118 | LEARGEALG | 1681 | 9 | Human | MAGE2 | 16 | | 155 | 1161 | 3006 | 11018 | 24 | 2688 |
| 9002.0119 | GEALGLVGA | 1682 | 9 | Human | MAGE2 | 20 | | 9529 | 2832 | 34 | 6134 | 2.2 | 17 |
| 9002.0120 | QEEEGPRMF | 1683 | 9 | Human | MAGE2 | 90 | | 414 | 918 | 7747 | 237 | 409 | 2171 |
| 9002.0122 | VELVHFLLL | 1684 | 9 | Human | MAGE2 | 114 | | 71 | 79 | 31 | 579 | 3.1 | 1129 |
| 9002.0123 | REPVTKAEM | 1685 | 9 | Human | MAGE2 | 127 | | 60 | 373 | 284 | 896 | 4.5 | 832 |
| 9002.0124 | SEYLQLVFG | 1686 | 9 | Human | MAGE2 | 155 | | 18 | 8890 | 421 | 271 | 19 | 113 |
| 9002.0127 | PEEKIWEEL | 1687 | 9 | Human | MAGE2 | 217 | | 577 | 19449 | 3908 | 1029 | 235 | 17345 |
| 9002.0129 | EELSMLEVF | 1688 | 9 | Human | MAGE2 | 223 | | 1.4 | 16436 | 252 | 22 | 2.8 | 1013 |
| 9002.0130 | FEGREDSVF | 1689 | 9 | Human | MAGE2 | 231 | | 9.8 | 2366 | 348 | 221 | 13 | 3339 |
| 9002.0131 | YEFLWGPRA | 1690 | 9 | Human | MAGE2 | 269 | | 5.3 | 249 | 5.2 | 2355 | 1.1 | 241 |
| 9002.0220 | EEGLEARGEA | 1691 | 10 | Human | MAGE2 | 13 | | 1077 | 3434 | 3227 | 216 | 302 | 30 |
| 9002.0221 | LEARGEALGL | 1692 | 10 | Human | MAGE2 | 16 | | 81 | 184 | 277 | 2275 | 4.1 | 964. |
| 9002.0222 | VEVTLGEVPA | 1693 | 10 | Human | MAGE2 | 46 | | 14 | 371 | 31 | 3801 | 0.52 | 15 |
| 9002.0223 | EEGPRMFPDL | 1694 | 10 | Human | MAGE2 | 92 | | 128 | 4438 | 486 | 95 | 13 | 42 |
| 9002.0224 | REPVTKAEML | 1695 | 10 | Human | MAGE2 | 127 | | 88 | 23 | 264 | 84 | 41 | 917 |
| 9002.0225 | SEYLQLVFGI | 1696 | 10 | Human | MAGE2 | 155 | | 2.2 | 20 | 6.1 | 3.7 | 0.84 | 4.4 |
| 9002.0226 | VEVVPISHLY | 1697 | 10 | Human | MAGE2 | 167 | | 20 | 11522 | 4385 | 13 | 1225 | 4885 |
| 9002.0227 | EEKIWEELSM | 1698 | 10 | Human | MAGE2 | 218 | | 17 | 21450 | 477 | 46 | 19 | 107 |
| 9002.0228 | WEELSMLEVF | 1699 | 10 | Human | MAGE2 | 222 | | 0.14 | 463 | 30 | 15 | 15 | 290 |
| 9002.0229 | FEGREDSVFA | 1700 | 10 | Human | MAGE2 | 231 | | 178 | >10062.89 | 4775 | 6879 | 192 | 503 |
| 9002.0230 | QENYLEYRQV | 1701 | 10 | Human | MAGE2 | 252 | | 118 | 493 | 102 | 17 | 16 | 27 |
| 9002.0231 | YEFLWGPRAL | 1702 | 10 | Human | MAGE2 | 269 | | | 8.5 | 0.97 | 130 | 0.72 | 753 |
| 9002.0232 | GEPHISYPPL | 1703 | 10 | Human | MAGE2 | 295 | | 2612 | 7.0 | 2.9 | 1200 | 0.71 | 380 |
| 9002.0307 | EEGLEARGEAL | 1704 | 11 | Human | MAGE2 | 13 | | 179 | 300 | 578 | 2630 | 19 | 1812 |
| 9002.0308 | LEARGEALGLV | 1705 | 11 | Human | MAGE2 | 16 | | 158 | 198 | 345 | >17829.46 | 13 | 1912 |
| 9002.0309 | GEALGLVGAQA | 1706 | 11 | Human | MAGE2 | 20 | | 877 | 4293 | 52 | 3575 | 1.4 | 28 |
| 9002.0310 | EEQQTASSSST | 1707 | 11 | Human | MAGE2 | 34 | | 752 | 4040 | 41162 | 5910 | 1552 | 134 |
| 9002.0311 | VEVTLGEVPAA | 1708 | 11 | Human | MAGE2 | 46 | | 124 | 25216 | 919 | >23469.39 | 44 | 1583 |
| 9002.0313 | EEEGPRMFPDL | 1709 | 11 | Human | MAGE2 | 91 | | 1011 | 2646 | 3470 | 3273 | 131 | 209 |
| 9002.0314 | SEFQAAISRKM | 1710 | 11 | Human | MAGE2 | 103 | | 7.0 | 345 | 107 | 88 | 1.2 | 161 |
| 9002.0315 | VELVHFLLLKY | 1711 | 11 | Human | MAGE2 | 114 | | 52 | 550 | 294 | 1551 | 49 | 1790 |
| 9002.0316 | LESVLRNCQDF | 1712 | 11 | Human | MAGE2 | 136 | | 64 | 5409 | 3458 | 209 | 76 | 15241 |
| 9002.0317 | VEVVPISHLYI | 1713 | 11 | Human | MAGE2 | 167 | | 97 | 135 | 146 | 335 | 7.2 | 3788 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 9002.0318 | IEGDCAPEEKI | 1714 | 11 | Human | MAGE2 | 211 | | 844 | 27827 | 32058 | 2627 | 486 | 183 |
| 9002.0320 | EEKIWEELSML | 1715 | 11 | Human | MAGE2 | 218 | | 1641 | 4978 | 20625 | 1862 | 375 | 181 |
| 9002.0321 | EELSMLEVFEG | 1716 | 11 | Human | MAGE2 | 223 | | 1.5 | 24061 | 294 | 4.6 | 23 | 163 |
| 9002.0322 | LEVFEGREDSV | 1717 | 11 | Human | MAGE2 | 228 | | 639 | 2624 | 367 | >21296.3 | 46 | 29449 |
| 9002.0323 | YEFLWGPRALI | 1718 | 11 | Human | MAGE2 | 269 | | 5.2 | 4.1 | 2.8 | 92 | 0.59 | 450 |
| 9002.0348 | EEQTASSSSTL | 1719 | 12 | Human | MAGE2 | 34 | | 7259 | 166 | 526 | 57 | 981 | 15 |
| 9002.0349 | QEEEGPRMFPDL | 1720 | 12 | Human | MAGE2 | 90 | | 3595 | 394 | 1330 | 1643 | 120 | |
| 9002.0350 | SEFQAAISRKMV | 1721 | 12 | Human | MAGE2 | 103 | | 43 | 161 | 29 | 25 | 21 | |
| 9002.0351 | LESVLRNCQDFF | 1722 | 12 | Human | MAGE2 | 136 | | 56 | 55 | 356 | 184 | 24 | 1993 |
| 9002.0352 | VEVVPISHLYIL | 1723 | 12 | Human | MAGE2 | 167 | | 266 | 3.4 | 16 | 486 | 4.0 | 1182 |
| 9002.0367 | EEGLEARGEALGL | 1724 | 13 | Human | MAGE2 | 13 | | 10416 | 1769 | 5143 | 196 | 118 | 1673 |
| 9002.0368 | LEARGEALGLVGA | 1725 | 13 | Human | MAGE2 | 16 | | 347 | 20 | 48 | 2575 | 2.2 | 116 |
| 9002.0369 | LESEFQAAISRKM | 1726 | 13 | Human | MAGE2 | 101 | | 49 | 310 | 72 | 242 | 14 | 22 |
| 9002.0370 | REPVTKAEMLESV | 1727 | 13 | Human | MAGE2 | 127 | | 5531 | 337 | 411 | 4546 | 21 | 1507 |
| 9002.0371 | SEYLQLVFGIEVV | 1728 | 13 | Human | MAGE2 | 155 | | 9.7 | 23 | 4.5 | 144 | 5.4 | 6.6 |
| 9002.0372 | IEVVEVVPISHLY | 1729 | 13 | Human | MAGE2 | 164 | | 79 | 162 | 245 | 52 | 125 | 106 |
| 9002.0373 | VEVVPISHLYILV | 1730 | 13 | Human | MAGE2 | 167 | | 92 | 93 | 47 | 270 | 51 | 112 |
| 69.0079 | MEVDPIGHLY | 1731 | 10 | Human | MAGE3 | 167 | | 13 | 209 | 334 | 13 | 28 | 228 |
| 9002.0050 | EEEGPSTF | 1732 | 8 | Human | MAGE3 | 91 | | 216 | 1008 | 435 | 3933 | 27 | 1819 |
| 9002.0051 | AELVHFLL | 1733 | 8 | Human | MAGE3 | 114 | | 120 | 71 | 6.8 | 1074 | 0.16 | 452 |
| 9002.0052 | FEGREDSI | 1734 | 8 | Human | MAGE3 | 231 | | 927 | 718 | 127 | 7708 | 13 | 2291 |
| 9002.0133 | QEAASSSST | 1735 | 9 | Human | MAGE3 | 36 | | 1422 | 23469 | 1480 | 9593 | 41 | 110 |
| 9002.0136 | AELVHFLLL | 1736 | 9 | Human | MAGE3 | 114 | | 160 | 25 | 3.1 | 33 | 0.94 | 141 |
| 9002.0137 | AEMLGSVVG | 1737 | 9 | Human | MAGE3 | 133 | | 96 | 1899 | 109 | 27 | 1.6 | 11 |
| 9002.0141 | EELSVLEVF | 1738 | 9 | Human | MAGE3 | 223 | | 7.3 | 10215 | 3314 | 61 | 12 | 2120 |
| 9002.0142 | FEGREDSIL | 1739 | 9 | Human | MAGE3 | 231 | | 1091 | 51 | 439 | 1925 | 11 | >27071.82 |
| 9002.0233 | QEAASSSSTL | 1740 | 10 | Human | MAGE3 | 36 | | 171 | 49 | 47 | 56 | 13 | 287 |
| 9002.0234 | EEGPSTFPDL | 1741 | 10 | Human | MAGE3 | 92 | | 158 | 655 | 591 | 198 | 127 | 128 |
| 9002.0235 | IELMEVDPIG | 1742 | 10 | Human | MAGE3 | 164 | | 194 | 6592 | 5325 | 222 | >16306.95 | 7604 |
| 9002.0236 | MEVDPIGHLY | 1743 | 10 | Human | MAGE3 | 167 | | 15 | 617 | 625 | 11 | 99 | 169 |
| 9002.0237 | EEKIWEELSV | 1744 | 10 | Human | MAGE3 | 218 | | 73 | 8947 | 79 | 396 | 17 | 17 |
| 9002.0238 | WEELSVLEVF | 1745 | 10 | Human | MAGE3 | 222 | | 1.7 | 75 | 37 | 14 | 13 | 1701 |
| 9002.0239 | FEGREDSILG | 1746 | 10 | Human | MAGE3 | 231 | | 229 | 940 | 4361 | 8534 | 172 | 20261 |
| 9002.0324 | EEEGPSTFPDL | 1747 | 11 | Human | MAGE3 | 91 | | 935 | 431 | 2120 | 2685 | 102 | 158 |
| 9002.0325 | AELVHFLLLKY | 1748 | 11 | Human | MAGE3 | 114 | | 153 | 32 | 39 | 178 | 1.6 | 670 |
| 9002.0326 | MEVDPIGHLYI | 1749 | 11 | Human | MAGE3 | 167 | | 9.8 | 34 | 16 | 64 | 0.91 | 95 |
| 9002.0327 | REGDCAPEEKI | 1750 | 11 | Human | MAGE3 | 211 | | 973 | 2418 | 830 | 4038 | 42 | 146 |
| 9002.0328 | EEKIWEELSVL | 1751 | 11 | Human | MAGE3 | 218 | | 133 | 152 | 1255 | 1416 | 58 | 218 |
| 9002.0329 | LEVFEGREDSI | 1752 | 11 | Human | MAGE3 | 228 | | 4745 | 206 | 512 | 20963 | 69 | >31012.66 |
| 9002.0020 | RERFEMF | 1753 | 7 | Human | p53 | 335 | | 180 | 4079 . | 1907 | 25488 | 108 | 20048 |
| 9002.0053 | LEDSSGNL | 1754 | 8 | Human | p53 | 257 | | 17736 | 782 | 362 | 42791 | 211 | 15946 |
| 9002.0054 | GEYFTLQI | 1755 | 8 | Human | p53 | 325 | | 7774 | 112 | 60 | 3511 | 1.0 | 261 |
| 9002.0145 | VEPPLSQET | 1756 | 9 | Human | p53 | 10 | | 8302 | 17052 | 20808 | 3186 | 236 | 29270 |
| 9002.0146 | PENNVLSPL | 1757 | 9 | Human | p53 | 27 | | 1150 | 1261 | 718 | 11174 | 8.8 | >27071.82 |
| 9002.0148 | DEAPRMPEA | 1758 | 9 | Human | p53 | 61 | | 84 | 9092 | 4577 | 6448 | 98 | 10.0 |
| 9002.0149 | HERCSDSDG | 1759 | 9 | Human | p53 | 179 | | 1118 | 2367 | 38636 | 19328 | 208 | 13390 |
| 9002.0150 | VEGNLRVEY | 1760 | 9 | Human | p53 | 197 | | 832 | 12752 | 67730 | 142 | 2583 | 39059 |
| 9002.0151 | VEYLDDRNT | 1761 | 9 | Human | p53 | 203 | | 1442 | 36833 | 35854 | 10071 | 157 | 13503 |
| 9002.0153 | LEDSSGNLL | 1762 | 9 | Human | p53 | 257 | | 1140 | 43 | 2771 | 4656 | 43 | 26134 |
| 9002.0155 | RELNEALEL | 1763 | 9 | Human | p53 | 342 | | 3000 | 15 | 30 | 525 | 1.1 | 3337 |
| 9002.0156 | NEALELKDA | 1764 | 9 | Human | p53 | 345 | | 1925 | 3887 | 27585 | 4270 | 1582 | 129 |

TABLE 17-continued

| Peptide | Sequence | SEQ ID NO | AA | Organism | Protein | Position | Analog | B*1801 | B*4001 | B*4002 | B*4402 | B*4403 | B*4501 |
|---|---|---|---|---|---|---|---|---|---|---|---|---|---|
| 9002.0157 | LELKDAQAG | 1765 | 9 | Human | p53 | 348 | | 451 | 18706 | 3659 | 17293 | 30 | 1989 |
| 9002.0240 | MEEPQSDPSV | 1766 | 10 | Human | p53 | 1 | | 12157 | 3802 | 16536 | 1927 | 816 | 175 |
| 9002.0241 | VEPPLSQETF | 1767 | 10 | Human | p53 | 10 | | 814 | >37209.3 | 21732 | 406 | 525 | >24019.61 |
| 9002.0242 | QETFSDLWKL | 1768 | 10 | Human | p53 | 16 | | 736 | 199 | 255 | 39 | 14 | 901 |
| 9002.0243 | IEQWFTEDPG | 1769 | 10 | Human | p53 | 50 | | 151 | 1250 | 2114 | 5595 | 142 | 197 |
| 9002.0244 | DEAPRMPEAA | 1770 | 10 | Human | p53 | 61 | | 121 | 3941 | 8444 | 2594 | 1037 | 100 |
| 9002.0246 | HERCSDSDGL | 1771 | 10 | Human | p53 | 179 | | 139 | 171 | 61 | 1468 | 6.0 | 1723 |
| 9002.0247 | VEGNLRVEYL | 1772 | 10 | Human | p53 | 197 | | 104 | 481 | 2565 | 1963 | 22 | 15189 |
| 9002.0248 | VEYLDDRNTF | 1773 | 10 | Human | p53 | 203 | | 0.94 | 501 | 37 | 32 | 1.4 | 3601 |
| 9002.0249 | PEVGSDCTTI | 1774 | 10 | Human | p53 | 223 | | 611 | 4552 | 248 | 2293 | 2046 | 22487 |
| 9002.0250 | LEDSSGNLLG | 1775 | 10 | Human | p53 | 257 | | 103 | 531 | 697 | 7905 | 153 | 19256 |
| 9002.0251 | FEVRVCACPG | 1776 | 10 | Human | p53 | 270 | | 64 | 2043 | 4.9 | 180 | 0.76 | 1872 |
| 9002.0252 | TEEENLRKKG | 1777 | 10 | Human | p53 | 284 | | 74966 | >37209.3 | 11858 | >23589.74 | 315 | 30635 |
| 9002.0253 | GEPHHELPPG | 1778 | 10 | Human | p53 | 293 | | 108 | 3323 | 1888 | 11728 | 4.4 | 20 |
| 9002.0254 | GEYFTLQIRG | 1779 | 10 | Human | p53 | 325 | | 108 | 88 | 19 | 2452 | 3.9 | 157 |
| 9002.0255 | RERFEMFREL | 1780 | 10 | Human | p53 | 335 | | 83 | 29 | 17 | 17 | 0.34 | 422 |
| 9002.0256 | FEMFRELNEA | 1781 | 10 | Human | p53 | 338 | | 127 | 3207 | 223 | 952 | 2.0 | 208 |
| 9002.0330 | QETFSDLWKLL | 1782 | 11 | Human | p53 | 16 | | 4158 | 3366 | 740 | 631 | 168 | 1218 |
| 9002.0331 | HERCSDSDGLA | 1783 | 11 | Human | p53 | 179 | | 1408 | 4879 | 1915 | >20956.72 | 96 | 186 |
| 9002.0332 | YEPPEVGSDCT | 1784 | 11 | Human | p53 | 220 | | 16872 | 4529 | 125 | 13349 | 12712 | 16034 |
| 9002.0333 | HELPPGSTKRA | 1785 | 11 | Human | p53 | 297 | | 6034 | 3974 | 3255 | 47077 | 189 | 1472 |
| 9002.0334 | FEMFRELNEAL | 1786 | 11 | Human | p53 | 338 | | 475 | 17 | 8.8 | 748 | 1.1 | 1352 |
| 9002.0335 | NEALELKDAQA | 1787 | 11 | Human | p53 | 345 | | 742 | 6235 | 5071 | >20956.72 | 949 | 53 |
| 9002.0353 | TEDPGPDEAPRM | 1788 | 12 | Human | p53 | 55 | | 888 | 327 | 893 | 2053 | 161 | 1676 |
| 9002.0355 | GEPHHELPPGST | 1789 | 12 | Human | p53 | 293 | | 6822 | 24342 | 4631 | 6581 | 252 | 169 |
| 9002.0374 | DEAPRMPEAAPPV | 1790 | 13 | Human | p53 | 61 | | 427 | >48484.85 | 7258 | >2762.76 | 1376 | 19 |
| 9002.0375 | YEPPEVGSDCTTI | 1791 | 13 | Human | p53 | 220 | | 8796 | 2699 | 1540 | >2740.54 | 253 | >20000 |
| 1420.11 | RERRDNYV | 1792 | 8 | Human | unknown | | | >73809.52 | 71554 | 62 | >67647.06 | >34517.77 | 34648 |
| 1420.12 | SEIDLILGY | 1793 | 9 | Human | unknown | | | 3.0 | 285 | 140 | 4.8 | 8.5 | 397 |
| 1420.13 | AEIPTRVNY | 1794 | 9 | Human | unknown | | | 1691 | 7826 | 5443 | 333 | 23 | 1286 |
| 1420.14 | AEMGKFKFSY | 1795 | 10 | Human | unknown | | | 1517 | 2941 | 622 | 146 | 28 | 283 |
| 1420.15 | DEIGVIDLY | 1796 | 9 | Human | unknown | | | 11 | >114285.71 | >77272.73 | 707 | 212 | >49000 |
| 1420.16 | AEMGKFKYSF | 1797 | 10 | Human | unknown | | A | 155 | 113 | 3.8 | 18 | 31 | 186 |
| 1420.17 | SEAIHTFQY | 1798 | 9 | Human | unknown | | | 25 | 2895 | 1802 | 18 | 16 | 1078 |
| 1420.18 | SEAIYTFQF | 1799 | 9 | Human | unknown | | A | 5.7 | 967 | 39 | 4.8 | 20 | 293 |
| 1420.19 | AEGIVTGQY | 1800 | 9 | Human | unknown | | | 7176 | 6462 | 1528 | 255 | 12 | 418 |
| 1420.26 | HETTYNSI | 1801 | 8 | Mouse | beta actin | 275 | A | 1644 | 251 | 336 | 616 | 23959 | 6608 |
| 1420.28 | GELSYLNV | 1802 | 8 | Mouse | cathepsin D | 255 | | >24800 | 4856 | 100 | 19013 | 23735 | 784 |
| 1420.27 | YEDTGKTI | 1803 | 8 | Mouse | p40 phox RNA | 245 | | 13997 | 794 | 83 | 7911 | 2177 | 49000 |
| 1420.31 | YENDIEKK1 | 1804 | 9 | Pf | CSP | 375 | | 30992 | 1156 | 145 | 1725 | 371 | 49000 |

TABLE 18

| Peptide | Sequence | SEQ ID NO | AA | Organism | Protein | Position | Analog | DQB1*0301 | DQB1*0302 | DQB1*0201 |
|---|---|---|---|---|---|---|---|---|---|---|
| 702.02 | AAAKAAAAAAYAA | 1805 | 13 | Artificial sequence | | | A | 424 | | |
| 736.02 | (44)YAAAAAAKAAA | 1806 | 13 | Artificial sequence | | | A | 26 | | |
| 760.15 | AAFAAAKTAAAFA | 1807 | 13 | Artificial sequence | | | A | 49 | | |
| 760.16 | YAAFAAAKTAAAFA | 1808 | 14 | Artificial sequence | | | A | 36 | | |
| Sandoz 362 | YAAFAAAKTAAAFA | 1809 | 14 | Artificial sequence | | | | 39 | | |
| 594.09 | AHAAHAAHAAHAAHAA | 1810 | 16 | HA | | | A | 58 | | |
| 9001.0003 | VLERYLLEAKEAENI | 1811 | 15 | Human | EPO | 11 | | 10932 | 309 | 5389 |
| 9001.0009 | VPDTKVNFYAWKRME | 1812 | 15 | Human | EPO | 41 | | 730 | >46666.67 | >147058.82 |
| 9001.0011 | WKRMEVGQQAVEVWQ | 1813 | 15 | Human | EPO | 51 | | 13666 | 12146 | 159 |
| 9001.0012 | VGQQAVEVWQGLALL | 1814 | 15 | Human | EPO | 56 | | 1807 | 4407 | 838 |
| 9001.0013 | VEVWQGLALLSEAVL | 1815 | 15 | Human | EPO | 61 | | 19 | 14 | 98 |
| 9001.0014 | GLALLSEAVLRGQAL | 1816 | 15 | Human | EPO | 66 | | 107 | 16963 | 6742 |
| 9001.0015 | SEAVLRGQALLVNSS | 1817 | 15 | Human | EPO | 71 | | 55 | 36395 | 9755 |
| 9001.0016 | RGQALLVNSSQPWEP | 1818 | 15 | Human | EPO | 76 | | 302 | 14393 | 13362 |
| 9001.0019 | LQLHVDKAVSGLRSL | 1819 | 15 | Human | EPO | 91 | | 88 | 7842 | 7590 |
| 9001.0024 | KEAISPPDAASAAPL | 1820 | 15 | Human | EPO | 116 | | 458 | 960 | 7287 |
| 9001.0025 | PPDAASAAPLRTITA | 1821 | 15 | Human | EPO | 121 | | 20 | 3869 | 3631 |
| 9001.0026 | SAAPLRTITADTFRK | 1822 | 15 | Human | EPO | 126 | | 301 | >46666.67 | 1100 |
| 9001.0035 | EAENITTGTAEHTSL | 1823 | 15 | Human | EPO | 21 | A | 316 | 8300 | |
| 9000.0002 | RLFDNASLRAHRLHQ | 1824 | 15 | Human | Growth hormone | 8 | | 996 | >36206.9 | 11766 |
| 9000.0004 | QLAFDTYQEFEEAYI | 1825 | 15 | Human | Growth hormone | 22 | | >89285.71 | 673 | 35 |
| 9000.0012 | ISLLLIQSWLEPVQF | 1826 | 15 | Human | Growth hormone | 78 | | >89285.71 | 562 | 5234 |
| 9000.0015 | NSLVYGASDSNVYDL | 1827 | 15 | Human | Growth hormone | 99 | | 14164 | 8337 | 731 |
| 9000.0016 | SDSNVYDLLKDLEEG | 1828 | 15 | Human | Growth hormone | 106 | | >89285.71 | 4136 | 503 |
| 1533.07 | KIFGSLAFLPESFDGDPA | 1829 | 18 | Human | Her2/neu | 369 | | 320 | | |
| 9001.0045 | CLKDRRNFDIPEEIK | 1830 | 15 | Human | IFN-B | 31 | | 19365 | 208 | 774 |
| 9001.0048 | QLQQFQKEDAAVTIY | 1831 | 15 | Human | IFN-B | 46 | | 26205 | 579 | 2145 |
| 9001.0049 | QKEDAAVTIYEMLQN | 1832 | 15 | Human | IFN-B | 51 | | 515 | 153 | 1685 |
| 9001.0054 | STGWNETIVENLLAN | 1833 | 15 | Human | IFN-B | 76 | | 47081 | 5041 | 322 |
| 9001.0055 | ETIVENLLANVYHQR | 1834 | 15 | Human | IFN-B | 81 | | >92592.59 | >75000 | 344 |
| 9001.0066 | KEDSHCAWTIVRVEI | 1835 | 15 | Human | IFN-B | 136 | | 4102 | 2123 | 465 |
| 9001.0070 | MSYNLLGFLQRSSNT | 1836 | 15 | Human | IFN-B | 1 | A | 724 | >51219.51 | |
| 9000.0048 | QHLCGSHLVEALYLV | 1837 | 15 | Human | Insulin beta chain | 4 | | 2553 | 8413 | 359 |
| 9000.0049 | GSHLVEALYLVCGER | 1838 | 15 | Human | Insulin beta chain | 8 | | >89285.71 | 2491 | 677 |
| 9000.0071 | GSDLVEALYLVCGER | 1839 | 15 | Human | Insulin beta chain | 8 | A | >89285.71 | 806 | |
| 9000.0074 | VEALYLVCGERGFLY | 1840 | 15 | Human | Insulin beta chain | 12 | A | 27334 | 514 | |
| 9000.0075 | VEALYLVTGERGFFY | 1841 | 15 | Human | Insulin beta chain | 12 | A | 20021 | 564 | |
| 1518.01 | IDVWLGGLAENFLPY | 1842 | 15 | Human | thyroid perox | 632 | | 204 | 138 | 13 |
| 1518.02 | IDVWLGGLAYNFLPY | 1843 | 15 | Human | thyroid perox | 632 | A | 85 | 358 | 63 |
| 1518.03 | IDVWLGGLALNFLPY | 1844 | 15 | Human | thyroid perox | 632 | A | 49 | 457 | 52 |
| 1518.04 | IDVWLGGLASNFLPY | 1845 | 15 | Human | thyroid perox | 632 | A | 175 | 1251 | 40 |
| 1518.05 | IDVWLGGLAKNFLPY | 1846 | 15 | Human | thyroid perox | 632 | A | 170 | 10247 | >4166.67 |
| 1518.06 | IDVWLGGLADNFLPY | 1847 | 15 | Human | thyroid perox | 632 | A | 296 | 1762 | 12 |
| 1518.07 | IDVYLGGLAENFLPY | 1848 | 15 | Human | thyroid perox | 632 | A | 161 | 186 | 30 |
| 1518.08 | IDVLLGGLAENFLPY | 1849 | 15 | Human | thyroid perox | 632 | A | 166 | 437 | 27 |
| 1518.09 | IDVYLGGLAENFLPY | 1850 | 15 | Human | thyroid perox | 632 | A | 188 | 277 | 48 |
| 1518.10 | IDVKLGGLAENFLPY | 1851 | 15 | Human | thyroid perox | 632 | A | 724 | 5511 | 41 |
| 1518.11 | IDVDLGGLAENFLPY | 1852 | 15 | Human | thyroid perox | 632 | A | 218 | 73 | 17 |
| 1518.12 | IDVWLGGLAENYLPY | 1853 | 15 | Human | thyroid perox | 632 | A | 223 | 110 | 19 |
| 1518.13 | IDVWLGGLAENVLPY | 1854 | 15 | Human | thyroid perox | 632 | A | 84 | 82 | 15 |
| 1518.14 | IDVWLGGLAENSLPY | 1855 | 15 | Human | thyroid perox | 632 | A | 116 | 125 | 25 |
| 1518.15 | IDVWLGGLAENKLPY | 1856 | 15 | Human | thyroid perox | 632 | A | 353 | 5189 | 51 |
| 1518.16 | IDVWLGGLAENDLPY | 1857 | 15 | Human | thyroid perox | 632 | A | 240 | 60 | 22 |
| 1518.17 | IYVWLGGLAENFLPY | 1858 | 15 | Human | thyroid perox | 632 | A | 170 | 237 | 13 |
| 1518.18 | ILVWLGGLAENFLPY | 1859 | 15 | Human | thyroid perox | 632 | A | 216 | 147 | 10.0 |
| 1518.19 | ISVWLGGLAENFLPY | 1860 | 15 | Human | thyroid perox | 632 | A | 132 | 286 | 18 |
| 1518.20 | IKVWLGGLAENFLPY | 1861 | 15 | Human | thyroid perox | 632 | A | 180 | 220 | 37 |
| 1518.21 | IEVWLGGLAENFLPY | 1862 | 15 | Human | thyroid perox | 632 | A | 158 | 145 | 23 |
| 1518.22 | IDVWLGGLAENFLPF | 1863 | 15 | Human | thyroid perox | 632 | A | 111 | 177 | 3.6 |
| 1518.23 | IDVWLGGLAENFLPL | 1864 | 15 | Human | thyroid perox | 632 | A | 182 | 114 | 17 |
| 1518.24 | IDVWLGGLAENFLPS | 1865 | 15 | Human | thyroid perox | 632 | A | 134 | 249 | 27 |
| 1518.25 | IDVWLGGLAENFLPK | 1866 | 15 | Human | thyroid perox | 632 | A | 261 | 231 | 23 |
| 1518.26 | IDVWLGGLAENFLPD | 1867 | 15 | Human | thyroid perox | 632 | A | 115 | 91 | 20 |
| 1518.27 | IDVWLGGLAENFYPY | 1868 | 15 | Human | thyroid perox | 632 | A | 324 | 203 | 37 |
| 1518.28 | IDVWLGGLAENFVPY | 1869 | 15 | Human | thyroid perox | 632 | A | 346 | 272 | 12 |
| 1518.29 | IDVWLGGLAENFSPY | 1870 | 15 | Human | thyroid perox | 632 | A | 131 | 193 | 47 |
| 1518.30 | IDVWLGGLAENFKPY | 1871 | 15 | Human | thyroid perox | 632 | A | 195 | 262 | 310 |
| 1518.31 | IDVWLGGLAENFDPY | 1872 | 15 | Human | thyroid perox | 632 | A | 364 | 90 | 32 |
| 1518.32 | IDVWLGGLAEYFLPY | 1873 | 15 | Human | thyroid perox | 632 | A | 151 | 88 | 14 |
| 1518.33 | IDVWLGGLAELFLPY | 1874 | 15 | Human | thyroid perox | 632 | A | 107 | 81 | 22 |
| 1518.34 | IDVWLGGLAESFLPY | 1875 | 15 | Human | thyroid perox | 632 | A | 60 | 64 | 49 |
| 1518.35 | IDVWLGGLAEKFLPY | 1876 | 15 | Human | thyroid perox | 632 | A | 68 | 112 | 66 |

TABLE 18-continued

| Peptide | Sequence | SEQ ID NO | AA | Organism | Protein | Position | Analog | DQB1*0301 | DQB1*0302 | DQB1*0201 |
|---|---|---|---|---|---|---|---|---|---|---|
| 1518.36 | IDVWLGGLAEDFLPY | 1877 | 15 | Human | thyroid perox | 632 | A | 357 | 120 | 23 |
| 1518.37 | IDVWLGGLAEQFLPY | 1878 | 15 | Human | thyroid perox | 632 | A | 167 | 123 | 9.7 |
| 1518.38 | IDVWLGGLYENFLPY | 1879 | 15 | Human | thyroid perox | 632 | A | 912 | 697 | 6.4 |
| 1518.39 | IDVWLGGLLENFLPY | 1880 | 15 | Human | thyroid perox | 632 | A | 810 | 1734 | 58 |
| 1518.40 | IDVWLGGLSENFLPY | 1881 | 15 | Human | thyroid perox | 632 | A | 242 | 1348 | 37 |
| 1518.41 | IDVWLGGLKENFLPY | 1882 | 15 | Human | thyroid perox | 632 | A | 15907 | >2800 | 25 |
| 1518.42 | IDVWLGGLDENFLPY | 1883 | 15 | Human | thyroid perox | 632 | A | >19230.77 | 637 | 18 |
| 1518.43 | IDVWLGGYAENFLPY | 1884 | 15 | Human | thyroid perox | 632 | A | 900 | 492 | 39 |
| 1518.44 | IDVWLGGVAENFLPY | 1885 | 15 | Human | thyroid perox | 632 | A | 982 | 327 | 75 |
| 1518.45 | IDVWLGGVAENFLPY | 1886 | 15 | Human | thyroid perox | 632 | A | 427 | 755 | 166 |
| 1518.46 | IDVWLGGKAENFLPY | 1887 | 15 | Human | thyroid perox | 632 | A | 517 | 633 | 398 |
| 1518.47 | IDVWLGGDAENFLPY | 1888 | 15 | Human | thyroid perox | 632 | A | 11114 | 2074 | 11 |
| 1518.48 | IDVWLGYLAENFLPY | 1889 | 15 | Human | thyroid perox | 632 | A | 15215 | 1121 | 31 |
| 1518.49 | IDVWLGLLAENFLPY | 1890 | 15 | Human | thyroid perox | 632 | A | 2986 | 180 | 39 |
| 1518.50 | IDVWLGSLAENFLPY | 1891 | 15 | Human | thyroid perox | 632 | A | 654 | 278 | 72 |
| 1518.51 | IDVWLGKLAENFLPY | 1892 | 15 | Human | thyroid perox | 632 | A | 2333 | 20023 | 81 |
| 1518.52 | IDVWLGDLAENFLPY | 1893 | 15 | Human | thyroid perox | 632 | A | >44642.86 | 370 | 18 |
| 1518.53 | IDVWLYGLAENFLPY | 1894 | 15 | Human | thyroid perox | 632 | A | 2171 | 442 | 18 |
| 1518.54 | IDVWLLGLAENFLPY | 1895 | 15 | Human | thyroid perox | 632 | A | 4903 | 455 | 47 |
| 1518.55 | IDVWLGSLAENFLPY | 1896 | 15 | Human | thyroid perox | 632 | A | 3043 | 373 | 98 |
| 1518.56 | IDVWLKGLAENFLPY | 1897 | 15 | Human | thyroid perox | 632 | A | 41667 | 1115 | 55 |
| 1518.57 | IDVWLDGLAENFLPY | 1898 | 15 | Human | thyroid perox | 632 | A | 13325 | 357 | 43 |
| 1518.58 | IDVWYGGLAENFLPY | 1899 | 15 | Human | thyroid perox | 632 | A | 375 | 224 | 43 |
| 1518.59 | IDVWVGGLAENFLPY | 1900 | 15 | Human | thyroid perox | 632 | A | 128 | 158 | 14 |
| 1518.60 | IDVWSGGLAENFLPY | 1901 | 15 | Human | thyroid perox | 632 | A | 451 | 128 | 15 |
| 1518.61 | IDVWKGGLAENFLPY | 1902 | 15 | Human | thyroid perox | 632 | A | 256 | 346 | 41 |
| 1518.62 | IDVWDGGLAENFLPY | 1903 | 15 | Human | thyroid perox | 632 | A | 2086 | 299 | 112 |
| 1518.63 | IDYWLGGLAENFLPY | 1904 | 15 | Human | thyroid perox | 632 | A | 503 | 342 | 49 |
| 1518.64 | IDLWLGGLAENFLPY | 1905 | 15 | Human | thyroid perox | 632 | A | 1292 | 661 | 25 |
| 1518.65 | IDSWLGGLAENFLPY | 1906 | 15 | Human | thyroid perox | 632 | A | 508 | 276 | 35 |
| 1518.66 | IDKWLGGLAENFLPY | 1907 | 15 | Human | thyroid perox | 632 | A | 579 | 534 | 62 |
| 1518.67 | IDDWLGGLAENFLPY | 1908 | 15 | Human | thyroid perox | 632 | A | 219 | 101 | 85 |
| 1518.68 | IDVWLGGLAENFLYY | 1909 | 15 | Human | thyroid perox | 632 | A | 341 | 387 | 154 |
| 1518.69 | IDVWLGGLAENFLLY | 1910 | 15 | Human | thyroid perox | 632 | A | 649 | 491 | 52 |
| 1518.70 | IDVWLGGLAENFLSY | 1911 | 15 | Human | thyroid perox | 632 | A | 425 | 676 | 54 |
| 1518.71 | IDVWLGGLAENFLKY | 1912 | 15 | Human | thyroid perox | 632 | A | 2266 | 995 | 111 |
| 1518.72 | IDVWLGGLAENFLDY | 1913 | 15 | Human | thyroid perox | 632 | A | 371 | 149 | 49 |
| 1518.73 | YDVWLGGLAENFLPY | 1914 | 15 | Human | thyroid perox | 632 | A | 482 | 214 | 59 |
| 1518.74 | LDVWLGGLAENFLPY | 1915 | 15 | Human | thyroid perox | 632 | A | 180 | 216 | 29 |
| 1518.75 | SDVWLGGLAENFLPY | 1916 | 15 | Human | thyroid perox | 632 | A | 154 | 232 | 19 |
| 1518.76 | KDVWLGGLAENFLPY | 1917 | 15 | Human | thyroid perox | 632 | A | 348 | 254 | 54 |
| 1518.77 | DDVWLGGLAENFLPY | 1918 | 15 | Human | thyroid perox | 632 | A | 241 | 158 | 48 |

TABLE 19

| Peptide | Sequence | SEQ ID NO | AA | Organism | Protein | Position | Analog | DRB1*0101 | DRB1*0301 | DRB1*0401 | DRB1*0404 | DRB1*0405 |
|---|---|---|---|---|---|---|---|---|---|---|---|---|
| 724.01 | AC-NPTKHKWEAAHVAEQLAA | 1919 | 18 | A2 | MHC derived | Unknown | | | | | >900000 | 500000 |
| 631.02 | DDYVKQYTKQYTKQNTLKK | 1920 | 19 | Artificial sequence | | | | 50000 | | 160 | 500000 | |
| 702.02 | AAAKAAAAAAAYAA | 1921 | 13 | Artificial sequence | | | A | 833 | >900000 | 229 | 500000 | |
| 702.08 | AC-AAAKAAAAAAYAA | 1922 | 13 | Artificial sequence | | | A | 625 | | 348 | | |
| 702.17 | (20)AYA(20)A(20)A(20)K(20)A(20) | 1923 | 13 | Artificial sequence | | | A | 50000 | | 250 | 500000 | |
| 730.08 | AC-AAAKATAAAAYAA | 1924 | 13 | Artificial sequence | | | A | 50000 | | 381 | | |
| 730.09 | AC-AAAKAAAAAAFAA | 1925 | 13 | Artificial sequence | | | A | 50000 | | 421 | | |
| 730.12 | AC-AAAKATAAAA(10)AA | 1926 | 13 | Artificial sequence | | | A | 5000 | | 444 | 500000 | |
| 730.14 | AC-AAAKATAAAA(23)AA | 1927 | 13 | Artificial sequence | | | A | 1250 | | 286 | 25000 | |
| 730.15 | AAKAAAAAAA(10)AA | 1928 | 13 | Artificial sequence | | | A | 2500 | | >888.89 | | |
| 736.03 | AAYAAAATAKAAA | 1929 | 13 | Artificial sequence | | | A | 3.9 | | 0.54 | 2778 | |
| 736.08 | AALAAAAAAKAAA | 1930 | 13 | Artificial sequence | | | A | 1.9 | | 12 | 152 | |
| 736.11 | AAEAAAATAKAAA | 1931 | 13 | Artificial sequence | | | A | 2500 | | 667 | 500000 | |
| 736.13 | AAYJJAAAAKAAA | 1932 | 13 | Artificial sequence | | | A | 50000 | | 533 | 500000 | |
| 736.16 | AAYAAAAJJKAAA | 1933 | 13 | Artificial sequence | | | A | 1250 | | 308 | 500000 | |
| 760.04 | AFLRAAAAAAFAA | 1934 | 13 | Artificial sequence | | | A | 50000 | | 400 | 500000 | |
| 760.06 | AFLRQAAAAAFAAY | 1935 | 14 | Artificial sequence | | | A | 2500 | | 1000 | 25000 | |
| 760.15 | AAFAAAKTAAAFA | 1936 | 13 | Artificial sequence | | | A | 1.3 | 1063 | 0.19 | 6.2 | |
| 760.16 | YAAFAAAKTAAAFA | 1937 | 14 | Artificial sequence | | | A | 0.74 | | 0.13 | 5.0 | |
| 760.21 | AALKATAAAAAAA | 1938 | 13 | Artificial sequence | | | A | 50000 | | 800 | 500000 | |
| 782.03 | YAR(15)ASQTTLKAKT | 1939 | 14 | Artificial sequence | | | | 1.5 | | 0.46 | 5.2 | |
| 782.05 | YARF(33)QTTLKAKT | 1940 | 14 | Artificial sequence | | | | 50000 | | 889 | 16667 | |
| 784.03 | PKYFKQRILKFAT | 1941 | 13 | Artificial sequence | | | A | 1667 | | 400 | 1042 | |
| 784.11 | PKYFKQGFLKGAT | 1942 | 13 | Artificial sequence | | | A | 50000 | | 800 | 500000 | |
| 784.14 | PKYGKQIDLKGAT | 1943 | 13 | Artificial sequence | | | A | 50000 | | 444 | 500000 | |
| 787.01 | AAFFFFFGGGGGA | 1944 | 13 | Artificial sequence | | | | 50000 | | 800 | 500000 | |
| 787.02 | AADFFFFFFFFDA | 1945 | 13 | Artificial sequence | | | | 1250 | | 286 | 500000 | |
| 787.12 | AAKGIKIGFGIFA | 1946 | 13 | Artificial sequence | | | | 50000 | | 471 | 500000 | |
| 787.17 | AAFIFIGGGKIKA | 1947 | 13 | Artificial sequence | | | | 50000 | | 195 | 500000 | |
| 787.18 | AAKIFIGFFIDGA | 1948 | 13 | Artificial sequence | | | | 1250 | | 200 | 25000 | |
| 787.21 | AAFIGFGKIKFIA | 1949 | 13 | Artificial sequence | | | | 50000 | | 242 | 500000 | |
| 787.22 | AAKIGFGIKIGFA | 1950 | 13 | Artificial sequence | | | | 50000 | | 889 | 500000 | |
| 787.27 | AAFKIGKFGIFFA | 1951 | 13 | Artificial sequence | | | | 50000 | | 615 | 500000 | |
| 787.32 | AADDDDDDDDDDA | 1952 | 13 | Artificial sequence | | | | 50000 | | 667 | 500000 | |
| 787.35 | (43)AAIGFFFFKKGIA | 1953 | 14 | Artificial sequence | | | | 50000 | | 258 | 500000 | |
| 787.37 | (43)AAFFGIFKIGKFA | 1954 | 14 | Artificial sequence | | | | 50000 | | 381 | 500000 | |
| 787.38 | (43)AADFGIFIDFIIA | 1955 | 14 | Artificial sequence | | | | 50000 | | 235 | 500000 | |
| 787.39 | (43)AAIGGIFIFKKDA | 1956 | 14 | Artificial sequence | | | | 50000 | | 800 | 500000 | |
| 787.53 | (43)AAFIGFGKIKFIA | 1957 | 13 | Artificial sequence | | | | 50000 | | 1000 | 500000 | |
| 787.54 | (43)AAKIGFGIKIGFA | 1958 | 13 | Artificial sequence | | | | 50000 | | 1000 | 500000 | |
| 787.59 | (43)AAFKIGKFGIFFA | 1959 | 13 | Artificial sequence | | | | 50000 | | 276 | 500000 | |
| 789.02 | AAAKAAAAAAAAF | 1960 | 13 | Artificial sequence | | | | >1666.67 | | >347.83 | 12500 | |
| 789.03 | AAAKAAAAAAAFA | 1961 | 13 | Artificial sequence | | | | 50000 | | 727 | 500000 | |
| 789.04 | AAAKAAAAAAFAA | 1962 | 13 | Artificial sequence | | | | 50000 | | 235 | 25000 | |
| 789.06 | AAAKAAAAFAAAA | 1963 | 13 | Artificial sequence | | | | 50000 | | 533 | 500000 | |
| 789.14 | FAAAAAAAAAAAA | 1964 | 13 | Artificial sequence | | | | 1667 | | 200 | 8333 | |

TABLE 19-continued

| | | | | | | | | | | | | |
|---|---|---|---|---|---|---|---|---|---|---|---|---|
| 789.15 | AAAAAAAAAAAAN | 1965 | 13 | Artificial sequence | | | | 50000 | | 500 | 500000 | |
| 789.16 | AAAAAAAAAAANA | 1966 | 13 | Artificial sequence | | | | 50000 | | 1000 | 500000 | |
| 789.24 | AAANAAAAAAAAA | 1967 | 13 | Artificial sequence | | | | 50000 | | 615 | 500000 | |
| 789.28 | AAAAAAAAAAAAS | 1968 | 13 | Artificial sequence | | | | 50000 | | 533 | 500000 | |
| 789.35 | AAAAASAAAAAAA | 1969 | 13 | Artificial sequence | | | | 50000 | | 235 | 500000 | |
| 789.39 | ASAAAAAAAAAAA | 1970 | 13 | Artificial sequence | | | | 50000 | | 364 | 500000 | |
| 803.03 | AFAAAKTAA | 1971 | 9 | Artificial sequence | | | | 50000 | | 571 | 500000 | |
| 805.01 | YARFLALTTLRARA | 1972 | 14 | Artificial sequence | | | A | 0.98 | | 0.28 | 3.4 | |
| 820.01 | YAR(15A)SQTTLKAKT | 1973 | 14 | Artificial sequence | | | A | 2.4 | | 0.78 | 5.2 | |
| 820.02 | YAR(15A)RQTTLKAAA | 1974 | 14 | Artificial sequence | | | A | 1.6 | | 0.35 | 3.8 | |
| 820.03 | (15A)RQTTLKAAA | 1975 | 11 | Artificial sequence | | | A | 4.2 | | 0.31 | 4.3 | |
| 820.04 | (16A)RQTTLKAAA | 1976 | 11 | Artificial sequence | | | A | 455 | | 1.3 | 37 | |
| 824.22 | (46)AAKTAAAFA | 1977 | 10 | Artificial sequence | | | | 5000 | | 571 | 1852 | |
| 824.38 | (39)AAAATKAAA | 1978 | 10 | Artificial sequence | | | | 3333 | | 727 | 500000 | |
| 824.46 | (52)AAAATKAAAA | 1979 | 11 | Artificial sequence | | | | 2000 | | 242 | 2632 | |
| 824.54 | (55)AAAATKAAAA | 1980 | 11 | Artificial sequence | | | | 2500 | | 667 | 5556 | |
| 838.01 | A(14)AAAKTAAA | 1981 | 10 | Artificial sequence | | | | 39 | | 0.45 | 54 | |
| 839.03 | AA(14)A(35)ATKAAAA | 1982 | 12 | Artificial sequence | | | | 50000 | | >500 | 500000 | |
| 839.16 | AA(14)AA(36)TKAAAA | 1983 | 12 | Artificial sequence | | | | 50000 | | 667 | 25000 | |
| 851.11 | AFAAAKTAA(72) | 1984 | 10 | Artificial sequence | | | | 5000 | | 533 | 500000 | |
| 862.04 | (49)AAAKT(64)AAA | 1985 | 10 | Artificial sequence | | | | 50000 | | 667 | 500000 | |
| 862.05 | (49)AAAKTA(64)AA | 1986 | 10 | Artificial sequence | | | | 50000 | | 533 | 500000 | |
| 1463.18 | HQAISPRTLNGPGPGSPAIF | 1987 | 20 | Artificial sequence | | | | 1555 | 728464 | 12089 | 2056 | 3107 |
| Sandoz 362 | YAAFAAAKTAAAFA | 1988 | 14 | Artificial sequence | | | | 1.9 | | 0.82 | 7.0 | |
| 541.18 | TEGRCLHYTVDKSKPK | 1989 | 16 | Bee Venom | | 103 | | 1667 | | 200 | 500000 | |
| 221.01 | AWVAWRNRCK | 1990 | 0 | Chicken | HEL | 107 | | 50000 | | 667 | 500000 | |
| AP18 | IVSDGNGMNAWVAWRNRC | 1991 | 18 | Chicken | HEL | 98 | | 1250 | 18371 | 1000 | 8333 | |
| 857.04 | PHHTALRQAILSWGELMTLA | 1992 | 20 | DPw4 binder | | | | 1250 | | 166 | 1773 | |
| 510.01 | WMYYHGQRHSDEHHH | 1993 | 15 | EBV | LMP | 183 | | 50000 | >900000 | 727 | 500000 | |
| 510.33 | YIVMSDWTGGA | 1994 | 15 | EBV | LMP | 41 | | 50000 | 13416 | 222 | 500000 | |
| 594.09 | AHAAHAAHAAHAAHAA | 1995 | 16 | HA | | | A | 263 | | 80000 | 500000 | |
| F116.01 | MDIDPYKEFGATVELLSFLPSDFFP | 1996 | 25 | HBV | core | 1 | | 1563 | | 170 | | |
| 799.06 | GMLPVCPLIPGSSTTSTGP | 1997 | 19 | HBV | env | 102 | | 1250 | >900000 | 400 | 1220 | |
| 800.02 | LGFFPDHQLDPAFRANT | 1998 | 17 | HBV | env | 11 | | 1667 | 12027 | 333 | 2941 | |
| F197.06 | GYKVLVLNPSV | 1999 | 11 | HCV | NS3 | 1248 | | 16 | 72407 | 27 | 2116 | 145 |
| F197.05 | LMAFTAAVTS | 2000 | 10 | HCV | NS4 | 1790 | | 2511 | >73952.34 | 321 | 20577 | 627 |
| F197.01 | TFALWRVSAEEY | 2001 | 12 | HCV | NS5 | 2079 | | >5279.83 | 88348 | 342 | 569 | 72 |
| F197.02 | ALWRVSAEEY | 2002 | 10 | HCV | NS5 | 2081 | | >6337.14 | >76595.74 | 6543 | 6669 | >35315.99 |
| F197.03 | EEYVEIRQVGDFH | 2003 | 13 | HCV | NS5 | 2088 | | >1957.71 | 74884 | >5365.53 | 11627 | 26 |
| F193.01 | VGGVYLLPRRGPRLGV | 2004 | 16 | HCV | | | | 177 | 236639 | 22323 | 12756 | 2764 |
| F193.02 | VGGAYLLPRRGPRLGV | 2005 | 16 | HCV | | | A | 131 | 308534 | 26164 | 125056 | >12230.45 |
| F193.03 | VGGVALLPRRGPRLGV | 2006 | 16 | HCV | | | A | 849 | 326288 | 48233 | 23669 | >12230.45 |
| F193.04 | VGGVYALPRRGPRLGV | 2007 | 16 | HCV | | | A | 134 | 348950 | 25750 | 30504 | >12230.45 |
| F193.05 | VGGVYLAPRRGPRLGV | 2008 | 16 | HCV | | | A | 746 | 202660 | 33672 | >116550.12 | >12230.45 |
| F193.06 | VGGVYLLARRGPRLGV | 2009 | 16 | HCV | | | A | 60 | 23276 | 485 | 4396 | 2199 |
| F193.07 | VGGVYLLPARGPRLGV | 2010 | 16 | HCV | | | A | 12 | 68070 | 3644 | 3213 | 4579 |
| F193.08 | VGGVYLLRRAGPRLGV | 2011 | 16 | HCV | | | A | 202 | 39751 | 12252 | 32330 | 6432 |
| F193.09 | GAPLGGAARALAHGV | 2012 | 15 | HCV | | | | 690 | 3145 | 10408 | 19762 | >13044.97 |
| F193.10 | GAALGGAARALAHGV | 2013 | 15 | HCV | | | A | 1081 | 26944 | 21362 | 60600 | >13044.97 |
| F193.12 | GAPLAGAARALAHGV | 2014 | 15 | HCV | | | A | 588 | 2983 | 39885 | 19692 | >13044.97 |
| F193.13 | GAPLGAAARALAHGV | 2015 | 15 | HCV | | | A | 226 | 17703 | 10255 | 52041 | >13044.97 |
| F193.14 | GAPLGGLARALAHGV | 2016 | 15 | HCV | | | A | 537 | 351525 | 13941 | 6564 | >13044.97 |
| F193.15 | GAPLGGALRALAHGV | 2017 | 15 | HCV | | | A | 68 | >486486.49 | 14977 | 977 | 1271 |

TABLE 19-continued

| | | | | | | | | | | | | |
|---|---|---|---|---|---|---|---|---|---|---|---|---|
| F193.16 | GAPLGGAAAALAHGV | 2018 | 15 | HCV | | | A | 147 | 82088 | 5472 | 1272 | >3365.21 |
| F193.17 | GAPLGGAARLLAHGV | 2019 | 15 | HCV | | | A | 398 | 22959 | 14984 | 21017 | >3365.21 |
| F193.18 | GAPLGGAARAAAHGV | 2020 | 15 | HCV | | | A | 797 | 377964 | 25279 | >110132.16 | >3365.21 |
| F193.20 | GAPLGGAARALAAGV | 2021 | 15 | HCV | | | A | 541 | 23298 | 11270 | 16747 | >3365.21 |
| 1453.03 | FPDWQNYTPGPGTRF | 2022 | 15 | HIV | NEF | 200 | | 13766 | >223880.6 | 23394 | >109170.31 | >10101.01 |
| 1453.06 | RFPLTFGWCFKLVPV | 2023 | 15 | HIV | NEF | 216 | | 5913 | 406579 | 316 | 21384 | 121 |
| 1453.09 | RQDILDLWVYHTQGY | 2024 | 15 | HIV | NEF | 182 | | 2390 | 98327 | 1202 | 1624 | 1136 |
| 1453.10 | RQEILDLWVYHTQGF | 2025 | 15 | HIV | NEF | 182 | | 1050 | 10530 | 5928 | 1414 | 3362 |
| 1453.12 | LSHFLKEKGGLEGLI | 2026 | 15 | HIV | NEF | 114 | | 537 | >340909.09 | 2442 | 86814 | 2114 |
| 1453.13 | LSFFLKEKGGLDGLI | 2027 | 15 | HIV | NEF | 114 | | 172 | >340909.09 | 1275 | >109170.31 | 983 |
| 1453.33 | LEPWNHPGSQPKTACT | 2028 | 16 | HIV | TAT | 11 | | >33557.05 | >328467.15 | >33333.33 | >96525.1 | >8232.24 |
| 1453.40 | QVCFITKGLGISYGR | 2029 | 15 | HIV | TAT | 38 | | 114 | 166744 | 1529 | 1391 | 295 |
| 1453.42 | QLCFLKKGLGISYGR | 2030 | 15 | HIV | TAT | 38 | | 185 | 158381 | 4436 | 1613 | 443 |
| 190.11 | PPEESFRFGEEKTTPS | 2031 | 16 | HIV1 | gp | 81 | | >2500 | >900000 | 267 | 500000 | |
| 85.0002 | CIVYRDGNPYAVCDK | 2032 | 15 | HPV | E6 | 58 | | 8464 | | 147 | 1084 | 3473 |
| 85.0003 | HYCYSLYGTTLEQQY | 2033 | 15 | HPV | E6 | 85 | | 546 | | 1127 | 9713 | 76 |
| 85.0004 | CYSLYGTTLEQQYNK | 2034 | 15 | HPV | E6 | 87 | | 1086 | | 1317 | 2836 | 71 |
| 85.0007 | NTSLQDIEITCVYCK | 2035 | 15 | HPV | E6 | 22 | | >12106.54 | | 10930 | 6143 | 4584 |
| 85.0008 | VFEFAFKDLFVVYRD | 2036 | 15 | HPV | E6 | 44 | | 6716 | | 1059 | 2156 | 120 |
| 85.0009 | EFAFKDLFVVYRDSI | 2037 | 15 | HPV | E6 | 46 | | 8944 | | 2220 | 11721 | 33 |
| 85.0010 | DLFVVYRDSIPHAAC | 2038 | 15 | HPV | E6 | 51 | | 1186 | | 82 | 218 | 3591 |
| 85.0011 | FVVYRDSIPHAACHK | 2039 | 15 | HPV | E6 | 53 | | 587 | 200 | 10 | 87 | 704 |
| 85.0012 | NTGLYNLLIRCLRCQ | 2040 | 15 | HPV | E6 | 95 | | 127 | 13429 | 686 | 358 | 258 |
| 85.0013 | IRCLRCQKPLNPAEK | 2041 | 15 | HPV | E6 | 103 | | 7240 | | 6334 | 8464 | 1229 |
| 85.0014 | PRKLHELSSALEIPY | 2042 | 15 | HPV | E6 | 9 | | 156 | 16146 | 5276 | 694 | 80 |
| 85.0015 | EIPYDELRLNCVYCK | 2043 | 15 | HPV | E6 | 20 | | 3299 | | 15532 | 11292 | 7321 |
| 85.0017 | TEVLDFAFTDLTIVY | 2044 | 15 | HPV | E6 | 40 | | 2073 | 1542 | 185 | 1083 | 871 |
| 85.0018 | VLDFAFTDLTIVYRD | 2045 | 15 | HPV | E6 | 42 | | 354 | 30 | 313 | 6061 | 721 |
| 85.0019 | DFAFTDLTIVYRDDT | 2046 | 15 | HPV | E6 | 44 | | 463 | 23 | 80 | 3373 | 40 |
| 85.0020 | TIVYRDDTPHGVCTK | 2047 | 15 | HPV | E6 | 51 | | 3798 | | 22 | 1269 | >9753.59 |
| 85.0021 | WYRYSVYGTTLEKLT | 2048 | 15 | HPV | E6 | 78 | | 163 | 26561 | 249 | 3448 | 8.5 |
| 85.0023 | ETTIHNIELQCVECK | 2049 | 15 | HPV | E6 | 20 | | 3623 | | 1996 | 3327 | 6561 |
| 85.0024 | SEVYDFAFADLTVVY | 2050 | 15 | HPV | E6 | 40 | | 31 | 2996 | 260 | 2180 | 101 |
| 85.0025 | VYDFAFADLTVVYRE | 2051 | 15 | HPV | E6 | 42 | | 173 | | 119 | 5281 | 133 |
| 85.0026 | DFAFADLTVVYREGN | 2052 | 15 | HPV | E6 | 44 | | 3293 | | 141 | 4948 | 60 |
| 85.0027 | TVVYREGNPFGICKL | 2053 | 15 | HPV | E6 | 51 | | 168 | | 121 | 1833 | >13089.91 |
| 85.0028 | GNPFGICKLCLRFLS | 2054 | 15 | HPV | E6 | 57 | | 189 | | 1227 | 2073 | 377 |
| 85.0029 | NYSVYGNTLEQTVKK | 2055 | 15 | HPV | E6 | 80 | | 14059 | | 1933 | 91506 | 822 |
| 85.0030 | KKPLNEILIRCIICQ | 2056 | 15 | HPV | E6 | 93 | | 1363 | | 315 | 1070 | 347 |
| 85.0031 | NEILIRCIICQRPLC | 2057 | 15 | HPV | E6 | 97 | | 7945 | | 11739 | 23082 | 7704 |
| 85.0032 | IRCIICQRPLCPQEK | 2058 | 15 | HPV | E6 | 101 | | 7549 | | 5960 | 23092 | 2973 |
| 85.0035 | CIVYRDCIAYAACHIC | 2059 | 15 | HPV | E6 | 53 | | 1166 | | 928 | 8560 | 3973 |
| 85.0038 | NTELYNLLIRCLRCQ | 2060 | 15 | HPV | E6 | 95 | | 1108 | | 1366 | 1293 | 873 |
| 85.0039 | IRCLRCQKPLNPAEK | 2061 | 15 | HPV | E6 | 103 | | 7012 | | 6668 | 9890 | 8982 |
| 85.0040 | REVYKFLFTDLRIVY | 2062 | 15 | HPV | E6 | 40 | | 8.7 | 23 | 112 | 738 | 52 |
| 85.0041 | RIVYRDNNPYGVCIM | 2063 | 15 | HPV | E6 | 51 | | 524 | 325 | 20 | 432 | 2307 |
| 85.0042 | NNPYGVCIMCLRFLS | 2064 | 15 | HPV | E6 | 57 | | 1075 | | 1378 | 2522 | 454 |
| 85.0043 | EERVKKPLSEITIRC | 2065 | 15 | HPV | E6 | 89 | | 1286 | | 11896 | 9772 | 1470 |
| 85.0044 | IRCIICQTPLCPEEK | 2066 | 15 | HPV | E6 | 101 | | 10847 | | 12270 | 3812 | 1407 |
| 85.0046 | EIPLIDLRLSCVYCK | 2067 | 15 | HPV | E6 | 23 | | 7610 | | 1876 | 5012 | 336 |
| 85.0047 | SCVYCKKELTRAEVY | 2068 | 15 | HPV | E6 | 32 | | 6466 | | 2411 | 7510 | 465 |
| 85.0049 | VCLLFYSKVRKYRYY | 2069 | 15 | HPV | E6 | 68 | | 960 | 276 | 286 | 987 | 73 |
| 85.0050 | YYDYSVYGATLESIT | 2070 | 15 | HPV | E6 | 81 | | 1008 | | 186 | 9855 | 230 |

TABLE 19-continued

| | | | | | | | | | | | |
|---|---|---|---|---|---|---|---|---|---|---|---|
| 85.0052 | IRCYRCQSPLTPEEK | 2071 | 15 | HPV | E6 | 104 | 10947 | | 13358 | 83166 | 10327 |
| 85.0053 | VYDFVFADLRIVYRD | 2072 | 15 | HPV | E6 | 42 | 98 | 2.2 | 475 | 5856 | 717 |
| 85.0054 | DFVFADLRIVYRDGN | 2073 | 15 | HPV | E6 | 44 | 6699 | | 867 | 7197 | 133 |
| 85.0055 | RIVYRDGNPFAVCKV | 2074 | 15 | HPV | E6 | 51 | 116 | 144 | 19 | 209 | 1812 |
| 85.0056 | GNPFAVCKVCLRLLS | 2075 | 15 | HPV | E6 | 57 | 134 | 3805 | 322 | 522 | 56 |
| 85.0058 | KKCLNEILIRCIICQ | 2076 | 15 | HPV | E6 | 93 | 9357 | | 424 | 1229 | 365 |
| 85.0059 | NEILIRCIICQRPLC | 2077 | 15 | HPV | E6 | 97 | 10992 | | 14069 | 9339 | 4621 |
| 85.0102 | RTAMFQDPQERPRKL | 2078 | 15 | HPV | E6 | 5 | 9372 | 154 | 28192 | 39014 | 7977 |
| 85.0110 | LFVVYRDSIPHAACH | 2079 | 15 | HPV | E6 | 52 | 131 | 62 | 3.0 | 24 | 690 |
| 85.0114 | LTIVYRDDTPHGVCT | 2080 | 15 | HPV | E6 | 50 | >15384.62 | 187 | 23 | 203 | >8593.4 |
| 85.0123 | LCIVYRDCIAYAACH | 2081 | 15 | HPV | E6 | 52 | 996 | 1855 | 357 | 1293 | 628 |
| 85.0128 | YKFLFTDLRIVYRDN | 2082 | 15 | HPV | E6 | 43 | 109 | 8.8 | 292 | 256 | 91 |
| 85.0132 | YNFACTELKLVYRDD | 2083 | 15 | HPV | E6 | 46 | 7522 | 346 | 1976 | 4246 | 3147 |
| 85.0133 | LKLVYRDDFPYAVCR | 2084 | 15 | HPV | E6 | 53 | 778 | 237 | 123 | 9269 | 830 |
| 85.0138 | YDFVFADLRIVYRDG | 2085 | 15 | HPV | E6 | 43 | 1160 | 13 | 1914 | 3264 | 829 |
| 85.0139 | LRIVYRDGNPFAVCK | 2086 | 15 | HPV | E6 | 50 | 142 | 181 | 16 | 25 | 557 |
| 85.0061 | HEYMLDLQPETTDLY | 2087 | 15 | HPV | E7 | 9 | 1377 | | 222 | 3997 | 2291 |
| 85.0062 | TLRLCVQSTHVDIRT | 2088 | 15 | HPV | E7 | 64 | 1517 | | 11996 | 8650 | 169 |
| 85.0063 | IRTLEDLLMGTLGIV | 2089 | 15 | HPV | E7 | 76 | 16 | 5211 | 95 | 43 | 61 |
| 85.0064 | LEDLLMGTLGIVCPI | 2090 | 15 | HPV | E7 | 79 | 104 | | 1136 | 353 | 1116 |
| 85.0065 | DLLMGTLGIVCPICS | 2091 | 15 | HPV | E7 | 81 | 966 | | 1324 | 984 | 639 |
| 85.0066 | KATLQDIVLHLEPQN | 2092 | 15 | HPV | E7 | 5 | 1204 | | 1987 | 811 | 1173 |
| 85.0067 | IDGVNHQHLPARRAE | 2093 | 15 | HPV | E7 | 41 | 1060 | | 34272 | 165545 | >16971.86 |
| 85.0068 | LRAFQQLFLNTLSFV | 2094 | 15 | HPV | E7 | 83 | 1.5 | 648 | 7.4 | 13 | 8.3 |
| 85.0069 | FQQLFLNTLSFVCPW | 2095 | 15 | HPV | E7 | 86 | 118 | 1321 | 134 | 1585 | 222 |
| 85.0070 | QDYVLDLQPEATDLH | 2096 | 15 | HPV | E7 | 9 | 13441 | | 253 | 45281 | 5585 |
| 85.0072 | DIRILQELLMGSFGI | 2097 | 15 | HPV | E7 | 75 | 88 | 3252 | 166 | 290 | 552 |
| 85.0073 | IRILQELLMGSFGIV | 2098 | 15 | HPV | E7 | 76 | 67 | 31840 | 724 | 710 | 1208 |
| 85.0074 | ELLMGSFGIVCPNCS | 2099 | 15 | HPV | E7 | 81 | 628 | | 1078 | 8518 | 1853 |
| 85.0075 | KEYVLDLYPEPTDLY | 2100 | 15 | HPV | E7 | 9 | 5949 | | 131 | 89674 | 391 |
| 85.0076 | LRTIQQLLMGTVNIV | 2101 | 15 | HPV | E7 | 76 | 13 | 23182 | 108 | 208 | 179 |
| 85.0077 | IQQLLMGTVNIVCPT | 2102 | 15 | HPV | E7 | 79 | 71 | 93701 | 107 | 483 | 624 |
| 85.0078 | QLLMGTVNIVCPTCA | 2103 | 15 | HPV | E7 | 81 | 1192 | | 2874 | 10062 | 4688 |
| 85.0079 | RETLQEIVLHLEPQN | 2104 | 15 | HPV | E7 | 5 | 1592 | | 2941 | 6583 | 829 |
| 85.0081 | LRTLQQLFLSTLSFV | 2105 | 15 | HPV | E7 | 84 | 8.3 | 801 | 18 | 18 | 9.0 |
| 85.0082 | LQQLFLSTLSFVCPW | 2106 | 15 | HPV | E7 | 87 | 121 | 2045 | 113 | 754 | 94 |
| 85.0083 | KDYILDLQPETTDLH | 2107 | 15 | HPV | E7 | 9 | 6409 | | 1022 | 30309 | 2771 |
| 85.0084 | LRTLQQMLLGTLQVV | 2108 | 15 | HPV | E7 | 78 | 80 | >3750000 | 437 | 644 | 79 |
| 85.0085 | LQQMLLGTLQVVCPG | 2109 | 15 | HPV | E7 | 81 | 168 | | 1496 | 631 | 1068 |
| 85.0086 | QMLLGTLQVVCPGCA | 2110 | 15 | HPV | E7 | 83 | 957 | | 2773 | 425 | 3074 |
| 85.0087 | VPTLQDVVLELTPQT | 2111 | 15 | HPV | E7 | 5 | 16056 | | 214 | 4764 | 5409 |
| 85.0088 | LQDVVLELTPQTEID | 2112 | 15 | HPV | E7 | 8 | 1487 | | 101 | 1094 | 417 |
| 85.0089 | QDVVLELTPQTEIDL | 2113 | 15 | HPV | E7 | 9 | 1269 | | 83 | 1537 | 53 |
| 85.0090 | CKFVVQLDIQSTKED | 2114 | 15 | HPV | E7 | 68 | 1251 | | 196 | 1642 | 374 |
| 85.0091 | VVQLDIQSTKEDLRV | 2115 | 15 | HPV | E7 | 71 | 1060 | | 11122 | 8625 | 46 |
| 85.0092 | DLRVVQQLLMGALTV | 2116 | 15 | HPV | E7 | 82 | 8.4 | 25971 | 325 | 89 | 84 |
| 85.0093 | LRVVQQLLMGALTVT | 2117 | 15 | HPV | E7 | 83 | 5.7 | 21650 | 115 | 28 | 85 |
| 85.0094 | VQQLLMGALTVTCPL | 2118 | 15 | HPV | E7 | 86 | 10 | 34257 | 239 | 614 | 116 |
| 85.0095 | QQLLMGALTVTCPLC | 2119 | 15 | HPV | E7 | 87 | 75 | | 1142 | 1286 | 201 |
| 85.0096 | QLLMGALTVTCPLCA | 2120 | 15 | HPV | E7 | 88 | 54 | >3750000 | 595 | 870 | 1019 |
| 85.0097 | REYILDLHPEPTDLF | 2121 | 15 | HPV | E7 | 9 | 154 | | 132 | 9957 | 354 |
| 85.0098 | TCCYTCGTTVRLCIN | 2122 | 15 | HPV | E7 | 57 | 1230 | 19884 | 719 | 2269 | 132 |
| 85.0099 | VRTLQQLLMGTCTIV | 2123 | 15 | HPV | E7 | 77 | 36 | 32360 | 322 | 39 | 114 |

TABLE 19-continued

| | | | | | | | | | | | | |
|---|---|---|---|---|---|---|---|---|---|---|---|---|
| 85.0100 | LQQLLMGTCTIVCPS | 2124 | 15 | HPV | E7 | 80 | | 197 | | 1147 | 483 | 522 |
| 85.0145 | MLDLQPETTDLYCYE | 2125 | 15 | HPV | E7 | 12 | | 10076 | 720 | 1913 | 12241 | 4249 |
| 85.0157 | VLDLYPEPTDLYCYE | 2126 | 15 | HPV | E7 | 12 | | 11201 | 121 | 203 | 2193 | 212 |
| 85.0167 | LREYILDLHPEPTDL | 2127 | 15 | HPV | E7 | 8 | | 134 | 891 | 23 | 9235 | 968 |
| 530.12 | HIEFTPTRTDTYACRV | 2128 | 16 | Human | B2-μglobulin | 67 | | 50000 | 30000 | 667 | 10000 | |
| 58.0015 | LWWVNNESLPVSPRL | 2129 | 15 | Human | CEA | 177 | A | | 315 | | | |
| 843.01 | YEEYVRFDSDVGE | 2130 | 13 | Human | DAB and CD4 peptide | | | 50000 | | 400 | 500000 | |
| 843.02 | EEYVRFDSDVGE | 2131 | 12 | Human | DRB and CD4 peptide | | | 50000 | | 216 | 500000 | |
| 9001.0001 | APPRLICDSRVLERY | 2132 | 15 | Human | EPO | 1 | | 1374 | 6.3 | 9735 | 5794 | 7141 |
| 9001.0002 | ICDSRVLERYLLEAK | 2133 | 15 | Human | EPO | 6 | | 2758 | 236 | 1984 | 10984 | 11016 |
| 9001.0003 | VLERYLLEAKEAENI | 2134 | 15 | Human | EPO | 11 | | 933 | 59010 | 2598 | 12139 | 5019 |
| 9001.0007 | EHCSLNENITVPDTK | 2135 | 15 | Human | EPO | 31 | | 9837 | 27481 | 2294 | 28297 | 1205 |
| 9001.0008 | NENITVPDTKVNFYA | 2136 | 15 | Human | EPO | 36 | | >24154.59 | 4.8 | >21390.37 | 7612 | >18572.83 |
| 9001.0009 | VPDTKVNFYAWKRME | 2137 | 15 | Human | EPO | 41 | | 2764 | 259 | 1742 | 4131 | 1328 |
| 9001.0010 | VNFYAWKRMEVGQQA | 2138 | 15 | Human | EPO | 46 | | 193 | 2871 | 10 | 291 | 15 |
| 9001.0011 | WKRMEVGQQAVEVWQ | 2139 | 15 | Human | EPO | 51 | | 62 | 514 | 24 | 2591 | 94 |
| 9001.0012 | VGQQAVEVWQGLALL | 2140 | 15 | Human | EPO | 56 | | 161 | >1.74081.24 | 10294 | 6283 | 923 |
| 9001.0013 | VEVWQGLALLSEAVL | 2141 | 15 | Human | EPO | 61 | | 86 | 13293 | 1310 | 1357 | 79 |
| 9001.0014 | GLALLSEAVLRGQAL | 2142 | 15 | Human | EPO | 66 | | 83 | 816 | 11 | 21 | 1435 |
| 9001.0015 | SEAVLRGQALLVNSS | 2143 | 15 | Human | EPO | 71 | | 11 | 70855 | 2064 | 4207 | 17446 |
| 9001.0016 | RGQALLVNSSQPWEP | 2144 | 15 | Human | EPO | 76 | | 1118 | 93874 | 1697 | 1168 | 3434 |
| 9001.0017 | LVNSSQPWEPLQLHV | 2145 | 15 | Human | EPO | 81 | | 2178 | 26138 | >21505.38 | 13031 | 19689 |
| 9001.0018 | QPWEPLQLHVDKAVS | 2146 | 15 | Human | EPO | 86 | | 11567 | 4862 | 1296 | 6135 | 1111 |
| 9001.0019 | LQLHVDKAVSGLRSL | 2147 | 15 | Human | EPO | 91 | | 192 | 22 | 9.7 | 44 | 13571 |
| 9001.0020 | DKAVSGLRSLTTLLR | 2148 | 15 | Human | EPO | 96 | | 13 | 4331 | 1014 | 25 | 247 |
| 9001.0021 | GLRSLTTLLRALGAQ | 2149 | 15 | Human | EPO | 101 | | 8.5 | 2345 | 24 | 9.2 | 30 |
| 9001.0022 | TTLLRALGAQKEAIS | 2150 | 15 | Human | EPO | 106 | | 19 | 107164 | 339 | 199 | 103 |
| 9001.0023 | ALGAQKEAISPPDAA | 2151 | 15 | Human | EPO | 111 | | 194 | >204081.63 | >21505.38 | 93062 | 13015 |
| 9001.0024 | KEAISPPDAASAAPL | 2152 | 15 | Human | EPO | 116 | | 15531 | 48560 | 6590 | 4389 | 28755 |
| 9001.0025 | PPDAASAAPLRTITA | 2153 | 15 | Human | EPO | 121 | | 309 | 14900 | 566 | 68 | 1555 |
| 9001.0026 | SAAPLRTITADTFRK | 2154 | 15 | Human | EPO | 126 | | 1166 | 1262 | 1185 | 261 | 1456 |
| 9001.0027 | RTITADTFRKLFRVY | 2155 | 15 | Human | EPO | 131 | | 148 | 139 | 1042 | 928 | 1957 |
| 9001.0028 | DTFRKLFRVYSNFLR | 2156 | 15 | Human | EPO | 136 | | 12 | 6946 | 70 | 104 | 93 |
| 9001.0029 | LFRVYSNFLRGKLKL | 2157 | 15 | Human | EPO | 141 | | 43 | 6156 | 643 | 1816 | 1275 |
| 9001.0030 | SNFLRGKLKLYTGEA | 2158 | 15 | Human | EPO | 146 | | 143 | 9583 | 2883 | 2375 | 7182 |
| 9001.0031 | KLKLYTGEACRTGDR | 2159 | 15 | Human | EPO | 152 | | 122 | 18435 | 5964 | 3505 | 36294 |
| 9001.0032 | APPRLITDSRVLERY | 2160 | 15 | Human | EPO | 1 | A | 10144 | 15 | 6680 | 3168 | 7765 |
| 9001.0033 | ITDSRVLERYLLEAK | 2161 | 15 | Human | EPO | 6 | A | 1571 | 6501 | 1303 | 1990 | 13339 |
| 9001.0037 | EHTSLNENITVPDTK | 2162 | 15 | Human | EPO | 31 | A | 43921 | 33635 | 12379 | 2769 | 1245 |
| 9001.0038 | KLKLYTGEATRTGDR | 2163 | 15 | Human | EPO | 152 | A | 178 | 118459 | 15 | 3230 | 1426 |
| 1416.01 | PQPFRPQQPYPQ | 2164 | 12 | Human | gliadin | | | | | | | |
| 1416.02 | PFRPQQPYPQ | 2165 | 10 | Human | gliadin | | | | | | | |
| 1416.05 | PQPFRPQQPYP | 2166 | 11 | Human | gliadin | | | | | | | |
| 1416.07 | PQPFRPQQP | 2167 | 9 | Human | gliadin | | | | | | | |
| 1416.08 | KQPFRPQQPYPQ | 2168 | 12 | Human | gliadin | | | | | | | |
| 1416.09 | PKPFRPQQPYPQ | 2169 | 12 | Human | gliadin | | | | | | | |
| 1416.12 | PQPFKPQQPYPQ | 2170 | 12 | Human | gliadin | | | | | | | |
| 1416.13 | PQPFRKQQPYPQ | 2171 | 12 | Human | gliadin | | | | | | | |
| 1416.15 | PQPFRPQKPYPQ | 2172 | 12 | Human | gliadin | | | | | | | |
| 1416.17 | PQPFRPQQPKPQ | 2173 | 12 | Human | gliadin | | | | | | | |
| 1416.18 | PQPFRPQQPYKQ | 2174 | 12 | Human | gliadin | | | | | | | |

TABLE 19-continued

| | | | | | | | | | | | | |
|---|---|---|---|---|---|---|---|---|---|---|---|---|
| 1416.19 | PQPFRPQQPYPK | 2175 | 12 | Human | gliadin | | | | | | | |
| 1416.20 | QFLGQQQPFPPQ | 2176 | 12 | Human | gliadin | | | | | | | |
| 1416.21 | FLGQQQPFPPQ | 2177 | 11 | Human | gliadin | | | | | | | |
| 1416.22 | LGQQQPFPPQ | 2178 | 10 | Human | gliadin | | | | | | | |
| 1416.24 | QFLGQQQPFPP | 2179 | 11 | Human | gliadin | | | | | | | |
| 1416.26 | QFLGQQQPF | 2180 | 9 | Human | gliadin | | | | | | | |
| 1416.27 | IRNLALQTLPAMCNVY | 2181 | 16 | Human | gliadin | | | | | | | |
| 1416.28 | NLALQTLPAMCNVY | 2182 | 14 | Human | gliadin | | | | | | | |
| 1416.29 | LALQTLPAMCNVY | 2183 | 13 | Human | gliadin | | | | | | | |
| 1416.31 | IRNLALQTLPAM | 2184 | 12 | Human | gliadin | | | | | | | |
| 1416.32 | IRNLALQTLP | 2185 | 10 | Human | gliadin | | | | | | | |
| F160.05 | EGDAFELTVSCQGGLPK | 2186 | 17 | Human | gp100 | 506 | | | | 572 | 3578 | |
| F167.02 | ESTGMTPEKVPVSEVMGT | 2187 | 18 | Human | gp100 | 370 | | >50000 | >47368.42 | 510 | >71428.57 | |
| 9000.0001 | FPTIPLSRLFDNASL | 2188 | 15 | Human | Growth hormone | 1 | | 8071 | 114611 | 228 | 22 | 7210 |
| 9000.0002 | RLFDNASLRAHRLHQ | 2189 | 15 | Human | Growth hormone | 8 | | 89 | 97 | 77 | 2043 | 10328 |
| 9000.0003 | LRAHRLHQLAFDTYQ | 2190 | 15 | Human | Growth hormone | 15 | | 162 | 15603 | 5076 | 2197 | 10139 |
| 9000.0004 | QLAFDTYQEFEEAYI | 2191 | 15 | Human | Growth hormone | 22 | | >20491.8 | 7981 | >10738.26 | 33446 | 5399 |
| 9000.0005 | QEFEEAYIPKEQKYS | 2192 | 15 | Human | Growth hormone | 29 | | >20491.8 | >171755.73 | >21276.6 | >88339.22 | 395 |
| 9000.0006 | IPKEQKYSFLQNPQT | 2193 | 15 | Human | Growth hormone | 36 | | 128 | 49978 | 217 | 3633 | 9.0 |
| 9000.0007 | SFLQNPQTSLCFSES | 2194 | 15 | Human | Growth hormone | 43 | | 595 | 8617 | 6376 | 16880 | >25832.77 |
| 9000.0008 | TSLCFSESIPTPSNR | 2195 | 15 | Human | Growth hormone | 50 | | 604 | 182762 | 48 | 229 | 852 |
| 9000.0010 | REETQQKSNLELLRI | 2196 | 15 | Human | Growth hormone | 64 | | 8921 | 91054 | 9341 | 1324 | 1433 |
| 9000.0011 | SNLELLRISLLLIQS | 2197 | 15 | Human | Growth hormone | 71 | | 72 | 43487 | 621 | 189 | 379 |
| 9000.0012 | ISLLLIQSWLEPVQF | 2198 | 15 | Human | Growth hormone | 78 | | 184 | 27922 | 885 | 177 | 0.86 |
| 9000.0013 | SWLEPVQFLRSVFAN | 2199 | 15 | Human | Growth hormone | 85 | | 11 | 167103 | 1128 | 152 | 883 |
| 9000.0014 | FLRSVFANSLVYGAS | 2200 | 15 | Human | Growth hormone | 92 | | 4.3 | 15221 | 6.7 | 43 | 59 |
| 9000.0015 | NSLVYGASDSNVYDL | 2201 | 15 | Human | Growth hormone | 99 | | 7313 | 81158 | 190 | 1585 | 1055 |
| 9000.0016 | SDSNVYDLLKDLEEG | 2202 | 15 | Human | Growth hormone | 106 | | 24369 | 54982 | 11032 | >25680.53 | 95 |
| 9000.0018 | GIQTLMGRLEDGSPR | 2203 | 15 | Human | Growth hormone | 120 | | 98 | >55900.62 | 11914 | 2458 | 3745 |
| 9000.0019 | RLEDGSPRTGQIFKQ | 2204 | 15 | Human | Growth hormone | 127 | | 15693 | 76675 | 7906 | 1729 | 22125 |
| 9000.0020 | RTGQIFKQTYSKFDT | 2205 | 15 | Human | Growth hormone | 134 | | 1555 | 20341 | 1680 | 1831 | 40 |
| 9000.0021 | QTYSKFDTNSHNDDA | 2206 | 15 | Human | Growth hormone | 141 | | 17352 | >55900.62 | 97 | 11218 | 78 |
| 9000.0022 | TNSHNDDALLKNYGL | 2207 | 15 | Human | Growth hormone | 148 | | 16457 | 26397 | 20308 | >25680.53 | 16329 |
| 9000.0023 | ALLKNYGLLYCFRKD | 2208 | 15 | Human | Growth hormone | 155 | | 137 | 9819 | 446 | 1286 | 551 |
| 9000.0025 | DMDKVETFLRIVQCR | 2209 | 15 | Human | Growth hormone | 169 | | 1277 | 4813 | 867 | 1135 | 622 |
| 9000.0026 | FLRIVQCRSVEGSCGF | 2210 | 16 | Human | Growth hormone | 176 | | 106 | 33536 | 185 | 164 | 191 |
| 9000.0027 | FPTIPLSRLFDNAML | 2211 | 15 | Human | Growth hormone | 1 | A | 6923 | 46707 | 9458 | 175 | 923 |
| 9000.0028 | RLFDNAMLRAHRLHQ | 2212 | 15 | Human | Growth hormone | 8 | A | 2.3 | 27 | 6289 | 1520 | 4247 |
| 9000.0029 | QLAFDTYQEFEQNPQ | 2213 | 15 | Human | Growth hormone | 22 | A | >17985.61 | 7851 | 28586 | 47399 | 4843 |
| 9000.0031 | SFLQNPQTSLCCFRK | 2214 | 15 | Human | Growth hormone | 43 | A | 106 | 1829 | 671 | 1816 | 1230 |
| 9000.0033 | SNLELLRICLLLIQS | 2215 | 15 | Human | Growth hormone | 71 | A | 731 | 61913 | 1526 | 2303 | 1112 |
| 9000.0034 | ICLLLIQSWLEPVQF | 2216 | 15 | Human | Growth hormone | 78 | A | 8511 | 50874 | 11303 | 5708 | 71 |
| 9000.0035 | NSLVYGASDSNIYDL | 2217 | 15 | Human | Growth hormone | 99 | A | 13068 | >51428.57 | 240 | 3683 | 1229 |
| 9000.0036 | SDSNIYDLLKDLEEG | 2218 | 15 | Human | Growth hormone | 106 | A | >17985.61 | 124500 | 17458 | 25922 | 137 |
| 9000.0037 | DKVETFLRIVQCCGF | 2219 | 15 | Human | Growth hormone | 169 | A | 953 | 18325 | 1158 | 259 | 397 |
| 9000.0038 | SFLQNPQTSLTFSES | 2220 | 15 | Human | Growth hormone | 43 | A | 1191 | 2395 | 7780 | 15527 | 9558 |
| 9000.0039 | TSLTFSESIPTPSNR | 2221 | 15 | Human | Growth hormone | 50 | A | 182 | 17425 | 18 | 98 | 686 |
| 9000.0040 | ALLKNYGLLYTFRKD | 2222 | 15 | Human | Growth hormone | 155 | A | 19 | 5982 | 160 | 266 | 303 |
| 9000.0041 | LLYTFRKDMDKVETF | 2223 | 15 | Human | Growth hormone | 162 | A | >17985.61 | 23871 | 10623 | 17771 | 1133 |
| 9000.0042 | DMDKVETFLRIVQTR | 2224 | 15 | Human | Growth hormone | 169 | A | 1111 | 11194 | 2030 | 133 | 454 |
| 9000.0043 | FLRIVQTRSVEGSTGF | 2225 | 16 | Human | Growth hormone | 176 | A | 6.4 | 3944 | 11 | 16 | 99 |
| 1533.01 | HLDMLRHLYQGCQVV | 2226 | 15 | Human | Her2/neu | 42 | | 304 | 37552 | 9417 | 2741 | 3593 |
| 1533.03 | RLRIVRGTQLFEDNYAL | 2227 | 17 | Human | Her2/neu | 98 | | 4.8 | 11287 | 8389 | 2929 | 1024 |

TABLE 19-continued

| | | | | | | | | | | | | |
|---|---|---|---|---|---|---|---|---|---|---|---|---|
| 1533.04 | GVGSPYVSRLLGICL | 2228 | 15 | Human | Her2/neu | 776 | | 19 | 167949 | 1570 | 49 | 4156 |
| 1533.06 | TLERPKTLSPGKNGV | 2229 | 15 | Human | Her2/neu | 1166 | | 10103 | 134367 | >22471.91 | 103285 | >28592.93 |
| 1533.07 | KIFGSLAFLPESFDGDPA | 2230 | 18 | Human | Her2/neu | 369 | | 597 | 74162 | 1195 | 1897 | 37 |
| 1533.08 | ELVSEFSRMARDPQ | 2231 | 14 | Human | Her2/neu | 971 | | 201 | 1026 | 120 | 4882 | 15120 |
| F196.02 | GEALSTLVLNRLKVG | 2232 | 15 | Human | HSP60 | 280 | | 719 | 11783 | 3045 | 305 | 14802 |
| F196.04 | AYVLLSEKKISSIQS | 2233 | 15 | Human | HSP60 | 242 | | 78 | 136 | 943 | 359 | 9471 |
| F196.06 | VASLLTTAEVVVTEI | 2234 | 15 | Human | HSP60 | 535 | | 604 | 136308 | 7431 | 810 | 6517 |
| F196.07 | KCEFQDAYVILLSEKK | 2235 | 16 | Human | HSP60 | 236 | | 14 | 5791 | 73 | 943 | 351 |
| F196.10 | ALSTLVLNRLKVGLQ | 2236 | 15 | Human | HSP60 | 282 | | 49 | 153 | 517 | 31 | 2167 |
| 9001.0039 | MSYNLLGFLQRSSNC | 2237 | 15 | Human | IFN-B | 1 | | 115 | 156715 | 366 | 1584 | 788 |
| 9001.0040 | LGFLQRSSNCQCQKL | 2238 | 15 | Human | IFN-B | 6 | | 437 | 112406 | 120 | 401 | 827 |
| 9001.0041 | RSSNCQCQKLLWQLN | 2239 | 15 | Human | IFN-B | 11 | | 9665 | >191897.65 | 1046 | 2987 | 12652 |
| 9001.0042 | QCQKLLWQLNGRLEY | 2240 | 15 | Human | IFN-B | 16 | | 181 | 133472 | 360 | 460 | 1004 |
| 9001.0043 | LWQLNGRLEYCLKDR | 2241 | 15 | Human | IFN-B | 21 | | 1108 | 2356 | 816 | 8882 | 1024 |
| 9001.0044 | GRLEYCLKDRRNFDI | 2242 | 15 | Human | IFN-B | 26 | | 9854 | 853 | 918 | 4155 | 3238 |
| 9001.0046 | RNFDIPEEIKQLQQF | 2243 | 15 | Human | IFN-B | 36 | | 6969 | 26262 | 18107 | 5375 | >114457.83 |
| 9001.0047 | PEEIKQLQQFQKEDA | 2244 | 15 | Human | IFN-B | 41 | | 1026 | 40154 | 1618 | 618 | 7875 |
| 9001.0048 | QLQQFQKEDAAVTIY | 2245 | 15 | Human | IFN-B | 46 | | 85 | 17383 | 231 | 27473 | 1121 |
| 9001.0049 | QKEDAAVTIYEMLQN | 2246 | 15 | Human | IFN-B | 51 | | 8376 | >156521.74 | 9437 | 75877 | 785 |
| 9001.0050 | AVTIYEMLQNIFAIF | 2247 | 15 | Human | IFN-B | 56 | | 17 | 23730 | 101 | 808 | 163 |
| 9001.0051 | EMLQNIFAIFRQDSS | 2248 | 15 | Human | IFN-B | 61 | | 395 | 9544 | 685 | 689 | 456 |
| 9001.0052 | IFAIFRQDSSSTGWN | 2249 | 15 | Human | IFN-B | 66 | | 132 | 402 | 9.6 | 71 | 118 |
| 9001.0053 | RQDSSSTGWNETIVE | 2250 | 15 | Human | IFN-B | 71 | | >102040.82 | 38681 | 4637 | 184507 | 40847 |
| 9001.0054 | STGWNETIVENLLAN | 2251 | 15 | Human | IFN-B | 76 | | 21407 | >156521.74 | 1755 | 10422 | 7060 |
| 9001.0055 | ETIVENLLANVYHQR | 2252 | 15 | Human | IFN-B | 81 | | 659 | 40053 | 789 | 802 | 326 |
| 9001.0056 | NLLANVYHQRNHLKT | 2253 | 15 | Human | IFN-B | 86 | | 152 | 40328 | 1039 | 1440 | 1492 |
| 9001.0057 | VYHQRNHLKTVLEEK | 2254 | 15 | Human | IFN-B | 91 | | 617 | 3135 | 7757 | 76003 | 153 |
| 9001.0060 | LEKEDFTRGKRMSSL | 2255 | 15 | Human | IFN-B | 106 | | 21965 | 50733 | >20887.73 | 93968 | 5694 |
| 9001.0061 | FTRGKRMSSLHLKRY | 2256 | 15 | Human | IFN-B | 111 | | 13 | 3302 | 1013 | 970 | 484 |
| 9001.0062 | RMSSLHLKRYYGRIL | 2257 | 15 | Human | IFN-B | 116 | | 275 | 2181 | 993 | 4793 | 34 |
| 9001.0063 | HLKRYYGRILHYLKA | 2258 | 15 | Human | IFN-B | 121 | | 26 | 3709 | 135 | 666 | 86 |
| 9001.0064 | YGRILHYLKAKEDSH | 2259 | 15 | Human | IFN-B | 126 | | 30 | 42429 | 2343 | 917 | 23 |
| 9001.0065 | HYLKAKEDSHCAWTI | 2260 | 15 | Human | IFN-B | 131 | | 1128 | 34758 | 2064 | 12153 | 3701 |
| 9001.0066 | KEDSHCAWTIVRVEI | 2261 | 15 | Human | IFN-B | 136 | | 4835 | >46656.3 | 353 | 1090 | 74 |
| 9001.0067 | CAWTIVRVEILRNFY | 2262 | 15 | Human | IFN-B | 141 | | 66 | 3561 | 158 | 640 | 135 |
| 9001.0068 | VRVEILRNFYVINRL | 2263 | 15 | Human | IFN-B | 146 | | 1.8 | 429 | 140 | 47 | 18 |
| 9001.0069 | RNFYVINRLTGYLRN | 2264 | 15 | Human | IFN-B | 152 | | 1.7 | 2199 | 219 | 4618 | 182 |
| 9001.0070 | MSYNLLGFLQRSSNT | 2265 | 15 | Human | IFN-B | 1 | A | 25 | 107838 | 1152 | 813 | 433 |
| 9001.0071 | LGFLQRSSNTQTQKL | 2266 | 15 | Human | IFN-B | 6 | A | 142 | 26455 | 18 | 211 | 1068 |
| 9001.0072 | RSSNTQTQKLLWQLN | 2267 | 15 | Human | IFN-B | 11 | A | 10515 | 44338 | 2139 | 15497 | 12590 |
| 9001.0073 | QTQKLLWQLNGRLEY | 2268 | 15 | Human | IFN-B | 16 | A | 32 | 3555 | 55 | 35283 | 86 |
| 9001.0074 | LWQLNGRLEYTLKDR | 2269 | 15 | Human | IFN-B | 21 | A | 698 | 511 | 757 | 16171 | 94 |
| 9001.0075 | GRLEYTLKDRRNFDI | 2270 | 15 | Human | IFN-B | 26 | A | 7252 | 30 | 3228 | 97035 | 1379 |
| 9001.0077 | HYLKAKEDSHTAWTI | 2271 | 15 | Human | IFN-B | 131 | A | 232 | 70237 | 553 | 10677 | 15067 |
| 9001.0078 | KEDSHTAWTIVRVEI | 2272 | 15 | Human | IFN-B | 136 | A | 1909 | 44754 | 746 | 2178 | 302 |
| 9001.0079 | TAWTIVRVEILRNFY | 2273 | 15 | Human | IFN-B | 141 | A | 7.8 | 2997 | 44 | 84 | 115 |
| 9001.0080 | LGFLQRSSNCQSQKL | 2274 | 15 | Human | IFN-B | 6 | A | 192 | 4888 | 8.1 | 93 | 228 |
| 9001.0081 | RSSNCQSQKLLWQLN | 2275 | 15 | Human | IFN-B | 11 | A | 2050 | 57946 | 595 | 16721 | 4010 |
| 9001.0082 | QSQKLLWQLNGRLEY | 2276 | 15 | Human | IFN-B | 16 | A | 127 | 33374 | 84 | 741 | 55 |
| 9000.0044 | GIVEQCCTSICSLYQ | 2277 | 15 | Human | Insulin alpha chain | 1 | | 11123 | 777105 | 10911 | 2995 | 17793 |
| 9000.0046 | TSICSLYQLENYCN | 2278 | 14 | Human | Insulin alpha chain | 8 | | 11391 | >154109.59 | 20462 | 3791 | 12457 |

TABLE 19-continued

| | | | | | | | | | | | | |
|---|---|---|---|---|---|---|---|---|---|---|---|---|
| 9000.0053 | GILEQCCTSICSLYQ | 2279 | 15 | Human | Insulin alpha chain | 1 | A | 11025 | >187500 | 14862 | 5106 | 15983 |
| 9000.0054 | GIVEQTTTSITSLYQ | 2280 | 15 | Human | Insulin alpha chain | 1 | A | 6354 | 107486 | 121 | 115 | 818 |
| 9000.0055 | EQTTTSITSLYQLEN | 2281 | 15 | Human | Insulin alpha chain | 4 | A | 18953 | >143769.97 | 170 | 258 | 272 |
| 9000.0056 | TSICSLYQLENYCG | 2282 | 14 | Human | Insulin alpha chain | 8 | A | 1125 | 202253 | 8841 | 1986 | 1089 |
| 9000.0057 | TSITSLYQLENYTN | 2283 | 14 | Human | Insulin alpha chain | 8 | A | 1253 | 81293 | 1468 | 138 | 851 |
| 9000.0058 | TSITSLYQLENYTG | 2284 | 14 | Human | Insulin alpha chain | 8 | A | 1132 | 96727 | 1628 | 129 | 115 |
| 9000.0059 | GIVEQCCCGSHLVEA | 2285 | 15 | Human | Insulin alpha-beta | | A | 10043 | >74750.83 | 19904 | 2892 | 6626 |
| 9000.0060 | SLYQLENYCCGERGF | 2286 | 15 | Human | Insulin alpha-beta | | A | 3568 | 54469 | 7313 | 1527 | 2356 |
| 9000.0064 | CCTSICSLYQLENYCC | 2287 | 16 | Human | Insulin alpha-beta | | A | 11655 | 71239 | 8383 | 1604 | 629 |
| 9000.0065 | GSHLVEALYLVCCN | 2288 | 14 | Human | Insulin alpha-beta | | A | 194 | >59681.7 | -2280 | 11512 | 2509 |
| 9000.0066 | CCGSHLVEALYLVCC | 2289 | 15 | Human | Insulin alpha-beta | | A | 880 | >55693.07 | 10081 | 20487 | 5230 |
| 9000.0047 | FVNQHLCGSHLVEAL | 2290 | 15 | Human | Insulin beta chain | 1 | | 583 | >187500 | 19209 | 39746 | >20663.4 |
| 9000.0048 | QHLCGSHLVEALYLV | 2291 | 15 | Human | Insulin beta chain | 4 | | 170 | 48557 | 12954 | 4303 | 9825 |
| 9000.0049 | GSHLVEALYLVCGER | 2292 | 15 | Human | Insulin beta chain | 8 | | 525 | >187500 | 8292 | 1603 | 4609 |
| 9000.0050 | VEALYLVCGERGFFY | 2293 | 15 | Human | Insulin beta chain | 12 | | 76 | 17558 | 209 | 124 | 1044 |
| 9000.0051 | YLVCGERGFFYTPKT | 2294 | 15 | Human | Insulin beta chain | 16 | | 11063 | 37210 | 1439 | 22980 | 730 |
| 9000.0067 | FVNQHLCGSDLVEAL | 2295 | 15 | Human | Insulin beta chain | 1 | A | 117 | >74750.83 | 19154 | 36693 | 14913 |
| 9000.0068 | FVNQHLTGSHLVEAL | 2296 | 15 | Human | Insulin beta chain | 1 | A | 9.2 | 67240 | 858 | 14916 | 1065 |
| 9000.0070 | QHLTGSHLVEALYLV | 2297 | 15 | Human | Insulin beta chain | 4 | A | 9.3 | 50338 | >16096.58 | 3952 | 7423 |
| 9000.0072 | GSHLVEALYLVTGER | 2298 | 15 | Human | Insulin beta chain | 8 | A | 645 | >176470.59 | 15781 | 1693 | 14443 |
| 9000.0073 | VEALYLVCGERGSFY | 2299 | 15 | Human | Insulin beta chain | 12 | A | 88 | 9972 | 833 | 194 | 6108 |
| 9000.0074 | VEALYLVCGERGFLY | 2300 | 15 | Human | Insulin beta chain | 12 | A | 14 | 11587 | 167 | 31 | 1027 |
| 9000.0075 | VEALYLVTGERGFFY | 2301 | 15 | Human | Insulin beta chain | 12 | A | 9.9 | 2011 | 60 | 23 | 2342 |
| 9000.0077 | YLVCGERGFLYTPKT | 2302 | 15 | Human | Insulin beta chain | 16 | A | 155 | 2033 | >20460.36 | >38550.5 | >30134.81 |
| 9000.0078 | YLVCGERGFFYTDKT | 2303 | 15 | Human | Insulin beta chain | 16 | A | 17260 | 11790 | >20460.36 | >38550.5 | >30134.81 |
| 9000.0079 | YLVCGERGFFYTKPT | 2304 | 15 | Human | Insulin beta chain | 16 | A | 3207 | 42139 | >20460.36 | >38550.5 | >30134.81 |
| 9000.0080 | YLVTGERGFFYTPKT | 2305 | 15 | Human | Insulin beta chain | 16 | A | 779 | 517 | >20460.36 | >38550.5 | 30457 |
| 9000.0081 | YLVTGERGFFYTDKT | 2306 | 15 | Human | Insulin beta chain | 16 | A | 3259 | 7326 | >20460.36 | >38550.5 | >30134.81 |
| 9000.0082 | YLVTGERGFFYTKPT | 2307 | 15 | Human | Insulin beta chain | 16 | A | 1152 | 4801 | >20460.36 | >38550.5 | >30134.81 |
| 9000.0083 | VCGERGFFYTPKTRR | 2308 | 15 | Human | Insulin beta chain | 18 | A | 9622 | 1989 | >20460.36 | >38550.5 | >15103.34 |
| 9000.0085 | VTGERGFFYTPKTRR | 2309 | 15 | Human | Insulin beta chain | 18 | A | 18906 | 3018 | 7226 | 147000 | 13417 |
| 68.0001 | MWDLVLSIALSVGCT | 2310 | 15 | Human | Kallikrein2 | 1 | | 205 | | 1846 | | |
| 68.0002 | DLVLSIALSVGCTGA | 2311 | 15 | Human | Kallikrein2 | 3 | | 1197 | | 13038 | | |
| 68.0003 | HPQWVLTAAHCLKKN | 2312 | 15 | Human | Kallikrein2 | 56 | | 22 | 1103 | 875 | | |
| 68.0004 | QWVLTAAHCLKKNSQ | 2313 | 15 | Human | Kallikrein2 | 58 | | 895 | | >40000 | | |
| 68.0005 | GQRVPVSHSFPHPLY | 2314 | 15 | Human | Kallikrein2 | 87 | | 1563 | | >40000 | | |
| 68.0006 | RVPVSHSFPHPLYNM | 2315 | 15 | Human | Kallikrein2 | 89 | | 67 | | >16000 | | |
| 68.0007 | PHPLYNMSLLKHQSL | 2316 | 15 | Human | Kallikrein2 | 97 | | 19079 | | 819 | | |
| 68.0008 | HPLYNMSLLKHQSLR | 2317 | 15 | Human | Kallikrein2 | 98 | | 232 | 13007 | 499 | | |
| 68.0009 | NMSLLKHQSLRPDED | 2318 | 15 | Human | Kallikrein2 | 102 | | 3131 | | >40000 | | |
| 68.0010 | SHDLMLLRLSEPAKI | 2319 | 15 | Human | Kallikrein2 | 118 | | 56 | 2396 | 2244 | | |
| 68.0011 | HDLMLLRLSEPAKIT | 2320 | 15 | Human | Kallikrein2 | 119 | | 16 | 1406 | 3063 | | |
| 68.0015 | PEEFLRPRSLQCVSL | 2321 | 15 | Human | Kallikrein2 | 162 | | 2001 | | >26666.67 | | |
| 68.0016 | PRSLQCVSLHLLSND | 2322 | 15 | Human | Kallikrein2 | 168 | | 1111 | | 16000 | | |
| 68.0017 | NGVLQGITSWGPEPC | 2323 | 15 | Human | Kallikrein2 | 220 | | 1093 | | 8433 | | |
| 68.0018 | KPAVYTKVVHYRKWI | 2324 | 15 | Human | Kallikrein2 | 239 | | 5000 | | 1433 | | |
| 68.0140 | LHLLSNDMCARAYSE | 2325 | 15 | Human | Kallikrein2 | 176 | | 2104 | 938 | 4277 | | |

TABLE 19-continued

| | | | | | | | | | | | | |
|---|---|---|---|---|---|---|---|---|---|---|---|---|
| 58.0114 | VGNWQYFFPVIFSKA | 2326 | 15 | Human | MAGE3 | 140 | | 37 | | 4.1 | | |
| F160.12 | ESEFQAALSRKVAKL | 2327 | 15 | Human | MAGE6 | 102 | | | | 579 | 29617 | |
| F160.28 | IGHLYIFATCLGLSYDGL | 2328 | 18 | Human | MAGE6 | 172 | | | | >816.33 | 12199 | |
| F160.30 | VGNWQYFFPVIFSKASDSLQLVFGIELMEVD | 2329 | 31 | Human | MAGE6 | 140 | | | | 654 | 3846 | |
| F160.06 | PAYEKLSAEQSPPPY | 2330 | 15 | Human | MART1 | 102 | | | | 479 | >250000 | |
| F160.08 | RNGYRALMDKSLHVGTQCALTRR | 2331 | 23 | Human | MART1 | 51 | | | | 512 | 5779 | |
| 613.01 | FFKNIVTFFKNIVT | 2332 | 14 | Human | MBP | | A | 50000 | | >666.67 | 500000 | |
| 825.08 | YKSAHKGFKGVDAQGTLSKI | 2333 | 20 | Human | MBP | 134 | | 70 | >900000 | 889 | 25000 | |
| 825.09 | VDAQGTLSKIFKLGGRDSRS | 2334 | 20 | Human | MBP | 144 | | 25 | 1383 | 1600 | 314 | |
| 825.10 | AC-ASQKRPSQRHGSKYLATAST | 2335 | 23 | Human | MBP | 1 | | 50000 | >900000 | 889 | 25000 | |
| F006.15 | ENPVVHFFKNIVTPR | 2336 | 15 | Human | MBP | 85 | | | | | | |
| F006.21 | ENPVVAFFKNIVTPR | 2337 | 15 | Human | MBP | 85 | SAAS | | | | | |
| F006.22 | ENPVVHAFKNIVTPR | 2338 | 15 | Human | MBP | 85 | SAAS | | | | | |
| F006.24 | ENPVVHFFANIVTPR | 2339 | 15 | Human | MBP | 85 | SAAS | | | | | |
| F006.30 | ENPVVHFFKNIVTPA | 2340 | 15 | Human | MBP | 85 | SAAS | | | | | |
| F006.31 | NPVVHFFKNIVT | 2341 | 12 | Human | MBP | 86 | | | | | | |
| F006.321 | HFFKNIVTPRTPPY | 2342 | 14 | Human | MBP | 90 | | | | | | |
| F006.34 | NPVVHFFKNIVTPR | 2343 | 14 | Human | MBP | 86 | | | | | | |
| F189.01 | LPVPGVLLKEFTVSGNILTI | 2344 | 20 | Human | NY-ESO-1 | 116 | | 57 | 15058 | 14 | 12 | 12 |
| F189.02 | WITQCFLPVFLAQPPSGQRR | 2345 | 20 | Human | NY-ESO-1 | 161 | | 679 | 25534 | 88 | 2804 | 216 |
| F189.03 | DHRQLQLSISSCLQQLSLLM | 2346 | 20 | Human | NY-ESO-1 | 141 | | 1356 | 42666 | 1322 | 210 | 725 |
| F189.04 | YLAMPFATPMEAELARRSLA | 2347 | 20 | Human | NY-ESO-1 | 91 | | 46 | 46591 | 266 | 814 | 405 |
| 68.0019 | AAPLLLARAASLSLG | 2348 | 15 | Human | PAP | 3 | | 6.8 | 35410 | 139 | | |
| 68.0020 | APLLLARAASLSLGF | 2349 | 15 | Human | PAP | 4 | | 8.4 | 56250 | 202 | | |
| 68.0021 | PLLLARAASLSLGFL | 2350 | 15 | Human | PAP | 5 | | 10 | >81818.18 | 521 | | |
| 68.0022 | SLSLGFLFLLFFWLD | 2351 | 15 | Human | PAP | 13 | | 11417 | | 4711 | | |
| 68.0023 | LLFFWLDRSVLAKEL | 2352 | 15 | Human | PAP | 21 | | 2.9 | 6.3 | 2.6 | | |
| 68.0024 | DRSVLAKELKFVTLV | 2353 | 15 | Human | PAP | 27 | | 705 | | 569 | | |
| 68.0025 | AKELKFVTLVFRHGD | 2354 | 15 | Human | PAP | 32 | | 787 | 30000 | 783 | | |
| 68.0026 | RSPIDTFPTDPIKES | 2355 | 15 | Human | PAP | 47 | | >50000 | | 13095 | | |
| 68.0028 | FGQLTQLGMEQHYEL | 2356 | 15 | Human | PAP | 67 | | 2259 | | 3210 | | |
| 68.0030 | DRTLMSAMTNLAALF | 2357 | 15 | Human | PAP | 110 | | 97 | 64286 | 13 | | |
| 68.0031 | MSAMTNLAALFPPEG | 2358 | 15 | Human | PAP | 114 | | 1757 | | 700 | | |
| 68.0032 | MTNLAALFPPEGVSI | 2359 | 15 | Human | PAP | 117 | | 24 | | >40000 | | |
| 68.0033 | PEGVSIWNPILLWQP | 2360 | 15 | Human | PAP | 126 | | 111 | | 1778 | | |
| 68.0034 | GVSIWNPILLWQPIP | 2361 | 15 | Human | PAP | 128 | | 44 | 56250 | 10328 | | |
| 68.0035 | WNPILLWQPIPVHTV | 2362 | 15 | Human | PAP | 132 | | 208 | >81818.18 | 695 | | |
| 68.0036 | NPILLWQPIPVHTVP | 2363 | 15 | Human | PAP | 133 | | 31 | >81818.18 | 206 | | |
| 68.0037 | PILLWQPIPVHTVPL | 2364 | 15 | Human | PAP | 134 | | 44 | >81818.18 | 258 | | |
| 68.0038 | ILLWQPIPVHTVPLS | 2365 | 15 | Human | PAP | 135 | | 45 | >81818.18 | 170 | | |
| 68.0039 | WQPIPVHTVPLSEDQ | 2366 | 15 | Human | PAP | 138 | | 6386 | | >26666.67 | | |
| 68.0040 | LSGLHGQDLFGIWSK | 2367 | 15 | Human | PAP | 194 | | 148 | | >26666.67 | | |
| 68.0041 | YDPLYCESVHNFTLP | 2368 | 15 | Human | PAP | 210 | | 1597 | 16625 | 8889 | | |
| 68.0042 | LPSWATEDTMTKLRE | 2369 | 15 | Human | PAP | 223 | | 20274 | | 973 | | |
| 68.0043 | LRELSELSLLSLYGI | 2370 | 15 | Human | PAP | 235 | | 655 | | 371 | | |
| 68.0044 | LSELSLLSLYGIHKQ | 2371 | 15 | Human | PAP | 238 | | 482 | >81818.18 | 1549 | | |
| 68.0045 | LSLLSLYGIHKQKEK | 2372 | 15 | Human | PAP | 241 | | 656 | >81818.18 | 4444 | | |
| 68.0046 | KSRLQGGVLVNEILN | 2373 | 15 | Human | PAP | 255 | | 362 | | >26666.67 | | |
| 68.0047 | GGVLVNEILNHMKRA | 2374 | 15 | Human | PAP | 260 | | 2165 | 700 | 359 | | |
| 68.0048 | IPSYKKLIMYSAHDT | 2375 | 15 | Human | PAP | 277 | | 9.9 | 9728 | 510 | | |
| 68.0049 | YKKLIMYSAHDTTVS | 2376 | 15 | Human | PAP | 280 | | 17 | 22678 | 207 | | |
| 68.0050 | LIMYSAHDTTVSGLQ | 2377 | 15 | Human | PAP | 283 | | 4496 | | 24 | | |
| 68.0051 | DTTVSGLQMALDVYN | 2378 | 15 | Human | PAP | 290 | | 171 | | 4424 | | |

TABLE 19-continued

| | | | | | | | | | | |
|---|---|---|---|---|---|---|---|---|---|---|
| 68.0052 | ALDVYNGLLPPYASC | 2379 | 15 | Human | PAP | 299 | 18 | | 485 | |
| 68.0053 | LDVYNGLLPPYASCH | 2380 | 15 | Human | PAP | 300 | 15 | | 348 | |
| 68.0054 | YNGLLPPYASCHLTE | 2381 | 15 | Human | PAP | 303 | 42 | | 6189 | |
| 68.0056 | FAELVGPVIPQDWST | 2382 | 15 | Human | PAP | 356 | 12 | | 4690 | |
| 68.0147 | TVPLSEDQLLYLPFR | 2383 | 15 | Human | PAP | 145 | 4012 | 332 | 10755 | |
| 68.0153 | LTELYFEKGEYFVEM | 2384 | 15 | Human | PAP | 315 | 2249 | 592 | 8051 | |
| 68.0156 | GPVIPQDWSTECMTT | 2385 | 15 | Human | PAP | 361 | | 52098 | | |
| 868.01 | QAHSLERVCHCLGKWLGHPDK | 2386 | 21 | Human | PLP | 130 | 50000 | | 667 | 500000 |
| F025.03 | WITCQSIAFPSKTSASIGSL | 2387 | 20 | Human | PLP | 181 | | 17308 | 22 | |
| F025.05 | QKGRGYRGQHQAHSLERVCH | 2388 | 20 | Human | PLP | 121 | | >47368.42 | 88 | |
| F025.08 | AATYNFAVLKLMGRGTKF | 2389 | 18 | Human | PLP | 260 | | >52941.18 | 533 | |
| F050.01 | VATGLCFFGVALFCGCGHEA | 2390 | 20 | Human | PLP | 21 | | >112500 | 351 | |
| K-09 | FLYGALLLAEGFYTTGAVRQ | 2391 | 20 | Human | PLP | 81 | | | | |
| K-18 | SAVPVYIYFNTWITCQSIAF | 2392 | 20 | Human | PLP | 171 | | | | |
| 68.0058 | TLSVTWIGAAPLILS | 2393 | 15 | Human | PSA | 5 | 3.1 | >81818.18 | 7273 | |
| 68.0059 | SVTWIGAAPLILSRI | 2394 | 15 | Human | PSA | 7 | 4.1 | >81818.18 | 3152 | |
| 68.0060 | VTWIGAAPLILSRIV | 2395 | 15 | Human | PSA | 8 | 8.1 | >81818.18 | 8000 | |
| 68.0061 | SQPWQVLVASRGRAV | 2396 | 15 | Human | PSA | 31 | 66 | >81818.18 | 7628 | |
| 68.0062 | GRAVCGGVLVHPQWV | 2397 | 15 | Human | PSA | 42 | 386 | | >26666.67 | |
| 68.0063 | GVLVHPQWVLTAAHC | 2398 | 15 | Human | PSA | 48 | 87 | 21320 | 67 | |
| 68.0064 | HPQWVLTAAHCIRNK | 2399 | 15 | Human | PSA | 52 | 13 | 3632 | 1621 | |
| 68.0065 | QWVLTAAHCIRNKSV | 2400 | 15 | Human | PSA | 54 | 50 | | 19403 | |
| 68.0066 | AHCIRNKSVILLGRH | 2401 | 15 | Human | PSA | 60 | 578 | 29704 | 69 | |
| 68.0067 | SVILLGRHSLFHPED | 2402 | 15 | Human | PSA | 67 | 717 | 1400 | 12649 | |
| 68.0068 | VILLGRHSLFHPEDT | 2403 | 15 | Human | PSA | 68 | 273 | 8744 | 8208 | |
| 68.0069 | GQVFQVSHSFPHPLY | 2404 | 15 | Human | PSA | 83 | 288 | 45000 | 8.2 | |
| 68.0070 | VFQVSHSFPHPLYDM | 2405 | 15 | Human | PSA | 85 | 16 | >75000 | 25 | |
| 68.0071 | PHPLYDMSLLKNRFL | 2406 | 15 | Human | PSA | 93 | 1315 | | 20787 | |
| 68.0072 | SHDLMLLRLSEPAEL | 2407 | 15 | Human | PSA | 114 | 532 | 6215 | 4051 | |
| 68.0073 | HDLMLLRLSEPAELT | 2408 | 15 | Human | PSA | 115 | 62 | 2867 | 6193 | |
| 68.0074 | TDAVKVMDLPTQEPA | 2409 | 15 | Human | PSA | 129 | >50000 | | >80000 | |
| 68.0077 | LHVISNDVCAQVHPQ | 2410 | 15 | Human | PSA | 172 | 789 | 8318 | 790 | |
| 68.0078 | CAQVHPQKVTKFMLC | 2411 | 15 | Human | PSA | 180 | 10206 | | 2566 | |
| 68.0079 | GGPLVCNGVLQGITS | 2412 | 15 | Human | PSA | 210 | 3353 | | 68 | |
| 68.0080 | GPLVCNGVLQGITSW | 2413 | 15 | Human | PSA | 211 | 1724 | | 30 | |
| 68.0081 | NGVLQGITSWGSEPC | 2414 | 15 | Human | PSA | 216 | 945 | 24942 | 560 | |
| 68.0082 | RPSLYTKVVHYRKWI | 2415 | 15 | Human | PSA | 235 | 6041 | 53785 | 339 | |
| 68.0158 | HSLFHPEDTGQVFQV | 2416 | 15 | Human | PSA | 74 | | 65260 | | |
| 68.0083 | PRWLCAGALVLAGGF | 2417 | 15 | Human | PSM | 18 | 46 | | >20000 | |
| 68.0084 | LGFLFGWFIKSSNEA | 2418 | 15 | Human | PSM | 35 | 10 | >75000 | 1338 | |
| 68.0085 | LDELKAENIKKFLYN | 2419 | 15 | Human | PSM | 62 | 1136 | 1370 | 4842 | |
| 68.0086 | IKKFLYNFTQIPHLA | 2420 | 15 | Human | PSM | 70 | 449 | 8080 | 43 | |
| 68.0087 | KFLYNFTQIPHLAGT | 2421 | 15 | Human | PSM | 72 | 340 | 13805 | 217 | |
| 68.0088 | WKEFGLDSVELAHYD | 2422 | 15 | Human | PSM | 100 | 1139 | 85 | 96 | |
| 68.0089 | LAHYDVLLSYPNKTH | 2423 | 15 | Human | PSM | 110 | 79 | 37533 | 1117 | |
| 68.0090 | GNEIFNTSLFEPPPP | 2424 | 15 | Human | PSM | 135 | 20412 | | >20000 | |
| 68.0096 | GKVFRGNKVKNAQLA | 2425 | 15 | Human | PSM | 206 | 612 | | 1087 | |
| 68.0097 | GNKVKNAQLAGAKGV | 2426 | 15 | Human | PSM | 211 | 677 | | 13333 | |
| 68.0100 | EYAYRRGIAEAVGLP | 2427 | 15 | Human | PSM | 276 | 5.1 | | 213 | |
| 68.0101 | AEAVGLPSIPVHPIG | 2428 | 15 | Human | PSM | 284 | 5.4 | | 9923 | |
| 68.0102 | AVGLPSIPVHPIGYY | 2429 | 15 | Human | PSM | 286 | 3.6 | | 4193 | |
| 68.0103 | IGYYDAQKLLEKMGG | 2430 | 15 | Human | PSM | 297 | 1923 | | 12649 | |
| 68.0105 | TGNFSTQKVKMHIHS | 2431 | 15 | Human | PSM | 334 | 11180 | | 833 | |

TABLE 19-continued

| | | | | | | | | | | | |
|---|---|---|---|---|---|---|---|---|---|---|---|
| 68.0107 | TRIYNVIGTLRGAVE | 2432 | 15 | Human | PSM | 353 | 14 | 33333 | 6.3 | | |
| 68.0109 | ERGVAYINADSSIEG | 2433 | 15 | Human | PSM | 444 | 2440 | | 6761 | | |
| 68.0110 | GVAYINADSSIEGNY | 2434 | 15 | Human | PSM | 446 | 1054 | | 146 | | |
| 68.0111 | DSSIEGNYTLRVDCT | 2435 | 15 | Human | PSM | 453 | 16667 | | 3360 | | |
| 68.0112 | NYTLRVDCTPLMYSL | 2436 | 15 | Human | PSM | 459 | 6804 | 45 | 9.9 | | |
| 68.0113 | CTPLMYSLVHNLTKE | 2437 | 15 | Human | PSM | 466 | 93 | 19437 | 245 | | |
| 68.0114 | DFEVFFQRLGIASGR | 2438 | 15 | Human | PSM | 520 | 143 | | 221 | | |
| 68.0115 | EVFFQRLGIASGRAR | 2439 | 15 | Human | PSM | 522 | 28 | >75000 | 22 | | |
| 68.0116 | TNKFSGYPLYHSVYE | 2440 | 15 | Human | PSM | 543 | 3402 | | 5521 | | |
| 68.0117 | YDPMFKYHLTVAQVR | 2441 | 15 | Human | PSM | 566 | 9.0 | >75000 | 19 | | |
| 68.0118 | DPMFKYHLTVAQVRG | 2442 | 15 | Human | PSM | 567 | 5.7 | >75000 | 9.1 | | |
| 68.0119 | MFKYHLTVAQVRGGM | 2443 | 15 | Human | PSM | 569 | 16 | 29032 | 18 | | |
| 68.0120 | KYHLTVAQVRGGMVF | 2444 | 15 | Human | PSM | 571 | 137 | 33658 | 806 | | |
| 68.0121 | VAQVRGGMVFELANS | 2445 | 15 | Human | PSM | 576 | 228 | | 662 | | |
| 68.0122 | RGGMVFELANSIVLP | 2446 | 15 | Human | PSM | 580 | 10 | 37118 | 229 | | |
| 68.0123 | GMVFELANSIVLPFD | 2447 | 15 | Human | PSM | 582 | 15 | 4604 | 230 | | |
| 68.0124 | VFELANSIVLPFDCR | 2448 | 15 | Human | PSM | 584 | 19 | 667 | 999 | | |
| 68.0125 | ADKIYSISMKHPQEM | 2449 | 15 | Human | PSM | 608 | 22361 | | 5310 | | |
| 68.0126 | IYSISMKHPQEMKTY | 2450 | 15 | Human | PSM | 611 | 8452 | | 16000 | | |
| 68.0127 | PQEMKTYSVSFDSLF | 2451 | 15 | Human | PSM | 619 | 15143 | | 3024 | | |
| 68.0128 | TYSVSFDSLFSAVKN | 2452 | 15 | Human | PSM | 624 | 219 | 101 | 73 | | |
| 68.0130 | VLRMMNDQLMFLERA | 2453 | 15 | Human | PSM | 660 | 118 | 183 | 29 | | |
| 68.0131 | LRMMNDQLMFLERAF | 2454 | 15 | Human | PSM | 661 | 2704 | | 392 | | |
| 68.0133 | RHVIYAPSSHNKYAG | 2455 | 15 | Human | PSM | 688 | 2174 | | 481 | | |
| 68.0134 | RQIYVAAFTVQAAAE | 2456 | 15 | Human | PSM | 730 | 3.7 | 28347 | 1.2 | | |
| 68.0135 | QIYVAAFTVQAAAET | 2457 | 15 | Human | PSM | 731 | 1.6 | 26609 | 1.6 | | |
| 68.0136 | VAAFTVQAAAETLSE | 2458 | 15 | Human | PSM | 734 | 14 | >75000 | 58 | | |
| 68.0165 | YISIINEDGNEIFNT | 2459 | 15 | Human | PSM | 127 | 498 | 397 | 624 | | |
| 68.0166 | ISIINEDGNEIFNTS | 2460 | 15 | Human | PSM | 128 | 507 | 559 | >12965.96 | | |
| 68.0167 | EDFFKLERDMKINCS | 2461 | 15 | Human | PSM | 183 | 2710 | 468 | 226 | | |
| 68.0168 | FFKLERDMKINCSGK | 2462 | 15 | Human | PSM | 185 | 4419 | 121 | 483 | | |
| 68.0170 | GVILYSDPADYFAPG | 2463 | 15 | Human | PSM | 224 | 1566 | 17 | 7508 | | |
| 68.0173 | GAAVVHEIVRSFGTL | 2464 | 15 | Human | PSM | 391 | | 12409 | | | |
| 68.0176 | NSRLLQERGVAYINA | 2465 | 15 | Human | PSM | 438 | 614 | 318 | 5089 | | |
| 68.0177 | VAYINADSSIEGNYT | 2466 | 15 | Human | PSM | 447 | 4716 | 531 | 411 | | |
| 68.0181 | DQLMFLERAFIDPLG | 2467 | 15 | Human | PSM | 666 | | >19667.83 | | | |
| 605.04 | KSNFLNCYVSGFHPSD. | 2468 | 16 | Human B2-μglobulin | | 19 | 2500 | >900000 | 296 | 3125 | |
| 725.01 | AC-NPDAENWNSQFEILEDAA | 2469 | 18 | IEd | MHC derived | Un-known | | | | | 500000 |
| F071.31 | EYLILSARDVLAVVS | 2470 | 15 | *M. leprae* | | 85 | | | 508 | | |
| 829.01 | YKTIAYDEEARR | 2471 | 12 | MT | | 3 | 50000 | 143 | 4000 | 500000 | |
| F196.01 | GEALSTLVVNKIRGT | 2472 | 15 | Mycobacteria | HSP60 | 254 | 292 | 29687 | 1535 | 246 | 30057 |
| F196.03 | PYILLVSSKVSTVKD | 2473 | 15 | Mycobacteria | HSP60 | 216 | 1.1 | 106 | 64 | 13 | 136 |
| F196.05 | EAVLEDPYILLVSSK | 2474 | 15 | Mycobacteria | HSP60 | 210 | 34 | 479 | 233 | 172 | 681 |
| F196.08 | IAGLFLTTEAVVADK | 2475 | 15 | Mycobacteria | HSP60 | 507 | 6.8 | 27189 | 13 | 106 | 67 |
| F196.09 | ALSTLVVNKIRGTFK | 2476 | 15 | Mycobacteria | HSP60 | 256 | 75 | 274 | 648 | 40 | 3626 |
| 27.0404 | MKHILYISFYFILVN | 2477 | 15 | Pf | LSAI | 1 | 5893 | | 189 | | 3385 |
| 1298.09 | KSLLSTNLPYGRTNL | 2478 | | Pf | SSP2 | 116 | 4226 | | 690 | | |
| 100.0011 | HFFLFLLYILFLVKM | 2479 | 15 | Pf | | 13 | 337 | | 260 | | |
| 100.0012 | LFLLYILFLVKMNAL | 2480 | 15 | Pf | | 16 | 1160 | | 283 | | |
| 100.0013 | ILFLVKMNALRRLPV | 2481 | 15 | Pf | | 21 | 0.80 | | 5.6 | | |
| 100.0014 | MNALRRLPVICSFLV | 2482 | 15 | Pf | | 27 | 2.1 | | 13 | | |
| 100.0015 | SAFLESQSMNKIGDD | 2483 | 15 | Pf | | 79 | 549 | | 113 | | |

TABLE 19-continued

| | | | | | | | | | | | | |
|---|---|---|---|---|---|---|---|---|---|---|---|---|
| 100.0016 | LKELIKVGLPSFENL | 2484 | 15 | Pf | | 132 | | 99 | | 163 | | |
| 100.0017 | FENLVAENVKPPKVD | 2485 | 15 | Pf | | 143 | | 56 | | 2372 | | |
| 100.0019 | PATYGIIVPVLTSLF | 2486 | 15 | Pf | | 158 | | 1.03 | | 15 | | |
| 100.0020 | YGIIVPVLTSLFNKV | 2487 | 15 | Pf | | 161 | | 6.0 | | 2.0 | | |
| 100.0034 | LLKIWICNYMKIMNHL | 2488 | 15 | Pf | | 28 | | 121 | | 132 | | |
| 100.0035 | MTLYQIQVMKRNQKQ | 2489 | 15 | Pf | | 43 | | 1219 | | 117 | | |
| 100.0036 | QKQVQMMIMIKFMGV | 2490 | 15 | Pf | | 57 | | 121 | | 213 | | |
| 100.0037 | MIMIKFMGVIYIMII | 2491 | 15 | Pf | | 63 | | 2905 | | 312 | | |
| 100.0038 | GVIYIMIISKKMMRK | 2492 | 15 | Pf | | 70 | | 10 | | 22 | | |
| 100.0039 | LYYLFNQHIKKELYH | 2493 | 15 | Pf | | 285 | | 27 | | 1324 | | |
| 100.0040 | HFNMLKNKMQSSFFM | 2494 | 15 | Pf | | 299 | | 12 | | 18 | | |
| 100.0041 | LDIYQKLYIKQEEQK | 2495 | 15 | Pf | | 353 | | 2834 | | 1492 | | |
| 100.0042 | QKKYIYNLIMNTQNK | 2496 | 15 | Pf | | 366 | | 73 | | 24 | | |
| 100.0043 | YEALIKLLPFSKRIR | 2497 | 15 | Pf | | 381 | | 55 | | 1839 | | |
| 100.0104 | ENEYATGAVRPFQAA | 2498 | 15 | Pf | | 2 | | 4438 | | 281 | | |
| 100.0105 | NYELSKKAVIFTPIY | 2499 | 15 | Pf | | 27 | | 713 | | 536 | | |
| 100.0106 | QKILIKIPVTKNIIT | 2500 | 15 | Pf | | 108 | | 993 | | 303 | | |
| 100.0107 | KCLVISQVSNSDSYK | 2501 | 15 | Pf | | 156 | | 628 | | 16 | | |
| 100.0108 | SKIMKLPKLPISNGK | 2502 | 15 | Pf | | 202 | | 824 | | 6485 | | |
| 100.0109 | FIHFFTWGTMFVPKY | 2503 | 15 | Pf | | 220 | | 745 | | 273 | | |
| 100.0110 | LCNFKKNIIALLIIP | 2504 | 15 | Pf | | 242 | | 9.7 | | 312 | | |
| 100.0111 | KKNIIALLIIPPKIH | 2505 | 15 | Pf | | 246 | | 13 | | 203 | | |
| 100.0112 | ALLIIPPKIHISIEL | 2506 | 15 | Pf | | 251 | | 648 | | 1738 | | |
| 100.0113 | SMEYKKDFLITARKP | 2507 | 15 | Pf | | 274 | | 939 | | 24 | | |
| 100.0114 | KSICFNILSSPLFNNF | 2508 | 15 | Pf | | 7 | | 0.80 | | 16 | | |
| 100.0115 | FKKLKNHVLFLQMMN | 2509 | 15 | Pf | | 173 | | 2.3 | | 28 | | |
| 100.0116 | KNHVLFLQMMNVNLQ | 2510 | 15 | Pf | | 177 | | 12 | | 32 | | |
| 100.0117 | VLFLQMMNVNLQKQL | 2511 | 15 | Pf | | 180 | | 6.3 | | 30 | | |
| 100.0118 | NVNLQKQLLTNHLIN | 2512 | 15 | Pf | | 187 | | 96 | | 2460 | | |
| 100.0119 | QKQLLTNHLINTPKI | 2513 | 15 | Pf | | 191 | | 675 | | 228 | | |
| 100.0120 | NHLINTPKIMPHHII | 2514 | 15 | Pf | | 197 | | 1378 | | 4798 | | |
| 100.0121 | YILLKKILSSRFNQM | 2515 | 15 | Pf | | 239 | | 220 | | 183 | | |
| 100.0122 | FNQMIFVSSIFISFY | 2516 | 15 | Pf | | 250 | | 483 | | 2091 | | |
| 938.05 | KVSCKGSGYTFTAYQMH | 2517 | 17 | Rheumatiod vector | Variable region | | | 5000 | | 381 | 50000 | |
| 620.01 | IAKVPPGPNITAEYGDKWLD | 2518 | 20 | Rye grass | Lolp1 | 1 | | 50000 | >30000 | >666.67 | 500000 | |
| 620.02 | TAEYGDKWLDAKSTWYGKPT | 2519 | 20 | Rye grass | Lolp1 | 11 | | 50000 | >30000 | >666.67 | 16667 | |
| 620.03 | AKSTWYGKPTGAGPKDNGGA | 2520 | 20 | Rye grass | Lolp1 | 21 | | 50000 | >30000 | 667 | 500000 | |
| 620.04 | GAGPKDNGGACGYKDVDKAP | 2521 | 20 | Rye grass | Lolp1 | 31 | | 50000 | >30000 | >666.67 | 500000 | |
| 620.06 | FNGMTGCGNTPIFKDGRGCG | 2522 | 20 | Rye grass | Lolp1 | 51 | | 50000 | 51962 | >666.67 | 500000 | |
| 620.07 | PIFKDGRGCGSCFEIKCTKP | 2523 | 20 | Rye grass | Lolp1 | 61 | | 50000 | 6784 | >666.67 | 500000 | |
| 620.08 | SCFEIKCTKPESCSGEAVTV | 2524 | 20 | Rye grass | Lolp1 | | | 50000 | >900000 | >666.67 | 500000 | |
| 620.12 | AFGSMAKKGEEQNVRSAGEL | 2525 | 20 | Rye grass | Lolp1 | 111 | | 50000 | >30000 | >666.67 | 50000 | |
| 620.21 | TPDKLTGPFTVRYTTEGGTK | 2526 | 20 | Rye grass | Lolp1 | 201 | | 50000 | >900000 | >666.67 | 500000 | |
| 620.22 | VRYTTEGGTKSEVEDVIPEG | 2527 | 20 | Rye grass | Lolp1 | 211 | | 50000 | >30000 | >666.67 | 500000 | |
| 1523.02 | TCVLGKLSQELHKLQ | 2528 | 15 | Salmon | Calcitonin | 6 | | 26 | 29529 | 14848 | 7566 | 9001 |
| 1523.03 | KLSQELHKLQTYPRT | 2529 | 15 | Salmon | Calcitonin | 11 | | 19 | 196889 | 19684 | 2076 | 12198 |
| 1523.04 | LHKLQTYPRTNTGSG | 2530 | 15 | Salmon | Calcitonin | 16 | | 2118 | >205479.45 | 15182 | 9921 | >7403.08 |
| 1523.05 | KLQTYPRTNTGSGTP | 2531 | 15 | Salmon | Calcitonin | 18 | | >10060.36 | >205479.45 | >26490.07 | 114672 | >9806.45 |
| 1523.07 | CCVLGKLSQELHKLQ | 2532 | 15 | Salmon | Calcitonin | 7 | A | 34 | 17387 | 19764 | 31253 | 5299 |
| 1523.08 | CSNLSTCVLGKLSQE | 2533 | 15 | Salmon | Calcitonin | 1 | A | 296 | >205479.45 | 14339 | 28603 | 5340 |
| 1523.09 | TSNLSTTVLGKLSQE | 2534 | 15 | Salmon | Calcitonin | 1 | A | 298 | 86798 | 8016 | 32358 | 9280 |
| 1523.10 | TTVLGKLSQELHKLQ | 2535 | 15 | Salmon | Calcitonin | 6 | A | 133 | 92782 | 22449 | 36802 | >9806.45 |
| 213.19 | DIAAKYKELGY | 2536 | 11 | Sperm whale | Myoglobin | 141 | | | >900000 | >470.59 | | |

TABLE 19-continued

| | | | | | | | | | | | | |
|---|---|---|---|---|---|---|---|---|---|---|---|---|
| 191.25 | ALVRQGLAKVA | 2537 | 11 | Staph. | Nase | 102 | | 1250 | | 190 | 500000 | |
| NASE 011-30 | PATLIKAIDGDTVKLMYKGQ | 2538 | 20 | Staph. | Nase | 11 | | 278 | 6429 | 296 | 3846 | |
| NASE 041-60 | TPETKHPKKGVEKYGPEASA | 2539 | 20 | Staph. | Nase | 41 | | >1000 | >900000 | >500 | 500000 | |
| NASE 051-70 | VEKYGPEASAFTKKMVENAK | 2540 | 20 | Staph. | Nase | 51 | | 50000 | >900000 | 1333 | 500000 | |
| NASE 061-80 | FTKKMVENAKKIEVEFDKGQ | 2541 | 20 | Staph. | Nase | 61 | | >1000 | 11619 | >500 | 500000 | |
| NASE 091-110 | YIYADGKMVNEALVRQGLAK | 2542 | 20 | Staph. | Nase | 91 | | 65 | | 500 | 4167 | |
| NASE 121-140 | HEQHLRKSEAQAKKEKLNIW | 2543 | 20 | Staph. | Nase | 121 | | 50000 | 90000 | 80000 | 16667 | |
| NASE 131-149 | QAKKEKLNIWSEDNADSGQ | 2544 | 19 | Staph. | Nase | 131 | | 50000 | >900000 | 364 | 3125 | |
| 583.02 | YFNNFTVSFWLRVPK | 2545 | 15 | TetTox | | 947 | | 50000 | | 615 | 25000 | |
| 846.02 | FSYFPSI | 2546 | 7 | TetTox | | 593 | A | 50000 | | 889 | 16667 | |
| 846.03 | YSFFPSI | 2547 | 7 | TetTox | | 593 | A | 50000 | | 889 | 500000 | |
| 846.05 | YSYFPSIR | 2548 | 8 | TetTox | | 593 | A | 50000 | >900000 | 667 | 16667 | |
| F074.03 | DPNANPNVDPNANPNVNANPNANPNANP(X4 | 2549 | 117 | Unknown | (MAP)==(T1B)4 | | | | | 738 | >5494.51 | |
| 831.03 | QKWAAVVVPS | 2550 | 10 | Unknown | ClassI A2 | 242 | | 50000 | | 1000 | 50000 | |
| 831.02 | TWQLNGEELIQDMELVETRPAG | 2551 | 22 | Unknown | ClassI Kb 216-237 | 216 | | 50000 | | 889 | 2273 | |
| JR-01 | PEFLEQRRAAVDTYC | 2552 | 15 | Unknown | IEBs2 | | | 5000 | | 80000 | 500000 | |
| F160.33 | STORKUSP33 | 2553 | | Unknown | RAGE | | | | | 617 | 2069 | |
| F089.10 | DYSYLQDSDPDSFQD | 2554 | 15 | Unknown | Tyrosinase | 448 | | >50000 | | 189 | >500000 | >126666.67 |
| F089.23 | DFSYLQDSDPDSFQD | 2555 | 15 | Unknown | Tyrosinase | 448 | SAAS | | | 264 | >500000 | >126666.67 |
| F089.31 | QNILFSNAPLGPQFP | 2556 | 15 | Unknown | Tyrosinase | 56 | SAAS | | | 195 | | |
| F089.35 | QNILLSNAPLVPQFP | 2557 | 15 | Unknown | Tyrosinase | 56 | SAAS | | | 538 | | |
| F160.25 | DYSYLQDSDPDSFQD | 2558 | 15 | Unknown | Tyrosinase | 448 | | | | 316 | >166666.67 | |
| 852.04 | KYVKQNTLKLAT | 2559 | 11 | unknown | | | | 9.9 | | 6.2 | 25000 | |
| F042.06 | P(X)KQNTLKLAT | 2560 | 13 | unknown | | | A | 1.7 | | | | |
| 1466.50 | EEDIEIIPIQEEEY | 2561 | 14 | | CD20 | 249 | A | >9057.97 | >18549.05 | >7518.8 | 12203 | 849 |
| 1387.20 | HQAISPRTLNSPAIF | 2562 | 15 | | | | | 1961 | 298315 | 6214 | 1314 | 3450 |
| 1438.06 | YTDVFSLDPTFTIETT | 2563 | 16 | | | | | | 217 | | | |
| 1519.02 | YAGIRRDGLLLRLVD | 2564 | 15 | | | | A | | 9.6 | | | |
| F192.01 | LFFYRKSVWSKLQSI | 2565 | 15 | | | | | 19 | 30163 | 913 | 1383 | 84 |
| F192.02 | RPIVNMDYVVGARTFRREKR | 2566 | 20 | | | | | 29 | 22 | 3.1 | 21 | 812 |
| F192.03 | RPGLLGASVLGLDDI | 2567 | 15 | | | | | 1789 | 35768 | 6522 | 4414 | 3183 |
| F192.04 | LYFVKVDVTGAYDTI | 2568 | 15 | | | | | 16 | 9.6 | 2.8 | 13 | 14 |
| F192.05 | FAGIRRDGLLLRLVD | 2569 | 15 | | | | | 2381 | 3.6 | 7092 | 3820 | >3365.21 |
| F192.06 | AKTFLRTLVRGVPEY | 2570 | 15 | | | | | 104 | 54159 | 208 | 3326 | 105 |
| F192.07 | YGAVVNLRKTVVNFP | 2571 | 15 | | | | | 13509 | 150175 | 4194 | 4531 | >95000 |
| F192.08 | GTAFVQMPAHGLFPW | 2572 | 15 | | | | | 1.6 | 37275 | 8.1 | 34 | 18 |
| F192.09 | WAGLLLDTRTLEVQS | 2573 | 15 | | | | | 2016 | 22 | 49 | 323 | 1238 |
| F192.10 | RTSIRASLTFNRGFK | 2574 | 15 | | | | | 1430 | 256 | 770 | 177 | 5131 |
| F195.01 | RVIKNSIRLTL | 2575 | 11 | | | | | 3650 | 584 | 9249 | 5389 | 80682 |
| F195.02 | PVIKNSIKLRL | 2576 | 11 | | | | | 1549 | 198 | 34245 | 14612 | 277735 |
| NASE 001-20 | ATSTKKLHKEPATLIKAIDG | 2577 | 21 | | | | | 4.6 | 8018 | 113 | 1020 | |

SEQ ID

TABLE 19-continued

| Peptide | Sequence | NO | DRB1*0701 | DRB1*0802 | DRB1*0901 | DRB1*1101 | DRB1*1302 | DRB1*1501 | DRB3*0101 | DRB4*0101 | DRB5*0101 | DRB5*0201 |
|---|---|---|---|---|---|---|---|---|---|---|---|---|
| 724.01 | AC-NPTKHKWEAAHVAEQLAA | 1919 | | 25000 | | >33333.33 | >10000 | 200000 | 101 | | 1250 | |
| 631.02 | DDYVKQYTKQYTKQNTLKK | 1920 | 12500 | | | >1111.11 | | | >11111.11 | | 35 | |
| 702.02 | AAAKAAAAAAYAA | 1921 | 12500 | | | 200000 | | | 6250 | | 2857 | |
| 702.08 | AC-AAAKAAAAAAYAA | 1922 | | | | | | | | | | |
| 702.17 | (20)AYA(20)A(20)A(20)K(20)A(20) | 1923 | 8333 | | | 200000 | | | | | 2857 | |
| 730.08 | AC-AAAKATAAAAYAA | 1924 | | | | | | | | | | |
| 730.09 | AC-AAAKAAAAAAFAA | 1925 | | | | | | | | | | |
| 730.12 | AC-AAAKATAAAA(10)AA | 1926 | | | | | | | | | | |
| 730.14 | AC-AAAKATAAAA(23)AA | 1927 | | | | | | | | | | |
| 730.15 | AAKAAAAAAA(10)AA | 1928 | | | | | | | | | | |
| 736.03 | AAYAAAATAKAAA | 1929 | | | | | | | | | | |
| 736.08 | AALAAAAAAKAAA | 1930 | 1316 | | | 2222 | | | | | 67 | |
| 736.11 | AAEAAAATAKAAA | 1931 | | | | | | | | | | |
| 736.13 | AAYJJAAAAKAAA | 1932 | | | | | | | | | | |
| 736.16 | AAYAAAAJJKAAA | 1933 | | | | | | | | | | |
| 760.04 | AFLRAAAAAAFAA | 1934 | | | | | | | | | | |
| 760.06 | AFLRQAAAAAFAAY | 1935 | | | | | | | | | | |
| 760.15 | AAFAAAKTAAAFA | 1936 | 67 | | | 4.6 | | | 20000 | | 25 | 6.4 |
| 760.16 | YAAFAAAKTAAAFA | 1937 | 34 | | | 2.6 | | | 33333 | 30 | 9.5 | |
| 760.21 | AALKATAAAAAAA | 1938 | | | | | | | | | | |
| 782.03 | YAR(15)ASQTTLKAKT | 1939 | 1196 | | | 3.9 | | | | | 3.6 | |
| 782.05 | YARF(33)QTTLKAKT | 1940 | | | | | | | | | | |
| 784.03 | PKYFKQRILKFAT | 1941 | | | | | | | | | | |
| 784.11 | PKYFKQGFLKGAT | 1942 | | | | | | | | | | |
| 784.14 | PKYGKQIDLKGAT | 1943 | | | | | | | | | | |
| 787.01 | AAFFFFFGGGGGA | 1944 | | | | | | | | | | |
| 787.02 | AADFFFFFFFFDA | 1945 | | | | | | | | | | |
| 787.12 | AAKGIKIGFGIFA | 1946 | | | | | | | | | | |
| 787.17 | AAFIFIGGGKIKA | 1947 | | | | | | | | | | |
| 787.18 | AAKIFIGFFIDGA | 1948 | | | | | | | | | | |
| 787.21 | AAFIGFGKIKFIA | 1949 | | | | | | | | | | |
| 787.22 | AAKIGFGIKIGFA | 1950 | | | | | | | | | | |
| 787.27 | AAFKIGKFGIFFA | 1951 | | | | | | | | | | |
| 787.32 | AADDDDDDDDDDA | 1952 | | | | | | | | | | |
| 787.35 | (43)AAIGFFFFKKGIA | 1953 | | | | | | | | | | |
| 787.37 | (43)AAFFGIFKIGKFA | 1954 | | | | | | | | | | |
| 787.38 | (43)AADFGIFIDFIIA | 1955 | | | | | | | | | | |
| 787.39 | (43)AAIGGIFIFKKDA | 1956 | | | | | | | | | | |
| 787.53 | (43)AAFIGFGKIKFIA | 1957 | | | | | | | | | | |
| 787.54 | (43)AAKIGFGIKIGFA | 1958 | | | | | | | | | | |
| 787.59 | (43)AAFKIGKFGIFFA | 1959 | | | | | | | | | | |
| 789.02 | AAAKAAAAAAAAF | 1960 | | | | | | | | | | |
| 789.03 | AAAKAAAAAAAFA | 1961 | | | | | | | | | | |
| 789.04 | AAAKAAAAAAFAA | 1962 | | | | | | | | | | |
| 789.06 | AAAKAAAAFAAAA | 1963 | | | | | | | | | | |
| 789.14 | FAAAAAAAAAAAA | 1964 | | | | | | | | | | |
| 789.15 | AAAAAAAAAAAAN | 1965 | | | | | | | | | | |
| 789.16 | AAAAAAAAAAANA | 1966 | | | | | | | | | | |
| 789.24 | AAANAAAAAAAAA | 1967 | | | | | | | | | | |
| 789.28 | AAAAAAAAAAAAS | 1968 | | | | | | | | | | |
| 789.35 | AAAAASAAAAAAA | 1969 | | | | | | | | | | |

TABLE 19-continued

| | | | | | | | | | | | | |
|---|---|---|---|---|---|---|---|---|---|---|---|---|
| 789.39 | ASAAAAAAAAAAA | 1970 | | | | | | | | | | |
| 803.03 | AFAAAKTAA | 1971 | | | | | | | | | | |
| 805.01 | YARFLALTTLRARA | 1972 | | | | | | | | | | |
| 820.01 | YAR(15A)SQTTLKAKT | 1973 | 1786 | | | 2.5 | | | | | 1.4 | 48 |
| 820.02 | YAR(15A)RQTTLKAAA | 1974 | 8333 | | | 1.2 | | | | | 0.94 | 62 |
| 820.03 | (15A)RQTTLKAAA | 1975 | 250000 | | | 1.8 | | | | | 9.5 | 3095 |
| 820.04 | (16A)RQTTLKAAA | 1976 | 250000 | | | 77 | | | | | 4000 | |
| 824.22 | (46)AAKTAAAFA | 1977 | | | | | | | | | | |
| 824.38 | (39)AAAATKAAA | 1978 | | | | | | | | | | |
| 824.46 | (52)AAAATKAAAA | 1979 | | | | | | | | | | |
| 824.54 | (55)AAAATKAAAA | 1980 | | | | | | | | | | |
| 838.01 | A(14)AAAKTAAA | 1981 | 96 | | | 43 | | | | | 120 | |
| 839.03 | AA(14)A(35)ATKAAAA | 1982 | | | | | | | | | | |
| 839.16 | AA(14)AA(36)TKAAAA | 1983 | | | | | | | | | | |
| 851.11 | AFAAAKTAA(72) | 1984 | | | | | | | | | | |
| 862.04 | (49)AAAKT(64)AAA | 1985 | | | | | | | | | | |
| 862.05 | (49)AAAKTA(64)AA | 1986 | | | | | | | | | | |
| 1463.18 | HQAISPRTLNGPGPGSPAIF | 1987 | 5081 | | | 9875 | 638 | 5570 | | 232 | 32930 | |
| Sandoz 362 | YAAFAAAKTAAAFA | 1988 | | | | | | | >4347.83 | | | |
| 541.18 | TEGRCLHYTVDKSKPK | 1989 | >250000 | | | >1250 | | | 4082 | | 2857 | |
| 221.01 | AWVAWRNRCK | 1990 | >12500 | | | >5000 | | | >11111.11 | | 44 | |
| AP18 | IVSDGNGMNAWVAWRNRC | 1991 | >8333.33 | | | 6667 | | | >6250 | | >2222.22 | |
| 857.04 | PHHTALRQAILSWGELMTLA | 1992 | 14434 | | | 3116 | | 5.3 | | 48 | 261 | |
| 510.01 | WMYYHGQRHSDEHHH | 1993 | >250000 | | | >10000 | | | >7692.31 | | >5000 | |
| 510.33 | YIVMSDWTGGA | 1994 | 12500 | | | >6666.67 | | | >33333.33 | | >10000 | |
| 594.09 | AHAAHAAHAAHAAHAA | 1995 | >250000 | | | 200000 | | | | | 200000 | |
| F116.01 | MDIDPYKEFGATVELLSFLPSDFFP | 1996 | 6609 | | | | 2415 | | | | | |
| 799.06 | GMLPVCPLIPGSSTTSTGP | 1997 | 250000 | | | 2500 | | | >25000 | | 200000 | |
| 800.02 | LGFFPDHQLDPAFRANT | 1998 | 250000 | | | 6667 | | | 1449 | | 6667 | |
| F197.06 | GYKVLVLNPSV | 1999 | 1516 | 115 | 8789 | 26 | 21 | 126 | | 995 | >11441.65 | |
| F197.05 | LMAFTAAVTS | 2000 | 240 | >40562.91 | 160 | >23337.22 | >2464.79 | 1934 | | 11687 | >12586.53 | |
| F197.01 | TFALWRVSAEEY | 2001 | 927 | 1433 | 517 | 342 | >2569.75 | >12709.5 | | >6608.93 | 25499 | |
| F197.02 | ALWRVSAEEY | 2002 | 7954 | 4099 | 698 | 243 | >6398.54 | >15268.46 | | >7930 | >35587.19 | |
| F197.03 | EEYVEIRQVGDFH | 2003 | 11323 | 13890 | 11154 | 4683 | >1895.99 | 2060 | | 2063 | 9754 | |
| F193.01 | VGGVYLLPRRGPRLGV | 2004 | 351 | | | 88 | >15350.88 | 4.2 | 60753 | 19239 | 12 | |
| F193.02 | VGGAYLLPRRGPRLGV | 2005 | 703 | | | 507 | 24663 | 4.1 | >66533.6 | 37640 | 50 | |
| F193.03 | VGGVALLPRRGPRLGV | 2006 | 61558 | | | 154 | >15350.88 | 8.5 | >66533.6 | 25688 | 20459 | |
| F193.04 | VGGVYALPRRGPRLGV | 2007 | 749 | | | 12 | >15350.88 | 451 | >66533.6 | 26122 | 34 | |
| F193.05 | VGGVYLAPRRGPRLGV | 2008 | 878 | | | 35 | >15350.88 | 55 | >66533.6 | >42059.46 | 76 | |
| F193.06 | VGGVYLLARRGPRLGV | 2009 | 595 | | | 6.5 | 10325 | 2.8 | 17030 | 4338 | 17 | |
| F193.07 | VGGVYLLPARGPRLGV | 2010 | 49 | | | 694 | 201 | 6.5 | 18073 | 18960 | 40 | |
| F193.08 | VGGVYLLRRAGPRLGV | 2011 | 433 | | | 67 | >15350.88 | 6.2 | 91912 | 30707 | 7.9 | |
| F193.09 | GAPLGGAARALAHGV | 2012 | 10773 | | | 24 | 8739 | 1615 | >70972.32 | 3959 | 11983 | |
| F193.10 | GAALGGAARALAHGV | 2013 | 29786 | | | 168 | 19335 | 4483 | >70972.32 | 3509 | 25372 | |
| F193.12 | GAPLAGAARALAHGV | 2014 | 8178 | | | 9.5 | 7215 | 2810 | >70972.32 | 2963 | 7688 | |
| F193.13 | GAPLGAAARALAHGV | 2015 | 6490 | | | 36 | 15091 | 3920 | >70972.32 | 16533 | 4502 | |
| F193.14 | GAPLGGLARALAHGV | 2016 | 66 | | | 12 | 76 | 1805 | 123762 | 3950 | 4256 | |
| F193.15 | GAPLGGALRALAHGV | 2017 | 1418 | | | 83 | 340 | 2068 | >51098.62 | 4889 | 5396 | |
| F193.16 | GAPLGGAAAALAHGV | 2018 | 31907 | | | 43842 | 23810 | 7682 | >51098.62 | 31 | 12916 | |
| F193.17 | GAPLGGAARLLAHGV | 2019 | 57549 | | | 80 | 29412 | 631 | >51098.62 | 2549 | 26684 | |
| F193.18 | GAPLGGAARAAAHGV | 2020 | 31308 | | | 3633 | >23489.93 | >8666.67 | >51098.62 | 41441 | 42463 | |
| F193.20 | GAPLGGAARALAAGV | 2021 | 7419 | | | 45 | 23179 | 5714 | >51098.62 | 3865 | 8354 | |
| 1453.03 | FPDWQNYTPGPGTRF | 2022 | 59625 | 592 | 3013 | >51282.05 | >12027.49 | 35058 | | 33923 | >20533.88 | |

TABLE 19-continued

| | | | | | | | | | | | |
|---|---|---|---|---|---|---|---|---|---|---|---|
| 1453.06 | RFPLTFGWCFKLVPV | 2023 | 4100 | 748 | 1848 | 62289 | 4797 | 514 | | 964 | >20533.88 |
| 1453.09 | RQDILDLWVYHTQGY | 2024 | 1628 | 5039 | 1665 | >51282.05 | 6775 | 723 | | 1326 | 16155 |
| 1453.10 | RQEILDLWVYHTQGF | 2025 | 3052 | 2730 | 3679 | 11113 | 5384 | 985 | | 1071 | >20533.88 |
| 1453.12 | LSHFLKEKGGLEGLI | 2026 | 13676 | 1561 | 23191 | 9460 | >12027.49 | >39737.99 | | 18709 | >20533.88 |
| 1453.13 | LSFFLKEKGGLDGLI | 2027 | 19957 | 1127 | 3501 | 614 | >12027.49 | >39737.99 | | 13214 | 15272 |
| 1453.33 | LEPWNHPGSQPKTACT | 2028 | >72254.34 | 69223 | 34468 | >15325.67 | >11041.01 | 2665 | | 92 | 2939 |
| 1453.40 | QVCFITKGLGISYGR | 2029 | 91 | 41 | 296 | 31 | 92 | 3555 | | 876 | 3950 |
| 1453.42 | QLCFLKKGLGISYGR | 2030 | 3634 | 40 | 200 | 9.5 | 88 | 4212 | | 282 | 1190 |
| 190.11 | PPEESFRFGEEKTTPS | 2031 | >12500 | | | >10000 | | | >14285.71 | | >2857.14 |
| 85.0002 | CIVYRDGNPYAVCDK | 2032 | >17182.13 | | 31865 | >14662.76 | 1646 | 650 | | >24786.32 | >10666.67 |
| 85.0003 | HYCYSLYGTTLEQQY | 2033 | 9858 | | 12359 | 12397 | >13725.49 | 4849 | | 1292 | >10666.67 |
| 85.0004 | CYSLYGTTLEQQYNK | 2034 | >9964.13 | | 25989 | >14662.76 | >13725.49 | 5060 | | 189 | >10666.67 |
| 85.0007 | NTSLQDIEITCVYCK | 2035 | >17182.13 | | 30884 | >14662.76 | 14857 | 678 | | 11710 | >10666.67 |
| 85.0008 | VFEFAFKDLFVVYRD | 2036 | 11583 | | 16797 | 10923 | 7675 | 4871 | | 18117 | >10666.67 |
| 85.0009 | EFAFKDLFVVYRDSI | 2037 | 3688 | | 1882 | 9496 | 9996 | 5355 | | 9072 | 5998 |
| 85.0010 | DLFVVYRDSIPHAAC | 2038 | 5213 | | 2374 | 1163 | 11172 | 2832 | | 2676 | 10741 |
| 85.0011 | FVVYRDSIPHAACHK | 2039 | 5085 | | 2122 | 1194 | 1851 | 349 | | 18144 | 2343 |
| 85.0012 | NTGLYNLLIRCLRCQ | 2040 | 6743 | | 4759 | 14 | 5692 | 67 | | 222 | 598 |
| 85.0013 | IRCLRCQKPLNPAEK | 2041 | 16787 | | 32024 | >14662.76 | >13725.49 | 6928 | | 611 | >10666.67 |
| 85.0014 | PRKLHELSSALEIPY | 2042 | 103 | | 213 | 5990 | 51 | 1116 | | 1710 | >10666.67 |
| 85.0015 | EIPYDELRLNCVYCK | 2043 | >35612.54 | | >39432.18 | >18001.8 | 858 | 2084 | | 9047 | >62305.3 |
| 85.0017 | TEVLDFAFTDLTIVY | 2044 | 1432 | | 349 | >18001.8 | >13059.7 | 561 | | 110 | >62305.3 |
| 85.0018 | VLDFAFTDLTIVYRD | 2045 | 230 | | 252 | 7474 | 3102 | 645 | | 11294 | 14839 |
| 85.0019 | DFAFTDLTIVYRDDT | 2046 | 725 | | 1443 | 14334 | 5008 | 3651 | | 21621 | 675 |
| 85.0020 | TIVYRDDTPHGVCTK | 2047 | >35612.54 | | >39144.05 | >18001.8 | 6280 | 5449 | | >21521.34 | >62305.3 |
| 85.0021 | WYRYSVYGTTLEKLT | 2048 | 107 | | 284 | 1670 | 805 | 421 | | 1039 | 62 |
| 85.0023 | ETTIHNIELQCVECK | 2049 | >35612.54 | | >39432.18 | >18001.8 | 6282 | 11191 | | 112 | >62305.3 |
| 85.0024 | SEVYDFAFADLTVVY | 2050 | 1850 | | 174 | >18001.8 | >13059.7 | 955 | | 1325 | 11802 |
| 85.0025 | VYDFAFADLTVVYRE | 2051 | 7012 | | 155 | >18001.8 | >13059.7 | 9446 | | 10720 | 27275 |
| 85.0026 | DFAFADLTVVYREGN | 2052 | 1728 | | 322 | >18001.8 | 9627 | 4915 | | 17973 | 39785 |
| 85.0027 | TVVYREGNPFGICKL | 2053 | 10064 | | 2407 | >18001.8 | >13059.7 | 13850 | | 16200 | 48840 |
| 85.0028 | GNPFGICKLCLRFLS | 2054 | 13916 | | 45631 | 1084 | 9737 | 1139 | | 196 | 6594 |
| 85.0029 | NYSVYGNTLEQTVKK | 2055 | >14602.8 | | 47481 | >56657.22 | 8614 | 15587 | | >25108.23 | 14326 |
| 85.0030 | KKPLNEILIRCIICQ | 2056 | 7972 | | 13328 | 1299 | 965 | 1870 | | 140 | 26273 |
| 85.0031 | NEILIRCIICQRPLC | 2057 | 16901 | | 26483 | 20827 | 7174 | 18927 | | 883 | >29761.9 |
| 85.0032 | IRCIICQRPLCPQEK | 2058 | >14602.8 | | 40269 | 6757 | 7295 | 25349 | | 510 | 15154 |
| 85.0035 | CIVYRDCIAYAACHIC | 2059 | >14602.8 | | 10186 | 35566 | 12898 | 3847 | | 2578 | 1912 |
| 85.0038 | NTELYNLLIRCLRCQ | 2060 | >14602.8 | | 12528 | 259 | 5674 | 2449 | | 797 | 854 |
| 85.0039 | IRCLRCQKPLNPAEK | 2061 | >14602.8 | | >32271.94 | 21581 | >9641.87 | 27591 | | 447 | 20171 |
| 85.0040 | REVYKFLFTDLRIVY | 2062 | 54 | | 204 | 2263 | 80 | 258 | | 203 | 155 |
| 85.0041 | RIVYRDNNPYGVCIM | 2063 | 8307 | | 24147 | 3446 | 119 | 821 | | 1403 | 20474 |
| 85.0042 | NNPYGVCIMCLRFLS | 2064 | 12020 | | 30895 | 7786 | 4797 | 6662 | | 207 | 7258 |
| 85.0043 | EERVKKPLSEITIRC | 2065 | 9454 | | 19968 | 6877 | 8919 | 132 | | 2990 | 7910 |
| 85.0044 | IRCIICQTPLCPEEK | 2066 | 25186 | | 28062 | 5461 | 17444 | 9766 | | 916 | >51020.41 |
| 85.0046 | EIPLIDLRLSCVYCK | 2067 | 10468 | | 1961 | 47355 | 6936 | 656 | | 861 | 16853 |
| 85.0047 | SCVYCKKELTRAEVY | 2068 | 8446 | | 2010 | 569 | 23385 | 4374 | | 673 | 3197 |
| 85.0049 | VCLLFYSKVRKYRYY | 2069 | 258 | | 1798 | 326 | 309 | 61 | | 2343 | 182 |
| 85.0050 | YYDYSVYGATLESIT | 2070 | 744 | | 1403 | 9122 | 8923 | 1106 | | 32378 | >51020.41 |
| 85.0052 | IRCYRCQSPLTPEEK | 2071 | 13356 | | >36023.05 | 6645 | >14403.29 | 480 | | 28659 | >51020.41 |
| 85.0053 | VYDFVFADLRIVYRD | 2072 | 5962 | | 198 | 12168 | 79 | 855 | | 4392 | >51020.41 |
| 85.0054 | DFVFADLRIVYRDGN | 2073 | 9847 | | 1962 | 6957 | 162 | 1253 | | 6709 | 8433 |
| 85.0055 | RIVYRDGNPFAVCKV | 2074 | 6638 | | 4962 | 174 | 122 | 81 | | 1606 | 3148 |
| 85.0056 | GNPFAVCKVCLRLLS | 2075 | 1034 | | 29300 | 296 | 7389 | 117 | | 126 | 657 |

TABLE 19-continued

| | | | | | | | | | | |
|---|---|---|---|---|---|---|---|---|---|---|
| 85.0058 | KKCLNEILIRCIICQ | 2076 | 16288 | 3997 | 7579 | 731 | 3176 | | 257 | >9925.56 |
| 85.0059 | NEILIRCIICQRPLC | 2077 | 18947 | 22062 | 16056 | 10184 | 8177 | | 372 | >22909.51 |
| 85.0102 | RTAMFQDPQERPRKL | 2078 | 32947 | >25346.4 | 1034 | 17086 | 73192 | | 20481 | 7474 |
| 85.0110 | LFVVYRDSIPHAACH | 2079 | 1998 | 2855 | 1582 | 697 | 437 | | 3580 | 7854 |
| 85.0114 | LTIVYRDDTPHGVCT | 2080 | >72254.34 | >25346.4 | 15880 | 1852 | 27048 | | 16993 | >15267.18 |
| 85.0123 | LCIVYRDCIAYAACH | 2081 | 40121 | 10660 | 9886 | 5662 | 2269 | | 2881 | 9738 |
| 85.0128 | YKFLFTDLRIVYRDN | 2082 | 1516 | 1255 | 10122 | 77 | 2912 | | 1342 | 800 |
| 85.0132 | YNFACTELKLVYRDD | 2083 | 2867 | 2084 | 11615 | 10167 | 3082 | | 12866 | 1673 |
| 85.0133 | LKLVYRDDFPYAVCR | 2084 | 28971 | 18677 | 698 | 699 | 1877 | | 3828 | 9156 |
| 85.0138 | YDFVFADLRIVYRDG | 2085 | 21352 | 5419 | 6540 | 8173 | 25727 | | 10907 | 11161 |
| 85.0139 | LRIVYRDGNPFAVCK | 2086 | 8985 | 14207 | 109 | 123 | 169 | | 1566 | 6820 |
| 85.0061 | HEYMLDLQPETTDLY | 2087 | >18559.76 | 21277 | >56179.78 | 12990 | 30895 | | 2099 | >22909.51 |
| 85.0062 | TLRLCVQSTHVDIRT | 2088 | 3257 | 6368 | 17613 | 932 | 3957 | | 243 | >22909.51 |
| 85.0063 | IRTLEDLLMGTLGIV | 2089 | 895 | 1718 | 1156 | 789 | 2181 | | 23 | 12385 |
| 85.0064 | LEDLLMGTLGIVCPI | 2090 | 261 | 1994 | 8514 | 1693 | 229 | | 1800 | 9475 |
| 85.0065 | DLLMGTLGIVCPICS | 2091 | 963 | 2614 | >56179.78 | 1053 | 1427 | | 4123 | 16198 |
| 85.0066 | KATLQDIVLHLEPQN | 2092 | 9094 | 17726 | 25948 | 603 | 6968 | | 159 | >9925.56 |
| 85.0067 | IDGVNHQHLPARRAE | 2093 | >18559.76 | >39914.85 | >56179.78 | >11475.41 | >36842.11 | | 344 | 12573 |
| 85.0068 | LRAFQQLFLNTLSFV | 2094 | 75 | 174 | 106 | 1.01 | 20 | | 2.2 | 253 |
| 85.0069 | FQQLFLNTLSFVCPW | 2095 | 134 | 2062 | 10311 | 9.3 | 24792 | | 309 | 17330 |
| 85.0070 | QDYVLDLQPEATDLH | 2096 | >18559.76 | >39914.85 | >11918.95 | >11475.41 | >62758.62 | | 1851 | >22909.51 |
| 85.0072 | DIRILQELLMGSFGI | 2097 | 1591 | 282 | 18982 | 5796 | 1625 | | 16 | >55096.42 |
| 85.0073 | IRILQELLMGSFGIV | 2098 | 1998 | 271 | 7978 | 1038 | 294 | | 17 | >55096.42 |
| 85.0074 | ELLMGSFGIVCPNCS | 2099 | 4183 | 949 | >59171.6 | 933 | 1928 | | 206 | >55096.42 |
| 85.0075 | KEYVLDLYPEPTDLY | 2100 | >72254.34 | >49867.02 | >59171.6 | >14767.93 | 3171 | | 476 | >55096.42 |
| 85.0076 | LRTIQQLLMGTVNIV | 2101 | 513 | 181 | 3641 | 6.4 | 265 | | 15 | 32108 |
| 85.0077 | IQQLLMGTVNIVCPT | 2102 | 444 | 156 | 11062 | 9.0 | 2010 | | 166 | >55096.42 |
| 85.0078 | QLLMGTVNIVCPTCA | 2103 | 2947 | 2209 | >59171.6 | 118 | >38396.62 | | 11550 | >55096.42 |
| 85.0079 | RETLQEIVLHLEPQN | 2104 | 25856 | 19109 | 7896 | 11360 | 16220 | | 95 | >55096.42 |
| 85.0081 | LRTLQQLFLSTLSFV | 2105 | 60 | 166 | 208 | 55 | 29 | | 3.1 | 1994 |
| 85.0082 | LQQLFLSTLSFVCPW | 2106 | 272 | 152 | 11693 | 133 | 296 | | 22 | 36943 |
| 85.0083 | KDYILDLQPETTDLH | 2107 | >72254.34 | >49867.02 | >17436.79 | 23654 | >37448.56 | | 490 | >55096.42 |
| 85.0084 | LRTLQQMLLGTLQVV | 2108 | 6909 | 5077 | 907 | 616 | 1697 | | 88 | >46620.05 |
| 85.0085 | LQQMLLGTLQVVCPG | 2109 | 929 | 1692 | >31645.57 | 395 | 1266 | | 1014 | 29198 |
| 85.0086 | QMLLGTLQVVCPGCA | 2110 | 3722 | 2082 | >31645.57 | 874 | 4144 | | 258 | >31446.54 |
| 85.0087 | VPTLQDVVLELTPQT | 2111 | >35360.68 | >30612.24 | >31645.57 | 14985 | 12263 | | 1000 | >31446.54 |
| 85.0088 | LQDVVLELTPQTEID | 2112 | 5673 | 2180 | >31645.57 | 1145 | >33090.91 | | 1116 | >31446.54 |
| 85.0089 | QDVVLELTPQTEIDL | 2113 | 2716 | 1684 | >31645.57 | 10274 | >33090.91 | | 1719 | >31446.54 |
| 85.0090 | CKFVVQLDIQSTKED | 2114 | 4547 | 19282 | >31645.57 | >11437.91 | 22851 | | 301 | >31446.54 |
| 85.0091 | VVQLDIQSTKEDLRV | 2115 | 3762 | 13906 | 7353 | 708 | 5044 | | 226 | 8690 |
| 85.0092 | DLRVVQQLLMGALTV | 2116 | 508 | 1845 | 667 | 57 | 132 | | 9.5 | 10879 |
| 85.0093 | LRVVQQLLMGALTVT | 2117 | 82 | 204 | 314 | 8.9 | 56 | | 7.7 | 8755 |
| 85.0094 | VQQLLMGALTVTCPL | 2118 | 71 | 180 | 11074 | 574 | 526 | | 204 | 7151 |
| 85.0095 | QQLLMGALTVTCPLC | 2119 | 743 | 1170 | 7657 | 1223 | 4461 | | 1470 | >31446.54 |
| 85.0096 | QLLMGALTVTCPLCA | 2120 | 389 | 303 | >31645.57 | 1817 | 3761 | | 2224 | >31446.54 |
| 85.0097 | REYILDLHPEPTDLF | 2121 | 7257 | 29316 | 4152 | 13183 | >33090.91 | | 316 | >31446.54 |
| 85.0098 | TCCYTCGTTVRLCIN | 2122 | 63 | 1374 | 8636 | 739 | 3820 | | 891 | 16033 |
| 85.0099 | VRTLQQLLMGTCTIV | 2123 | 1820 | 496 | 1409 | 37 | 1829 | | 139 | >15267.18 |
| 85.0100 | LQQLLMGTCTIVCPS | 2124 | 2098 | 1638 | 9447 | 753 | 2441 | | 2667 | >15267.18 |
| 85.0145 | MLDLQPETTDLYCYE | 2125 | >72254.34 | >32230.34 | >15209.13 | >12027.49 | >48404.26 | | 20 | >15267.18 |
| 85.0157 | VLDLYPEPTDLYCYE | 2126 | >72254.34 | >32230.34 | >15209.13 | >12027.49 | 21591 | | 18 | >15267.18 |
| 85.0167 | LREYILDLHPEPTDL | 2127 | 21989 | 16462 | 9827 | 12365 | 10949 | | 2040 | >40404.04 |
| 530.12 | HIEFTPTRTDTYACRV | 2128 | >12500 | | 200000 | | | >7142.86 | | 200000 |

TABLE 19-continued

| | | | | | | | | | | | |
|---|---|---|---|---|---|---|---|---|---|---|---|
| 58.0015 | LWWVNNESLPVSPRL | 2129 | | | | | | | | | |
| 843.01 | YEEYVRFDSDVGE | 2130 | 250000 | | | 200000 | | | | | 200000 |
| 843.02 | EEYVRFDSDVGE | 2131 | 250000 | | | 200000 | | | | | 200000 |
| 9001.0001 | APPRLICDSRVLERY | 2132 | 8937 | 11214 | 9348 | >1111111.11 | 149 | 1384 | 1617 | 2840 | 6087 |
| 9001.0002 | ICDSRVLERYLLEAK | 2133 | 57605 | 808 | >78947.37 | 2945 | 20402 | 85 | 16159 | 8550 | 7295 |
| 9001.0003 | VLERYLLEAKEAENI | 2134 | 13067 | 3150 | 6382 | 17227 | 881 | 269 | 340 | 8920 | 6714 |
| 9001.0007 | EHCSLNENITVPDTK | 2135 | 32375 | 6191 | >78947.37 | >1111111.11 | 84 | 12013 | 8307 | 52943 | 6626 |
| 9001.0008 | NENITVPDTKVNFYA | 2136 | 42846 | 1850 | >78947.37 | 17921 | 9338 | 22568 | >38167.94 | >38461.54 | 12214 |
| 9001.0009 | VPDTKVNFYAWKRME | 2137 | 38622 | 422 | >78947.37 | 8861 | 14795 | 333 | >38167.94 | 23602 | 449 |
| 9001.0010 | VNFYAWKRMEVGQQA | 2138 | 40163 | 35 | 1238 | 50 | 14798 | 1194 | 22507 | 1490 | 455 |
| 9001.0011 | WKRMEVGQQAVEVWQ | 2139 | 46062 | 139 | 14696 | 512 | 159 | 1812 | >42194.09 | 238 | 4300 |
| 9001.0012 | VGQQAVEVWQGLALL | 2140 | 4230 | >40511.09 | >78947.37 | >17241.38 | 1313 | 12 | >38167.94 | 3901 | >7785.13 |
| 9001.0013 | VEVWQGLALLSEAVL | 2141 | 6863 | 13411 | 8151 | 5157 | 4473 | 58 | >38167.94 | 1334 | 13794 |
| 9001.0014 | GLALLSEAVLRGQAL | 2142 | 4606 | 2000 | 15148 | 2578 | 1216 | 1939 | >38167.94 | 3.5 | 105 |
| 9001.0015 | SEAVLRGQALLVNSS | 2143 | 1087 | >63636.36 | >78947.37 | 3484 | 7.4 | 151 | 3997 | 23 | 1057 |
| 9001.0016 | RGQALLVNSSQPWEP | 2144 | 319 | 29454 | 8450 | 7698 | 3.4 | 2876 | 6165 | 1554 | 558 |
| 9001.0017 | LVNSSQPWEPLQLHV | 2145 | 8344 | 16920 | >78947.37 | >8163.27 | 504 | 2359 | 18044 | 3412 | 10039 |
| 9001.0018 | QPWEPLQLHVDKAVS | 2146 | 24157 | >63636.36 | 34819 | 8897 | 695 | 12480 | 1924 | 103 | 2929 |
| 9001.0019 | LQLHVDKAVSGLRSL | 2147 | 3213 | 801 | >78947.37 | 910 | 53 | 2707 | 1044 | 31 | 76 |
| 9001.0020 | DKAVSGLRSLTTLLR | 2148 | 615 | 16375 | >78947.37 | 52 | 187 | 60 | 3150 | 2006 | 104 |
| 9001.0021 | GLRSLTTLLRALGAQ | 2149 | 509 | 14 | 1136 | 3.7 | 871 | 6.2 | 12947 | 283 | 2.7 |
| 9001.0022 | TTLLRALGAQKEAIS | 2150 | 4281 | 652 | 4607 | 860 | 1512 | 89 | 33256 | 251 | 21 |
| 9001.0023 | ALGAQKEAISPPDAA | 2151 | >71225.07 | >60214.56 | 15337 | 4212 | >12411.35 | 14216 | >91743.12 | 27294 | 3963 |
| 9001.0024 | KEAISPPDAASAAPL | 2152 | 6661 | 6391 | 5735 | 601 | 9272 | 1201 | 27203 | 2988 | 310 |
| 9001.0025 | PPDAASAAPLRTITA | 2153 | 24937 | >63636.36 | 8674 | 2582 | 10205 | 1267 | 10584 | 182 | 1117 |
| 9001.0026 | SAAPLRTITADTFRK | 2154 | 3646 | 28110 | 2505 | 3883 | 809 | 858 | 2111 | 17 | 45 |
| 9001.0027 | RTITADTFRKLFRVY | 2155 | 3448 | 792 | 4692 | 166 | 95 | 35 | 672 | 1561 | 93 |
| 9001.0028 | DTFRKLFRVYSNFLR | 2156 | 10 | 39 | 307 | 11 | 10 | 0.95 | 43687 | 1029 | 26 |
| 9001.0029 | LFRVYSNFLRGKLKL | 2157 | 5.5 | 28 | 3508 | 173 | 80 | 2.8 | 8981 | 2333 | 2.9 |
| 9001.0030 | SNFLRGKLKLYTGEA | 2158 | 3783 | 1433 | 8099 | 192 | 4730 | 30 | 4075 | 2442 | 5.7 |
| 9001.0031 | KLKLYTGEACRTGDR | 2159 | 8082 | 7683 | 2860 | >17241.38 | 880 | 130 | 17787 | 20089 | 636 |
| 9001.0032 | APPRLITDSRVLERY | 2160 | 629 | 26382 | 8391 | 2750 | 92 | 238 | 710 | 2263 | 698 |
| 9001.0033 | ITDSRVLERYLLEAK | 2161 | 7498 | 967 | >78947.37 | 5279 | >14705.88 | 18 | >42194.09 | 12401 | 621 |
| 9001.0037 | EHTSLNENITVPDTK | 2162 | 37154 | >16333.33 | >78947.37 | >408163.27 | 13 | 11082 | >42194.09 | >29029.03. | 5547 |
| 9001.0038 | KLKLYTGEATRTGDR | 2163 | 8234 | 2008 | >78947.37 | 4364 | 841 | 18 | 5298 | 14838 | 731 |
| 1416.01 | PQPFRPQQPYPQ | 2164 | | | | | | | | 15 | |
| 1416.02 | PFRPQQPYPQ | 2165 | | | | | | | | 42 | |
| 1416.05 | PQPFRPQQPYP | 2166 | | | | | | | | 14 | |
| 1416.07 | PQPFRPQQP | 2167 | | | | | | | | 19 | |
| 1416.08 | KQPFRPQQPYPQ | 2168 | | | | | | | | 56 | |
| 1416.09 | PKPFRPQQPYPQ | 2169 | | | | | | | | 3.4 | |
| 1416.12 | PQPFKPQQPYPQ | 2170 | | | | | | | | 19 | |
| 1416.13 | PQPFRKQQPYPQ | 2171 | | | | | | | | 22 | |
| 1416.15 | PQPFRPQKPYPQ | 2172 | | | | | | | | 22 | |
| 1416.17 | PQPFRPQQPKPQ | 2173 | | | | | | | | 325 | |
| 1416.18 | PQPFRPQQPYKQ | 2174 | | | | | | | | 35 | |
| 1416.19 | PQPFRPQQPYPK | 2175 | | | | | | | | 22 | |
| 1416.20 | QFLGQQQPFPPQ | 2176 | | | | | | | | 2.8 | |
| 1416.21 | FLGQQQPFPPQ | 2177 | | | | | | | | 31 | |
| 1416.22 | LGQQQPFPPQ | 2178 | | | | | | | | 151 | |
| 1416.24 | QFLGQQQPFPP | 2179 | | | | | | | | 2.3 | |
| 1416.26 | QFLGQQQPF | 2180 | | | | | | | | 5.3 | |
| 1416.27 | IRNLALQTLPAMCNVY | 2181 | | | | | | | | 1.9 | |

TABLE 19-continued

| | | | | | | | | | | | |
|---|---|---|---|---|---|---|---|---|---|---|---|
| 1416.28 | NLALQTLPAMCNVY | 2182 | | | | | | | | 27 | |
| 1416.29 | LALQTLPAMCNVY | 2183 | | | | | | | | 153 | |
| 1416.31 | IRNLALQTLPAM | 2184 | | | | | | | | 2.0 | |
| 1416.32 | IRNLALQTLP | 2185 | | | | | | | | 3.0 | |
| F160.05 | EGDAFELTVSCQGGLPK | 2186 | | | | | | | | | |
| F167.02 | ESTGMTPEKVPVSEVMGT | 2187 | >31250 | | | | >17500 | | | >64444.44 | |
| 9000.0001 | FPTIPLSRLFDNASL | 2188 | 3175 | 4969 | 9876 | 30675 | 7495 | 1390 | 2585 | 194 | 5799 |
| 9000.0002 | RLFDNASLRAHRLHQ | 2189 | 1921 | 14985 | 23832 | 12461 | 84 | 85 | 11411 | 3210 | 557 |
| 9000.0003 | LRAHRLHQLAFDTYQ | 2190 | 123 | 5621 | 15115 | 3208 | 7590 | 90 | 19811 | 2.0 | 4471 |
| 9000.0004 | QLAFDTYQEFEEAYI | 2191 | 2580 | >33333.33 | >59523.81 | >15384.62 | 15167 | 23166 | 595 | 11495 | >38610.04 |
| 9000.0005 | QEFEEAYIPKEQKYS | 2192 | 31344 | >33333.33 | >59523.81 | 12821 | >15837.1 | >15582.19 | >54554.47 | >41134.75 | 5418 |
| 9000.0006 | IPKEQKYSFLQNPQT | 2193 | 8305 | 13553 | 79800 | >15384.62 | 13695 | 16207 | 30572 | 55587 | 13118 |
| 9000.0007 | SFLQNPQTSLCFSES | 2194 | 48620 | >33333.33 | 93856 | >15384.62 | 190 | 6513 | 93809 | 21651 | >9647.76 |
| 9000.0008 | TSLCFSESIPTPSNR | 2195 | 1064 | >33333.33 | 4395 | >15384.62 | 99 | 1944 | 3920 | 1883 | >38610.04 |
| 9000.0010 | REETQQKSNLELLRI | 2196 | 51179 | 22467 | 9680 | >15384.62 | 15709 | 9736 | >270270.27 | 52 | 25133 |
| 9000.0011 | SNLELLRISLLLIQS | 2197 | 642 | >33333.33 | 3422 | 23669 | 196 | 59 | >91901.83 | 147 | 50110 |
| 9000.0012 | ISLLLIQSWLEPVQF | 2198 | 83 | >33333.33 | 6247 | 2675 | 120 | 60 | 6765 | 2.5 | >9960.16 |
| 9000.0013 | SWLEPVQFLRSVFAN | 2199 | 589 | 3416 | 3998 | 2715 | 4322 | 136 | >270270.27 | 291 | 4815 |
| 9000.0014 | FLRSVFANSLVYGAS | 2200 | 16 | 13436 | 15127 | 973 | 5.6 | 13 | 157978 | 814 | 141 |
| 9000.0015 | NSLVYGASDSNVYDL | 2201 | 201 | >33333.33 | 3896 | >15384.62 | 14038 | 3640 | 11769 | 1792 | >13046.31 |
| 9000.0016 | SDSNVYDLLKDLEEG | 2202 | 182355 | >33333.33 | >59523.81 | >15384.62 | >17857.14 | >30536.91 | 219298 | >137767.22 | >13046.31 |
| 9000.0018 | GIQTLMGRLEDGSPR | 2203 | 18952 | >33333.33 | 37821 | 4474 | 10433 | 1348 | 186220 | 2110 | 18006 |
| 9000.0019 | RLEDGSPRTGQIFKQ | 2204 | 35120 | >33333.33 | >59523.81 | 7896 | >17857.14 | 9106 | 18119 | 296 | 12580 |
| 9000.0020 | RTGQIFKQTYSKFDT | 2205 | 46 | 16432 | 8515 | 6961 | 66 | 155 | 14736 | 201 | 64 |
| 9000.0021 | QTYSKFDTNSHNDDA | 2206 | 54569 | 7726 | 31341 | >15384.62 | >17857.14 | 25883 | 38715 | >137767.22 | 5787 |
| 9000.0022 | TNSHNDDALLKNYGL | 2207 | 245523 | >33333.33 | >59523.81 | >15384.62 | 5169 | 133 | 130378 | >137767.22 | >13046.31 |
| 9000.0023 | ALLKNYGLLYCFRKD | 2208 | 11915 | >33333.33 | 676 | >15384.62 | 10 | 17 | 2309 | 1230 | 462 |
| 9000.0025 | DMDKVETFLRIVQCR | 2209 | 10484 | 1673 | 16127 | 885 | 1232 | 201 | >27322.4 | 826 | 7447 |
| 9000.0026 | FLRIVQCRSVEGSCGF | 2210 | 7199 | 7262 | 5311 | 2708 | 1017 | 839 | >27322.4 | 1078 | 7102 |
| 9000.0027 | FPTIPLSRLFDNAML | 2211 | 5529 | 1051 | 14964 | 46404 | 9313 | 2770 | 121212 | 216 | 11521 |
| 9000.0028 | RLFDNAMLRAHRLHQ | 2212 | 3297 | 212 | >59523.81 | 267 | 738 | 18 | >270270.27 | 1628 | 58 |
| 9000.0029 | QLAFDTYQEFEQNPQ | 2213 | 21064 | >33333.33 | >59523.81 | >15384.62 | 19718 | >86666.67 | 738 | >32842.58 | >9510.22 |
| 9000.0031 | SFLQNPQTSLCCFRK | 2214 | 7026 | 7069 | 3082 | 3801 | 128 | 103 | >270270.27 | 8500 | 3739 |
| 9000.0033 | SNLELLRICLLLIQS | 2215 | 1222 | 19782 | 3970 | >15384.62 | 773 | 90 | 17024 | 164 | >11771.33 |
| 9000.0034 | ICLLLIQSWLEPVQF | 2216 | 643 | >33333.33 | >59523.81 | >15384.62 | 954 | 1771 | 187970 | 49 | >9510.22 |
| 9000.0035 | NSLVYGASDSNIYDL | 2217 | 297 | >33333.33 | >59523.81 | >15384.62 | 10854 | 971 | 31616 | 3287 | >9510.22 |
| 9000.0036 | SDSNIYDLLKDLEEG | 2218 | >85034.01 | >33333.33 | 50134 | >15384.62 | >16203.7 | >86666.67 | >18726.59 | 24259 | >9510.22 |
| 9000.0037 | DKVETFLRIVQCCGF | 2219 | 697 | 581 | 4080 | 1023 | 1034 | 383 | 6278 | 184 | 6350 |
| 9000.0038 | SFLQNPQTSLTFSES | 2220 | 6197 | >33333.33 | 17714 | >15384.62 | 121 | 1511 | 864 | 17824 | 12365 |
| 9000.0039 | TSLTFSESIPTPSNR | 2221 | 682 | 17602 | 2461 | 22152 | 16 | 176 | >95238.1 | 3476 | >1335.38 |
| 9000.0040 | ALLKNYGLLYTFRKD | 2222 | 5923 | 3616 | 2628 | 1737 | 0.89 | 6.5 | 50 | 1335 | 29 |
| 9000.0041 | LLYTFRKDMDKVETF | 2223 | 53362 | 10448 | >59523.81 | 7905 | >14522.82 | 886 | 941 | 12493 | 154 |
| 9000.0042 | DMDKVETFLRIVQTR | 2224 | 436 | 183 | 51511 | 206 | 3381 | >86666.67 | 13712 | 190 | 1263 |
| 9000.0043 | FLRIVQTRSVEGSTGF | 2225 | 9.8 | 445 | 778 | 143 | 1.5 | 9.8 | 27345 | 21 | 116 |
| 1533.01 | HLDMLRHLYQGCQVV | 2226 | 27027 | 5384 | 12508 | 2076 | 2879 | 359 | 107066 | 163 | 7087 |
| 1533.03 | RLRIVRGTQLFEDNYAL | 2227 | 12 | 6325 | 1834 | 2072 | 5.2 | 31 | 1198 | 120 | 46 |
| 1533.04 | GVGSPYVSRLLGICL | 2228 | 190 | 1317 | 2614 | 696 | 955 | 46 | 148588 | 316 | 14197 |
| 1533.06 | TLERPKTLSPGKNGV | 2229 | 25988 | >75384.62 | >300000 | >52631.58 | 835 | 23264 | >263157.89 | 25739 | 11337 |
| 1533.07 | KIFGSLAFLPESFDGDPA | 2230 | 377 | >75384.62 | 15796 | >52631.58 | 1073 | 2264 | 43745 | 10020 | 8008 |
| 1533.08 | ELVSEFSRMARDPQ | 2231 | 21259 | 4082 | 91575 | 4573 | >71428.57 | 7891 | 15838 | 970 | 4055 |
| F196.02 | GEALSTLVLNRLKVG | 2232 | 3191 | 192 | 20167 | 79 | 29 | 269 | | 1023 | 46 |
| F196.04 | AYVLLSEKKISSIQS | 2233 | 3848 | 27 | 3338 | 51 | 816 | 489 | | 902 | 4517 |
| F196.06 | VASLLTTAEVVVTEI | 2234 | 369 | >118357.49 | 1955 | >18674.14 | >10294.12 | >50837.99 | | >26435.73 | >119047.62 |

TABLE 19-continued

| | | | | | | | | | | | |
|---|---|---|---|---|---|---|---|---|---|---|---|
| F196.07 | KCEFQDAYVILLSEKK | 2235 | 336 | 489 | 185 | 1078 | >10294.12 | >47643.98 | | >19594.59 | 20 |
| F196.10 | ALSTLVLNRLKVGLQ | 2236 | 647 | 4.0 | 2166 | 9.1 | 4.6 | 191 | | 17 | 3.9 |
| 9001.0039 | MSYNLLGFLQRSSNC | 2237 | 1060 | 3421 | 3646 | 3628 | 1190 | 89 | >42194.09 | 6503 | 710 |
| 9001.0040 | LGFLQRSSNCQCQKL | 2238 | 767 | 218 | 3729 | 6025 | 112 | 1397 | >42194.09 | 1167 | 649 |
| 9001.0041 | RSSNCQCQKLLWQLN | 2239 | 9689 | 4530 | 74405 | >408163.27 | 6153 | 802 | 3519 | 21 | 6981 |
| 9001.0042 | QCQKLLWQLNGRLEY | 2240 | 3702 | 2519 | 4669 | 1644. | 227 | 175 | 8709 | 209 | 924 |
| 9001.0043 | LWQLNGRLEYCLKDR | 2241 | 10586 | >16333.33 | 5206 | 4215 | 808 | 893 | 29028 | 15576 | 3241 |
| 9001.0044 | GRLEYCLKDRRNFDI | 2242 | 12108 | 1318 | 25159 | 1707 | 1240 | 940 | 5213 | 15870 | 64725 |
| 9001.0046 | RNFDIPEEIKQLQQF | 2243 | 47893 | >144117.65 | >77319.59 | 7326 | >15418.5 | 2036 | 23832 | 311 | 6854 |
| 9001.0047 | PEEIKQLQQFQKEDA | 2244 | 49505 | 11908 | >77319.59 | 1953 | 13325 | 1873 | >26315.79 | 215 | 675 |
| 9001.0048 | QLQQFQKEDAAVTIY | 2245 | 500 | 4862 | 55351 | >408163.27 | 68 | 1724 | 348 | 1338 | 4270 |
| 9001.0049 | QKEDAAVTIYEMLQN | 2246 | 45455 | >144117.65 | 5989 | >408163.27 | 7315 | 1146 | >42194.09 | 15173 | >10482.18 |
| 9001.0050 | AVTIYEMLQNIFAIF | 2247 | 267 | 6873 | 4540 | 29718 | 109 | 262 | 2828 | 1118 | 14047 |
| 9001.0051 | EMLQNIFAIFRQDSS | 2248 | 3313 | 10429 | 9738 | 36832 | 61 | 1718 | 726 | 164 | 3187 |
| 9001.0052 | IFAIFRQDSSSTGWN | 2249 | 1186 | 4725 | 970 | 4558 | 775 | 204 | 2181 | 30 | 109290 |
| 9001.0053 | RQDSSSTGWNETIVE | 2250 | 36320 | 15135 | 9075 | >42553.19 | 848 | >189583.33 | 9172 | 1497 | 8650 |
| 9001.0054 | STGWNETIVENLLAN | 2251 | 3960 | >144117.65 | >77319.59 | 20576 | 105 | 897 | >26315.79 | 166 | 5822 |
| 9001.0055 | ETIVENLLANVYHQR | 2252 | 21681 | >144117.65 | 8151 | >42553.19 | 8.5 | 1603 | >42194.09 | 2503 | 18559 |
| 9001.0056 | NLLANVYHQRNHLKT | 2253 | 8000 | 453 | 4160 | 8258 | 61 | 20 | >123456.79 | 3071 | 65 |
| 9001.0057 | VYHQRNHLKTVLEEK | 2254 | 6180 | 2101 | >77319.59 | 22002 | 1267 | 1662 | >123456.79 | 9585 | 4.7 |
| 9001.0060 | LEKEDFTRGKRMSSL | 2255 | 946 | 804 | >77319.59 | 698 | 25362 | 14118 | 6267 | 16057 | 4903 |
| 9001.0061 | FTRGKRMSSLHLKRY | 2256 | 136 | 553 | 10925 | 81 | 10245 | 118 | 18836 | 2027 | 84 |
| 9001.0062 | RMSSLHLKRYYGRIL | 2257 | 283 | 277 | 14964 | 1035 | 2532 | 1.3 | >26178.01 | 2255 | 491 |
| 9001.0063 | HLKRYYGRILHYLKA | 2258 | 214 | 237 | 2896 | 2721 | 868 | 0.69 | 6608 | 22 | 2.3 |
| 9001.0064 | YGRILHYLKAKEDSH | 2259 | 900 | 704 | 7577. | 812 | 2783 | 16 | 454545 | 140 | 39 |
| 9001.0065 | HYLKAKEDSHCAWTI | 2260 | 581 | 34851 | >77319.59 | >60606.06 | 11571 | 627 | 301205 | 7501 | 2632 |
| 9001.0066 | KEDSHCAWTIVRVEI | 2261 | 30 | 40000 | 2937 | 9320 | 506 | 1397 | >1754385.96 | 7.9 | 4056 |
| 9001.0067 | CAWTIVRVEILRNFY | 2262 | 746 | 43672 | 757 | 4167 | 147 | 196 | 10300 | 152 | 4143 |
| 9001.0068 | VRVEILRNFYVINRL | 2263 | 14 | 3585 | 485 | 504 | 5.8 | 1.04 | 80386 | 187 | 485 |
| 9001.0069 | RNFYVINRLTGYLRN | 2264 | 527 | 167 | 7600 | 55 | 9.4 | 18 | 689 | 1249 | 5.6 |
| 9001.0070 | MSYNLLGFLQRSSNT | 2265 | 8867 | 900 | 8972 | 3069 | 1334 | 6.8 | 51787 | 4660 | 9.0 |
| 9001.0071 | LGFLQRSSNTQTQKL | 2266 | 420 | 939 | 1345 | 26247 | 21 | 2331 | >1754385.96 | 1041 | 339 |
| 9001.0072 | RSSNTQTQKLLWQLN | 2267 | 27678 | 1283 | >77319.59 | >42553.19 | 169 | 2740 | 751 | 26 | 8545 |
| 9001.0073 | QTQKLLWQLNGRLEY | 2268 | 3099 | 2042 | 2083 | 20654 | 121 | 20 | 6582 | 88 | 417 |
| 9001.0074 | LWQLNGRLEYTLKDR | 2269 | 20198 | 43286 | 16619 | 6521 | 2447 | 853 | 4402 | 14310 | 6004 |
| 9001.0075 | GRLEYTLKDRRNFDI | 2270 | 4961 | 4917 | >77319.59 | 4998 | 1468 | 168 | 9901 | 21427 | 796 |
| 9001.0077 | HYLKAKEDSHTAWTI | 2271 | 801 | 8526 | 10140 | >60606.06 | 2264 | 529 | 35829 | 11750 | 19617 |
| 9001.0078 | KEDSHTAWTIVRVEI | 2272 | 35 | >79032.26 | 6079 | 7443 | 3046 | 1992 | 56205 | 18 | 575 |
| 9001.0079 | TAWTIVRVEILRNFY | 2273 | 29 | 57243 | 404 | 5052 | 72 | 242 | 14419 | 26 | 518 |
| 9001.0080 | LGFLQRSSNCQSQKL | 2274 | 305 | 405 | 13167 | 604 | 131 | 541 | >1754385.96 | 124 | 508 |
| 9001.0081 | RSSNCQSQKLLWQLN | 2275 | 8922 | 6943 | 4062 | >60606.06 | 1960 | 2962 | 68823 | 27 | 4077 |
| 9001.0082 | QSQKLLWQLNGRLEY | 2276 | 1166 | 991 | 5920 | >60606.06 | 155 | 108 | 5609 | 166 | 402 |
| 9000.0044 | GIVEQCCTSICSLYQ | 2277 | >79872.2 | >10047.16 | 13855 | 7940 | 239 | 1280 | 14353 | 4245 | >37593.98 |
| 9000.0046 | TSICSLYQLENYCN | 2278 | >85616.44 | >54444.44 | >63025.21 | >10526.32 | >15021.46 | 837 | 8048 | 13496 | >40322.58 |
| 9000.0053 | GILEQCCTSICSLYQ | 2279 | 54113 | >54444.44 | 16714 | >10526.32 | 858 | 1097 | >18726.59 | 5871 | 19231 |
| 9000.0054 | GIVEQTTTSITSLYQ | 2280 | 788 | >54444.44 | 13304 | >10526.32 | 14 | 849 | >95238.1 | 2303 | >37593.98 |
| 9000.0055 | EQTTTSITSLYQLEN | 2281 | 2230 | >54444.44 | 17381 | >10526.32 | 16949 | 1078 | >18726.59 | 29614 | 48505 |
| 9000.0056 | TSICSLYQLENYCG | 2282 | 247525 | >54444.44 | >83333.33 | >10526.32 | 10346 | 173 | >95238.1 | 1645 | >40322.58 |
| 9000.0057 | TSITSLYQLENYTN | 2283 | 6055 | 26791 | 9947 | 1095 | >17073.17 | 99 | >95238.1 | 3245 | 6048 |
| 9000.0058 | TSITSLYQLENYTG | 2284 | 8371 | 14562 | 46268 | 1014 | >17073.17 | 182 | 92336 | 1658 | 16073 |
| 9000.0059 | GIVEQCCCGSHLVEA | 2285 | 41276 | >54444.44 | >63025.21 | >10526.32 | 15347 | 237 | 14184 | 11017 | >43290.04 |
| 9000.0060 | SLYQLENYCCGERGF | 2286 | 12308 | >54444.44 | >83333.33 | >1111111.11 | >15909.09 | 151 | 92336 | 30978 | >43290.04 |
| 9000.0064 | CCTSICSLYQLENYCC | 2287 | 35604 | >54444.44 | 29845 | >1111111.11 | 7096 | 877 | >18726.59 | 1582 | >40650.41 |

TABLE 19-continued

| | | | | | | | | | | | | |
|---|---|---|---|---|---|---|---|---|---|---|---|---|
| 9000.0065 | GSHLVEALYLVCCN | 2288 | 302 | >54444.44 | 37166 | >1111111.11 | 3259 | 11191 | >18726.59 | 14065 | >46403.71 | |
| 9000.0066 | CCGSHLVEALYLVCC | 2289 | 1822 | >54444.44 | >63025.21 | >10526.32 | 6027 | 12986 | >18726.59 | 11357 | >43290.04 | |
| 9000.0047 | FVNQHLCGSHLVEAL | 2290 | 6791 | >54444.44 | >63025.21 | >1111111.11 | 10595 | 1195 | >95238.1 | 3153 | 47170 | |
| 9000.0048 | QHLCGSHLVEALYLV | 2291 | 86 | >54444.44 | 7422 | >10526.32 | 7624 | 103 | 14819 | 1480 | 32049 | |
| 9000.0049 | GSHLVEALYLVCGER | 2292 | 560 | >54444.44 | 5386 | >10526.32 | 8030 | 1350 | >18726.59 | 372 | 29283 | |
| 9000.0050 | VEALYLVCGERGFFY | 2293 | 3869 | 24623 | 2233 | 3563 | 4403 | 181 | 4443 | 30 | 25543 | |
| 9000.0051 | YLVCGERGFFYTPKT | 2294 | 64644 | >54444.44 | 1520 | >10526.32 | 9272 | 10655 | 92764 | 34450 | 95238 | |
| 9000.0067 | FVNQHLCGSDLVEAL | 2295 | 38662 | >54444.44 | >63025.21 | >1111111.11 | 20248 | 9679 | 10031 | 24511 | >43290.04 | |
| 9000.0068 | FVNQHLTGSHLVEAL | 2296 | 15 | >54444.44 | 41482 | >10526.32 | 12413 | 799 | 94518 | 4084 | >43290.04 | |
| 9000.0070 | QHLTGSHLVEALYLV | 2297 | 38 | >54444.44 | 42312 | >10526.32 | 6862 | 184 | 4027 | 939 | 23716 | |
| 9000.0072 | GSHLVEALYLVTGER | 2298 | 553 | >54444.44 | >63025.21 | >10526.32 | 12185 | 1429 | 18215 | 225 | 11398 | |
| 9000.0073 | VEALYLVCGERGSFY | 2299 | 6485 | >54444.44 | 6311 | >10526.32 | 4288 | 1240 | >95238.1 | 129 | 804 | |
| 9000.0074 | VEALYLVCGERGFLY | 2300 | 5351 | 10565 | 3063 | 55402 | 1871 | 149 | 843 | 19 | 5149 | |
| 9000.0075 | VEALYLVTGERGFFY | 2301 | 195 | 1224 | 683 | 4860 | 1076 | 116 | 17156 | 13 | 78 | |
| 9000.0077 | YLVCGERGFLYTPKT | 2302 | 12842 | >54444.44 | 124 | >1111111.11 | 2120 | >25633.8 | >95238.1 | 33114 | 971 | |
| 9000.0078 | YLVCGERGFFYTDKT | 2303 | 92272 | >54444.44 | 317 | >60606.06 | 1014 | >25633.8 | 616 | 48099 | >28449.5 | |
| 9000.0079 | YLVCGERGFFYTKPT | 2304 | 969 | >54444.44 | 1673 | >60606.06 | 3467 | >25633.8 | 12805 | 40379 | >28449.5 | |
| 9000.0080 | YLVTGERGFFYTPKT | 2305 | 7737 | 29236 | 6295 | 7625 | 2100 | >25633.8 | 13737 | 20721 | >28449.5 | |
| 9000.0081 | YLVTGERGFFYTDKT | 2306 | 5328 | >25789.47 | 2909 | 16849 | 17353 | >25633.8 | 359 | 30824 | >28449.5 | |
| 9000.0082 | YLVTGERGFFYTKPT | 2307 | 78 | 4304 | 195313 | 9341 | 17869 | >21016.17 | 9573 | 27915 | 11926 | |
| 9000.0083 | VCGERGFFYTPKTRR | 2308 | 5494 | 419 | 14379 | 3817 | 34669 | >25633.8 | 17416 | >30999.47 | 92 | |
| 9000.0085 | VTGERGFFYTPKTRR | 2309 | 27824 | 9407 | >300000 | 10116 | 25362 | 2824 | 243902 | >29820.05 | 540 | |
| 68.0001 | MWDLVLSIALSVGCT | 2310 | 3032 | 23046 | 1727 | 81096 | 108 | 11375 | 15205 | 158 | 70711 | |
| 68.0002 | DLVLSIALSVGCTGA | 2311 | 4029 | >245000 | 2200 | >200000 | 98 | 18200 | >14918.69 | 459 | >100000 | |
| 68.0003 | HPQWVLTAAHCLKKN | 2312 | 563 | 1693 | 822 | 981 | 483 | 1219 | 8114 | 1106 | 11 | |
| 68.0004 | QWVLTAAHCLKKNSQ | 2313 | 3402 | 98000 | 4813 | 14213 | >35000 | >45500 | >14918.69 | 14395 | 382 | |
| 68.0005 | GQRVPVSHSFPHPLY | 2314 | 629 | >245000 | 102 | >200000 | 703 | 3960 | >14918.69 | 9860 | >200000 | |
| 68.0006 | RVPVSHSFPHPLYNM | 2315 | 101 | 100021 | 97 | >200000 | 377 | 5518 | >14918.69 | 9213 | 11650 | |
| 68.0007 | PHPLYNMSLLKHQSL | 2316 | 20691 | 3315 | 1592 | 6455 | 3307 | 3873 | >14918.69 | 49 | 1901 | |
| 68.0008 | HPLYNMSLLKHQSLR | 2317 | 1282 | 382 | 199 | 248 | 546 | 472 | >14918.69 | 8.4 | 219 | |
| 68.0009 | NMSLLKHQSLRPDED | 2318 | 20620 | 26496 | 96825 | 25820 | >35000 | >30333.33 | >14918.69 | 105 | >100000 | |
| 68.0010 | SHDLMLLRLSEPAKI | 2319 | 106 | 1327 | 112 | 5267 | 1.8 | 365 | 5361 | 10 | 2031 | |
| 68.0011 | HDLMLLRLSEPAKIT | 2320 | 109 | 544 | 43 | 1147 | 0.83 | 115 | 488 | 12 | 211 | |
| 68.0015 | PEEFLRPRSLQCVSL | 2321 | 5156 | 2207 | 5839 | 10675 | 11667 | 3193 | >14413.38 | 117 | 57537 | |
| 68.0016 | PRSLQCVSLHLLSND | 2322 | 2217 | 6107 | 28307 | 11128 | 3731 | 1597 | 11650 | 544 | 46416 | |
| 68.0017 | NGVLQGITSWGPEPC | 2323 | 2285 | 52234 | 50111 | 32444 | >17500 | 835 | >14413.38 | 5761 | >100000 | |
| 68.0018 | KPAVYTKVVHYRKWI | 2324 | 2401 | 53 | 3677 | 327 | 1947 | 401 | 7186 | 4581 | 23 | |
| 68.0140 | LHLLSNDMCARAYSE | 2325 | 27685 | 50230 | 59904 | 26012 | 1876 | >2367.33 | 1308 | 324 | 28817 | |
| 58.0114 | VGNWQYFFPVIFSKA | 2326 | 100 | | | | | | | | | |
| F160.12 | ESEFQAALSRKVAKL | 2327 | | | | | | | | | | |
| F160.28 | IGHLYIFATCLGLSYDGL | 2328 | | | | | | | | | | |
| F160.30 | VGNWQYFFPVIFSKASDSLQLVFGIELMEVD | 2329 | | | | | | | | | | |
| F160.06 | PAYEKLSAEQSPPPY | 2330 | | | | | | | | | | |
| F160.08 | RNGYRALMDKSLHVGTQCALTRR | 2331 | | | | | | | | | | |
| 613.01 | FFKNIVTFFKNIVT | 2332 | >12500 | | | | | | | | | |
| 825.08 | YKSAHKGFKGVDAQGTLSKI | 2333 | 108 | | | 2000 | | | | | 1333 | 2065 |
| 825.09 | VDAQGTLSKIFKLGGRDSRS | 2334 | 1171 | | | 18 | | | 769 | | 6667 | 1152 |
| 825.10 | AC-ASQKRPSQRHGSKYLATAST | 2335 | 2362 | | | 200000 | | | | | 200000 | 4561 |
| F006.15 | ENPVVHFFKNIVTPR | 2336 | | | | | | 5.2 | | | 463 | |
| F006.21 | ENPVVAFFKNIVTPR | 2337 | | | | | | 2.8 | | | 302 | |
| F006.22 | ENPVVHAFKNIVTPR | 2338 | | | | | | 4.1 | | | 910 | |
| F006.24 | ENPVVHFFANIVTPR | 2339 | | | | | | 2.9 | | | 6235 | |
| F006.30 | ENPVVHFFKNIVTPA | 2340 | | | | | | 2.5 | | | 3333 | |

TABLE 19-continued

| | | | | | | | | | | | |
|---|---|---|---|---|---|---|---|---|---|---|---|
| F006.31 | NPVVHFFKNIVT | 2341 | | | | | | 23 | | | 10000 |
| F006.321 | HFFKNIVTPRTPPY | 2342 | | | | | | 460 | | | 377 |
| F006.34 | NPVVHFFKNIVTPR | 2343 | | | | | | 3.7 | | | 1890 |
| F189.01 | LPVPGVLLKEFTVSGNILTI | 2344 | 57 | | | 216 | 52 | 84 | | 349 | 1840 |
| F189.02 | WITQCFLPVFLAQPPSGQRR | 2345 | 74162 | | | 13208 | 23649 | 726 | | 688 | 286 |
| F189.03 | DHRQLQLSISSCLQQLSLLM | 2346 | 736 | | | >98522.17 | 69 | 67 | | 532 | 63772 |
| F189.04 | YLAMPFATPMEAELARRSLA | 2347 | 526 | | | 3754 | 2813 | 865 | | 1965 | 641 |
| 68.0019 | AAPLLLARAASLSLG | 2348 | 160 | 30 | 64 | 100 | 3.2 | 35 | 10470 | 79 | 79 |
| 68.0020 | APLLLARAASLSLGF | 2349 | 59 | 76 | 124 | 322 | 12 | 91 | 13359 | 59 | 114 |
| 68.0021 | PLLLARAASLSLGFL | 2350 | 162 | 37 | 58 | 1255 | 12 | 118 | >9742.79 | 52 | 151 |
| 68.0022 | SLSLGFLFLLFFWLD | 2351 | 22727 | >122500 | 24620 | 100000 | 639 | 11375 | 3710 | >10955.8 | 66667 |
| 68.0023 | LLFFWLDRSVLAKEL | 2352 | 135 | 163 | 518 | 154 | 24 | 34 | 86 | 7.5 | 134 |
| 68.0024 | DRSVLAKELKFVTLV | 2353 | 2016 | 15815 | 4719 | 20966 | 4410 | 1359 | >14413.38 | 53 | 2217 |
| 68.0025 | AKELKFVTLVFRHGD | 2354 | 606 | 1953 | 2355 | 12309 | 824 | 1529 | 8563 | 51 | 24 |
| 68.0026 | RSPIDTFPTDPIKES | 2355 | >62500 | >245000 | 6124 | >200000 | >35000 | 2373 | >14413.38 | 469 | 28571 |
| 68.0028 | FGQLTQLGMEQHYEL | 2356 | >62500 | 109567 | >187500 | 27217 | >35000 | >22750 | >14413.38 | 543 | 100000 |
| 68.0030 | DRTLMSAMTNLAALF | 2357 | 383 | 2362 | 222 | 2367 | 114 | 871 | 3927 | 57 | 26138 |
| 68.0031 | MSAMTNLAALFPPEG | 2358 | 36084 | 73870 | >187500 | >200000 | 249 | 12384 | 7158 | 1072 | 63246 |
| 68.0032 | MTNLAALFPPEGVSI | 2359 | >125000 | 39231 | 22822 | 141421 | 1310 | 10370 | >8829.24 | 4606 | 141421 |
| 68.0033 | PEGVSIWNPILLWQP | 2360 | 15030 | 28577 | 103096 | 30861 | 444 | 7.2 | 4624 | 107 | 22222 |
| 68.0034 | GVSIWNPILLWQPIP | 2361 | 4992 | 11008 | 3985 | 10287 | 207 | 5.0 | 4428 | 492 | 523 |
| 68.0035 | WNPILLWQPIPVHTV | 2362 | 521 | 115494 | 607 | 19640 | 2259 | 14 | >8829.24 | 81 | 100000 |
| 68.0036 | NPILLWQPIPVHTVP | 2363 | 41 | 12999 | 575 | 599 | 250 | 4.6 | >8829.24 | 67 | 25000 |
| 68.0037 | PILLWQPIPVHTVPL | 2364 | 46 | 21244 | 168 | 4041 | 567 | 6.9 | >8829.24 | 106 | 41491 |
| 68.0038 | ILLWQPIPVHTVPLS | 2365 | 19 | 13091 | 131 | 2343 | 1111 | 65 | >8829.24 | 712 | 28768 |
| 68.0039 | WQPIPVHTVPLSEDQ | 2366 | 159 | >81666.67 | 17518 | >66666.67 | 2692 | >45500 | >8829.24 | 1228 | >100000 |
| 68.0040 | LSGLHGQDLFGIWSK | 2367 | >35714.29 | >81666.67 | >125000 | 30151 | >35000 | 32173 | >8829.24 | 135 | 81650 |
| 68.0041 | YDPLYCESVHNFTLP | 2368 | 838 | 30867 | 643 | 30151 | >35000 | 2136 | >8829.24 | 6901 | 28768 |
| 68.0042 | LPSWATEDTMTKLRE | 2369 | >35714.29 | >81666.67 | >125000 | >66666.67 | >35000 | >45500 | 5973 | >11134.57 | 343 |
| 68.0043 | LRELSELSLLSLYGI | 2370 | 4010 | 9368 | 1614 | 6958 | 3218 | 235 | >14956.63 | 544 | 5185 |
| 68.0044 | LSELSLLSLYGIHKQ | 2371 | 20906 | 1186 | 1450 | 1657 | 1253 | 45 | >13046.31 | 79 | 7.3 |
| 68.0045 | LSLLSLYGIHKQKEK | 2372 | >35714.29 | 1637 | 4959 | 742 | >35000 | 58 | >14956.63 | 772 | 3.4 |
| 68.0046 | KSRLQGGVLVNEILN | 2373 | 2838 | >81666.67 | 5516 | >66666.67 | 318 | >30333.33 | >14956.63 | 713 | >100000 |
| 68.0047 | GGVLVNEILNHMKRA | 2374 | 29463 | 3239 | 54411 | 255 | 49 | 576 | 8124 | 5.8 | 8.7 |
| 68.0048 | IPSYKKLIMYSAHDT | 2375 | 1946 | 60 | 351 | 53 | 2122 | 17 | 9982 | 12 | 191 |
| 68.0049 | YKKLIMYSAHDTTVS | 2376 | 292 | 309 | 107 | 208 | 37 | 15 | 13224 | 5.8 | 5482 |
| 68.0050 | LIMYSAHDTTVSGLQ | 2377 | 731 | 24812 | 813 | >66666.67 | 1752 | 184 | 6828 | 4381 | >100000 |
| 68.0051 | DTTVSGLQMALDVYN | 2378 | 14706 | >245000 | 2876 | >50000 | 3500 | 1042 | 10843 | 961 | >200000 |
| 68.0052 | ALDVYNGLLPPYASC | 2379 | >83333.33 | 588 | 86603 | 182 | >35000 | 1091 | >14956.63 | >10090.47 | 115470 |
| 68.0053 | LDVYNGLLPPYASCH | 2380 | >83333.33 | 404 | 31277 | 194 | >35000 | 3035 | >14956.63 | >10918.67 | 25820 |
| 68.0054 | YNGLLPPYASCHLTE | 2381 | >83333.33 | 14027 | 8022 | 5300 | 11667 | 252 | >14956.63 | >10918.67 | 100000 |
| 68.0056 | FAELVGPVIPQDWST | 2382 | 24056 | >245000 | 39472 | >50000 | >35000 | >45500 | >14956.63 | 983 | >200000 |
| 68.0147 | TVPLSEDQLLYLPFR | 2383 | 11313 | 42162 | 37369 | 26455 | 5300 | >2367.33 | 4323 | 872 | 27221 |
| 68.0153 | LTELYFEKGEYFVEM | 2384 | 13062 | 18841 | 26949 | >18903.59 | 3157 | >2367.33 | 124 | 601 | 6655 |
| 68.0156 | GPVIPQDWSTECMTT | 2385 | | | | | | | 20295 | 961 | |
| 868.01 | QAHSLERVCHCLGKWLGHPDK | 2386 | >250000 | | | 2857 | | | | | 2500 |
| F025.03 | WITCQSIAFPSKTSASIGSL | 2387 | | | | 40000 | | 277 | 37450 | 505 | 400 |
| F025.05 | QKGRGYRGQHQAHSLERVCH | 2388 | | | | 30151 | | >9100 | >500000 | 17951 | 9759 |
| F025.08 | AATYNFAVLKLMGRGTKF | 2389 | | | | 17 | | 239 | 70014 | 1218 | 18 |
| F050.01 | VATGLCFFGVALFCGCGHEA | 2390 | | | | 33333 | | | 117851 | 193333 | |
| K-09 | FLYGALLLAEGFYTTGAVRQ | 2391 | | | | | | 45 | | | 256 |
| K-18 | SAVPVYIYFNTWITCQSIAF | 2392 | | | | | | 92 | | | 20000 |
| 68.0058 | TLSVTWIGAAPLILS | 2393 | 16 | 840 | .5.4 | 6860 | 642 | 97 | 6031 | 3506 | 31 |

TABLE 19-continued

| | | | | | | | | | | |
|---|---|---|---|---|---|---|---|---|---|---|
| 68.0059 | SVTWIGAAPLILSRI | 2394 | 83 | 139 | 30 | 2196 | 420 | 147 | 13676 | 42 | 104 |
| 68.0060 | VTWIGAAPLILSRIV | 2395 | 195 | 731 | 82 | 1779 | 2339 | 552 | >10729.61 | 88 | 147 |
| 68.0061 | SQPWQVLVASRGRAV | 2396 | 385 | 386 | .621 | 135 | 32 | 11259 | >12116.81 | 7562 | 84 |
| 68.0062 | GRAVCGGVLVHPQWV | 2397 | 3582 | >245000 | 8069 | >50000 | 5456 | 12888 | >12116.81 | 62 | 100000 |
| 68.0063 | GVLVHPQWVLTAAHC | 2398 | 153 | 1931 | 365 | 263 | 2427 | 66 | >10729.61 | 6.2 | 1062 |
| 68.0064 | HPQWVLTAAHCIRNK | 2399 | 283 | 1305 | 107 | 785 | 1170 | 6500 | 1324 | 5518 | 40 |
| 68.0065 | QWVLTAAHCIRNKSV | 2400 | 214 | 2598 | 967 | 2169 | 2062 | 13565 | 7342 | 3802 | 35 |
| 68.0066 | AHCIRNKSVILLGRH | 2401 | 2573 | 104 | 715 | 93 | 75 | 88 | 4752 | 8.7 | 3630 |
| 68.0067 | SVILLGRHSLFHPED | 2402 | 26088 | 500 | 5216 | 96 | 96 | 106 | 13045 | 4411 | 16116 |
| 68.0068 | VILLGRHSLFHPEDT | 2403 | 30625 | 737 | 18520 | 344 | 543 | 426 | >12116.81 | 10696 | 100000 |
| 68.0069 | GQVFQVSHSFPHPLY | 2404 | 27 | 548 | 33 | 103 | 146 | 2172 | 1071 | 416 | 128 |
| 68.0070 | VFQVSHSFPHPLYDM | 2405 | 51 | 8751 | 17 | 881 | 83 | 2396 | 23433 | >12491.92 | 897 |
| 68.0071 | PHPLYDMSLLKNRFL | 2406 | 10699 | 29813 | 12836 | >50000 | 11667 | 712 | >13533.63 | 7486 | 3104 |
| 68.0072 | SHDLMLLRLSEPAEL | 2407 | 58 | 3538 | 64 | 4471 | 5.8 | 1099 | 13577 | 12 | 100000 |
| 68.0073 | HDLMLLRLSEPAELT | 2408 | 152 | 3914 | 22 | 2141 | 2.3 | 662 | 5305 | 45 | 10541 |
| 68.0074 | TDAVKVMDLPTQEPA | 2409 | >41666.67 | 20875 | >107142.86 | >50000 | >35000 | >45500 | >13533.63 | 747 | >200000 |
| 68.0077 | LHVISNDVCAQVHPQ | 2410 | 17451 | >122500 | 32671 | >50000 | 239 | 22750 | 1887 | 1087 | >200000 |
| 68.0078 | CAQVHPQKVTKFMLC | 2411 | 32275 | 8731 | 34893 | 18490 | 2192 | 809 | >13533.63 | 604 | 1229 |
| 68.0079 | GGPLVCNGVLQGITS | 2412 | >35714.29 | 9334 | 16308 | 1828 | 36 | 30333 | >6567.28 | 815 | 13417 |
| 68.0080 | GPLVCNGVLQGITSW | 2413 | 4893 | 4187 | 32640 | 915 | 49 | 6310 | 11615 | 646 | 6537 |
| 68.0081 | NGVLQGITSWGSEPC | 2414 | 485 | 5874 | 819 | 9724 | 775 | 258 | 8038 | 4487 | 11619 |
| 68.0082 | RPSLYTKVVHYRKWI | 2415 | 652 | 39 | 5484 | 350 | 4183 | 717 | 2982 | 4897 | 13 |
| 68.0158 | HSLFHPEDTGQVFQV | 2416 | | | | | | | 553 | 11503 | |
| 68.0083 | PRWLCAGALVLAGGF | 2417 | 766 | 26531 | 1439 | >40000 | 20207 | 15167 | 13150 | 883 | 40825 |
| 68.0084 | LGFLFGWFIKSSNEA | 2418 | 2261 | 1421 | 1701 | 7303 | 10104 | 355 | 681 | 9285 | 461 |
| 68.0085 | LDELKAENIKKFLYN | 2419 | 7470 | 1248 | 12778 | 324 | 597 | 414 | 548 | 788 | 150 |
| 68.0086 | IKKFLYNFTQIPHLA | 2420 | 29 | 512 | 160 | 137 | 27 | 305 | 477 | 96 | 658 |
| 68.0087 | KFLYNFTQIPHLAGT | 2421 | 30 | 415 | 54 | 91 | 221 | 227 | 10212 | 256 | 1600 |
| 68.0088 | WKEFGLDSVELAHYD | 2422 | 3511 | 19971 | 7052 | 4935 | 8413 | 22750 | 829 | 5925 | 89443 |
| 68.0089 | LAHYDVLLSYPNKTH | 2423 | 3617 | 415 | 1009 | 380 | 268 | 82 | 1406 | 589 | 172 |
| 68.0090 | GNEIFNTSLFEPPPP | 2424 | >35714.29 | >163333.33 | 10415 | >40000 | 2804 | >91000 | >13164.82 | 835 | >200000 |
| 68.0096 | GKVFRGNKVKNAQLA | 2425 | 2350 | 4121 | 31277 | 894 | 46 | 3373 | 7591 | 7884 | 1385 |
| 68.0097 | GNKVKNAQLAGAKGV | 2426 | >83333.33 | 28904 | 7882 | >66666.67 | >35000 | >45500 | >12462.61 | 1065 | 1218 |
| 68.0100 | EYAYRRGIAEAVGLP | 2427 | 70 | 596 | 67 | 2590 | 5217 | >45500 | 8773 | 6325 | 1204 |
| 68.0101 | AEAVGLPSIPVHPIG | 2428 | 2015 | >490000 | 23102 | >66666.67 | 5456 | 56 | >11848.34 | 12394 | 69336 |
| 68.0102 | AVGLPSIPVHPIGYY | 2429 | 1080 | 4432 | 15377 | 33333 | 1191 | 518 | >11848.34 | 5387 | 38517 |
| 68.0103 | IGYYDAQKLLEKMGG | 2430 | >83333.33 | 8236 | 47246 | >28571.43 | 5729 | 1978 | 17305 | 13588 | 506 |
| 68.0105 | TGNFSTQKVKMHIHS | 2431 | 9407 | 10282 | 1450 | 11856 | 6187 | 3745 | >11848.34 | 508 | 1927 |
| 68.0107 | TRIYNVIGTLRGAVE | 2432 | 4806 | 70 | 2900 | 45 | 1460 | 1605 | 17550 | 447 | 32 |
| 68.0109 | ERGVAYINADSSIEG | 2433 | 34021 | >163333.33 | 25516 | >50000 | 3689 | 30333 | 6846 | 87 | 200000 |
| 68.0110 | GVAYINADSSIEGNY | 2434 | 6244 | 23360 | 3048 | >40000 | 497 | 7610 | 1420 | 477 | 66667 |
| 68.0111 | DSSIEGNYTLRVDCT | 2435 | 14458 | >163333.33 | >187500 | >50000 | 7.6 | 1202 | 576 | 1262 | 16824 |
| 68.0112 | NYTLRVDCTPLMYSL | 2436 | 24597 | 6323 | 48412 | 7116 | 9.0 | 5056 | 25 | 404 | 66667 |
| 68.0113 | CTPLMYSLVHNLTKE | 2437 | 140 | 223 | 249 | 590 | 260 | 426 | 18348 | 58 | 36 |
| 68.0114 | DFEVFFQRLGIASGR | 2438 | 21926 | 122 | 2005 | 128 | 10069 | 10249 | 30745 | 4.2 | 3559 |
| 68.0115 | EVFFQRLGIASGRAR | 2439 | 5311 | 6.3 | 2976 | 31 | 17500 | 4556 | >15037.59 | 51 | 7.9 |
| 68.0116 | TNKFSGYPLYHSVYE | 2440 | 30853 | 614 | 741 | 33333 | >35000 | 489 | >21853.15 | 12466 | 2942 |
| 68.0117 | YDPMFKYHLTVAQVR | 2441 | 158 | 172 | 179 | 252 | 1014 | 1348 | 8137 | 553 | 62 |
| 68.0118 | DPMFKYHLTVAQVRG | 2442 | 168 | 43 | 258 | 69 | 699 | 230 | 7297 | 467 | 11 |
| 68.0119 | MFKYHLTVAQVRGGM | 2443 | 72 | 70 | 266 | 147 | 1615 | 1198 | 3648 | 1062 | 5.8 |
| 68.0120 | KYHLTVAQVRGGMVF | 2444 | 228 | 1519 | 5860 | 859 | 193 | 1222 | >21853.15 | 3446 | 86 |
| 68.0121 | VAQVRGGMVFELANS | 2445 | 4449 | >98000 | 499 | >50000 | 2802 | 117 | >21853.15 | 100 | 64366 |
| 68.0122 | RGGMVFELANSIVLP | 2446 | 41 | 8682 | 33 | >50000 | 4.4 | 94 | 132 | 411 | 413 |

TABLE 19-continued

| | | | | | | | | | | | |
|---|---|---|---|---|---|---|---|---|---|---|---|
| 68.0123 | GMVFELANSIVLPFD | 2447 | 30 | 4995 | 81 | >50000 | 12 | 83 | 234 | 4154 | 903 |
| 68.0124 | VFELANSIVLPFDCR | 2448 | 39 | 36123 | 50 | 11765 | 24 | 477 | 128 | 1215 | 10815 |
| 68.0125 | ADKIYSISMKHPQEM | 2449 | 4098 | 1136 | 3512 | 169 | 4957 | 8273 | >21853.15 | 3550 | 26726 |
| 68.0126 | IYSISMKHPQEMKTY | 2450 | 11573 | 1357 | 12293 | 213 | >35000 | 5025 | >21853.15 | 5356 | 2588 |
| 68.0127 | PQEMKTYSVSFDSLF | 2451 | 1192 | >98000 | 1981 | >50000 | 24749 | 919 | 14564 | 579 | 100000 |
| 68.0128 | TYSVSFDSLFSAVKN | 2452 | 346 | 2256 | 526 | 5981 | 5888 | 3223 | 8547 | 10461 | 61 |
| 68.0130 | VLRMMNDQLMFLERA | 2453 | 17334 | 1700 | 10684 | 2353 | 130 | 127 | 98 | 88 | 85 |
| 68.0131 | LRMMNDQLMFLERAF | 2454 | 17507 | 2492 | 4601 | 1833 | 1314 | 1411 | 1570 | 50 | 758 |
| 68.0133 | RHVIYAPSSHNKYAG | 2455 | 31250 | 11667 | 481 | 13363 | 8750 | 1291 | >62814.07 | 5293 | 88 |
| 68.0134 | RQIYVAAFTVQAAAE | 2456 | 292 | 36 | 91 | 35 | 524 | 166 | 6808 | 47 | 143 |
| 68.0135 | QIYVAAFTVQAAAET | 2457 | 324 | 102 | 65 | 34 | 344 | 252 | 1324 | 50 | 216 |
| 68.0136 | VAAFTVQAAAETLSE | 2458 | 793 | 1420 | 127 | 2126 | 446 | 18200 | 2116 | 464 | 378 |
| 68.0165 | YISIINEDGNEIFNT | 2459 | 23719 | >122500 | 83056 | >18903.59 | 346 | 2713 | 30 | 3705 | 72993 |
| 68.0166 | ISIINEDGNEIFNTS | 2460 | >23105.36 | >122500 | >52337.75 | >18903.59 | 343 | 3006 | 35 | 6394 | >37807.18 |
| 68.0167 | EDFFKLERDMKINCS | 2461 | 8550 | 1439 | >52337.75 | 10433 | 3188 | >3490.6 | 4036 | 7886 | 3494 |
| 68.0168 | FFKLERDMKINCSGK | 2462 | >23105.36 | 8109 | >52337.75 | 9687 | 382 | >3490.6 | 4918 | 98 | 3796 |
| 68.0170 | GVILYSDPADYFAPG | 2463 | 7848 | 106291 | 2473 | >18903.59 | 39 | 965 | 8.8 | 64 | 14168 |
| 68.0173 | GAAVVHEIVRSFGTL | 2464 | | | | | | | 788 | 89 | |
| 68.0176 | NSRLLQERGVAYINA | 2465 | 7997 | 3224 | 2616 | 12812 | 327 | 1229 | 3366 | 699 | 3473 |
| 68.0177 | VAYINADSSIEGNYT | 2466 | 9745 | 105832 | 5467 | >18903.59 | 2147 | >3490.6 | 471 | 841 | >37807.18 |
| 68.0181 | DQLMFLERAFIDPLG | 2467 | | | | | | | 17115 | 6.6 | |
| 605.04 | KSNFLNCYVSGFHPSD. | 2468 | 8333 | | | 5000 | | | | | 2857 |
| 725.01 | AC-NPDAENWNSQFEILEDAA | 2469 | | >25000 | | >33333.33 | >10000 | >10000 | 1000 | | 50000 |
| F071.31 | EYLILSARDVLAVVS | 2470 | | | | 6860 | | 2340 | | 2527 | 4154 |
| 829.01 | YKTIAYDEEARR | 2471 | 250000 | | | 200000 | | >91000 | >50000 | | 200000 |
| F196.01 | GEALSTLVVNKIRGT | 2472 | 2325 | 383 | 40840 | 977 | 55 | 2314 | | 1514 | 108 |
| F196.03 | PYILLVSSKVSTVKD | 2473 | 38 | 12 | 134 | 112 | 7.2 | 22 | | 107 | 32 |
| F196.05 | EAVLEDPYILLVSSK | 2474 | 933 | 1666 | 15032 | 4376 | >10294.12 | >50837.99 | | >26435.73 | 357 |
| F196.08 | IAGLFLTTEAVVADK | 2475 | 230 | 3893 | 409 | 867 | >10294.12 | >50837.99 | | >26435.73 | 606 |
| F196.09 | ALSTLVVNKIRGTFK | 2476 | 396 | 20 | 18035 | 32 | 7.6 | 160 | | 214 | 38 |
| 27.0404 | MKHILYISFYFILVN | 2477 | 1250 | 15558 | | 2082 | | | | | >9523.81 |
| 1298.09 | KSLLSTNLPYGRTNL | 2478 | 50000 | | | | | | | | |
| 100.0011 | HFFLFLLYILFLVKM | 2479 | 42443 | 19641 | | | 84 | 21473 | | 1064 | 10083 |
| 100.0012 | LFLLYILFLVKMNAL | 2480 | 4868 | 10869 | | | 129 | 30829 | | 1290 | 32446 |
| 100.0013 | ILFLVKMNALRRLPV | 2481 | 56 | 19 | | | 0.13 | 1.4 | | 7.6 | 14 |
| 100.0014 | MNALRRLPVICSFLV | 2482 | 488 | 265 | | | 15 | 36 | | 5.7 | 2557 |
| 100.0015 | SAFLESQSMNKIGDD | 2483 | 523 | 21493 | | | 52 | 18689 | | 302 | 243 |
| 100.0016 | LKELIKVGLPSFENL | 2484 | 542 | 1493 | | | 147 | 361 | | 110 | 41322 |
| 100.0017 | FENLVAENVKPPKVD | 2485 | 120215 | >25025.54 | | | 3029 | >50837.99 | | 9297 | 62661 |
| 100.0019 | PATYGIIVPVLTSLF | 2486 | 139 | 181 | | | 0.83 | 2557 | | 118 | 52 |
| 100.0020 | YGIIVPVLTSLFNKV | 2487 | 60 | 793 | | | 0.30 | 223 | | 97 | 80 |
| 100.0034 | LLKIWICNYMKIMNHL | 2488 | 395 | 132 | | | 3.7 | 6.8 | | 12 | 35 |
| 100.0035 | MTLYQIQVMKRNQKQ | 2489 | 31053 | 166 | | | 323 | 2429 | | 82 | 22 |
| 100.0036 | QKQVQMMIMIKFMGV | 2490 | 3618 | 182 | | | 17 | 363 | | 5.3 | 915 |
| 100.0037 | MIMIKFMGVIYIMII | 2491 | 68040 | 66150 | | | 102 | 23611 | | 145 | 12310 |
| 100.0038 | GVIYIMIISKKMMRK | 2492 | 476 | 137 | | | 38 | 173 | | 157 | 46 |
| 100.0039 | LYYLFNQHIKKELYH | 2493 | 10244 | 1771 | | | 327 | 2861 | | 1089 | 606 |
| 100.0040 | HFNMLKNKMQSSFFM | 2494 | 3225 | 185 | | | 54 | 616 | | 934 | 60 |
| 100.0041 | LDIYQKLYIKQEEQK | 2495 | >88339.22 | 1204 | | | 4346 | 47 | | 70 | 6958 |
| 100.0042 | QKKYIYNLIMNTQNK | 2496 | 11942 | 13255 | | | 53 | 844 | | 87 | 245 |
| 100.0043 | YEALIKLLPFSKRIR | 2497 | 3578 | 180 | | | 230 | 36 | | 15 | 11 |
| 100.0104 | ENEYATGAVRPFQAA | 2498 | 4970 | 17329 | | | 9302 | 3007 | | 10026 | >10303.97 |
| 100.0105 | NYELSKKAVIFTPIY | 2499 | 5498 | 141 | | | 410 | 537 | | 136 | 10581 |

TABLE 19-continued

| | | | | | | | | | | | |
|---|---|---|---|---|---|---|---|---|---|---|---|
| 100.0106 | QKILIKIPVTKNIIT | 2500 | 534 | 2240 | | | 332 | 3614 | | 953 | 297 |
| 100.0107 | KCLVISQVSNSDSYK | 2501 | 46383 | 17859 | | | 236 | 403 | | 81 | >42553.19 |
| 100.0108 | SKIMKLPKLPISNGK | 2502 | 83674 | 110 | | | 6460 | 3570 | | 6739 | >10303.97 |
| 100.0109 | FIHFFTWGTMFVPKY | 2503 | 489 | 1699 | | | 328 | 2375 | | 387 | 9608 |
| 100.0110 | LCNFKKNIIALLIIP | 2504 | 423 | 21324 | | | 16 | 29302 | | 99 | >42553.19 |
| 100.0111 | KKNIIALLIIPPKIH | 2505 | 495 | 157 | | | 15 | 32 | | 8.2 | 143 |
| 100.0112 | ALLIIPPKIHISIEL | 2506 | 8.4 | 11957 | | | 162 | 1823 | | 10 | 7135 |
| 100.0113 | SMEYKKDFLITARKP | 2507 | 776 | 8897 | | | 3818 | 4610 | | 10448 | 442 |
| 100.0114 | KSICFNILSSPLFNNF | 2508 | 65 | 152 | | | 25 | 5.9 | | 135 | 32 |
| 100.0115 | FKKLKNHVLFLQMMN | 2509 | 11 | 695 | | | 20 | 29 | | 14 | 59 |
| 100.0116 | KNHVLFLQMMNVNLQ | 2510 | 757 | >120098.04 | | | 36 | 224 | | 22 | >7212.41 |
| 100.0117 | VLFLQMMNVNLQKQL | 2511 | 8441 | 56770 | | | 8.6 | 8200 | | 12 | >7212.41 |
| 100.0118 | NVNLQKQLLTNHLIN | 2512 | 555 | 11245 | | | 28 | 4448 | | 354 | >7212.41 |
| 100.0119 | QKQLLTNHLINTPKI | 2513 | 4412 | 20984 | | | 1.6 | 514 | | 904 | 6595 |
| 100.0120 | NHLINTPKIMPHHII | 2514 | 625 | 1296 | | | 32 | 560 | | 1632 | 8882 |
| 100.0121 | YILLKKILSSRFNQM | 2515 | 8.3 | 18 | | | 1.01 | 26 | | 340 | 83 |
| 100.0122 | FNQMIFVSSIFISFY | 2516 | 854 | 16504 | | | 33 | 3903 | | 1291 | >12484.39 |
| 938.05 | KVSCKGSGYTFTAYQMH | 2517 | 2946 | | | >200000 | | | | | |
| 620.01 | IAKVPPGPNITAEYGDKWLD | 2518 | >12500 | | | 200000 | | | >20000 | | 200000 |
| 620.02 | TAEYGDKWLDAKSTWYGKPT | 2519 | 3125 | | | 200000 | | | >20000 | | 10000 |
| 620.03 | AKSTWYGKPTGAGPKDNGGA | 2520 | >12500 | | | 200000 | | | >20000 | | 10000 |
| 620.04 | GAGPKDNGGACGYKDVDKAP | 2521 | >12500 | | | 200000 | | | >20000 | | 200000 |
| 620.06 | FNGMTGCGNTPIFKDGRGCG | 2522 | >12500 | | | 200000 | | | >20000 | | 200000 |
| 620.07 | PIFKDGRGCGSCFEIKCTKP | 2523 | >12500 | | | 200000 | | | >20000 | | 200000 |
| 620.08 | SCFEIKCTKPESCSGEAVTV | 2524 | 12500 | | | 200000 | | | >20000 | | 200000 |
| 620.12 | AFGSMAKKGEEQNVRSAGEL | 2525 | >12500 | | | 1818 | | | >33333.33 | | 200000 |
| 620.21 | TPDKLTGPFTVRYTTEGGTK | 2526 | >12500 | | | 200000 | | | >25000 | | 200000 |
| 620.22 | VRYTTEGGTKSEVEDVIPEG | 2527 | >12500 | | | 200000 | | | >25000 | | 200000 |
| 1523.02 | TCVLGKLSQELHKLQ | 2528 | 18653 | 7656 | 17895 | 1398 | >12589.93 | 2009 | >263157.89 | 163 | 3986 |
| 1523.03 | KLSQELHKLQTYPRT | 2529 | 85464 | 28656 | 19129 | 2375 | >12589S3 | 287 | >263157.89 | 870 | 37 |
| 1523.04 | LHKLQTYPRTNTGSG | 2530 | 40226 | 1618 | >29228.37 | 6091 | >12589.93 | 157 | >263157.89 | 22948 | 40 |
| 1523.05 | KLQTYPRTNTGSGTP | 2531 | >99206.35 | >51578.95 | >29228.37 | 8210 | 987 | 520 | >263157.89 | >104693.14 | >14044.94 |
| 1523.07 | CCVLGKLSQELHKLQ | 2532 | 41656 | 5640 | 21704 | 5243 | >12589.93 | 570 | >263157.89 | 346 | 5158 |
| 1523.08 | CSNLSTCVLGKLSQE | 2533 | 31837 | 3516 | 7225 | 5263 | 7907 | 4538 | >263157.89 | 11756 | 5709 |
| 1523.09 | TSNLSTTVLGKLSQE | 2534 | 31275 | 2058 | 2469 | 534 | 9333 | 7697 | >263157.89 | 13210 | 2529 |
| 1523.10 | TTVLGKLSQELHKLQ | 2535 | 26113 | 16182 | 23824 | 3524 | 12715 | 525 | >263157.89 | 241 | 10618 |
| 213.19 | DIAAKYKELGY | 2536 | | | | >10000 | | | >25000 | | 200000 |
| 191.25 | ALVRQGLAKVA | 2537 | | | | 200000 | | | | | >10000 |
| NASE 011-30 | PATLIKAIDGDTVKLMYKGQ | 2538 | 8333 | | | >6666.67 | | | 2381 | | 3333 |
| NASE 041-60 | TPETKHPKKGVEKYGPEASA | 2539 | 12500 | | | >6666.67 | | | >25000 | | >4000 |
| NASE 051-70 | VEKYGPEASAFTKKMVENAK | 2540 | 12500 | | | 20000 | | | 16667 | | 34 |
| NASE 061-80 | FTKKMVENAKKIEVEFDKGQ | 2541 | 8333 | | | 6667 | | | >25000 | | 1000 |
| NASE 091-110 | YIYADGKMVNEALVRQGLAK | 2542 | 1563 | | | >6666.67 | | | >5555.56 | | >4000 |
| NASE 121-140 | HEQHLRKSEAQAKKEKLNIW | 2543 | 6250 | | | 200000 | | | >5555.56 | | 11 |
| NASE 131-149 | QAKKEKLNIWSEDNADSGQ | 2544 | >250000 | | | 200000 | | | >5555.56 | | 200000 |
| 583.02 | YFNNFTVSFWLRVPK | 2545 | | | | | | | | | |

TABLE 19-continued

| | | | | | | | | | | | |
|---|---|---|---|---|---|---|---|---|---|---|---|
| 846.02 | FSYFPSI | 2546 | | | | | | | | | |
| 846.03 | YSFFPSI | 2547 | | | | | | | | | |
| 846.05 | YSYFPSIR | 2548 | 7217 | | | 20000 | | | | | >200000 |
| F074.03 | DPNANPNVDPNANPNVNANPNANPNANP(X4 | 2549 | >15625 | | | >12500 | | >7583.33 | | >72500 | >2898.55 |
| 831.03 | QKWAAVVVPS | 2550 | | | | | | | | | |
| 831.02 | TWQLNGEELIQDMELVETRPAG | 2551 | | | | | | | | | |
| JR-01 | PEFLEQRRAAVDTYC | 2552 | 250000 | | | 488 | | | | | 200000 |
| F160.33 | STORKUSP33 | 2553 | | | | | | | | | |
| F089.10 | DYSYLQDSDPDSFQD | 2554 | >250000 | >61250 | >107142.86 | >66666.67 | >35000 | >45500 | | | >40000 |
| F089.23 | DFSYLQDSDPDSFQD | 2555 | >250000 | >61250 | >107142.86 | | >35000 | >91000 | | | >40000 |
| F089.31 | QNILFSNAPLGPQFP | 2556 | | | | | | | | | |
| F089.35 | QNILLSNAPLVPQFP | 2557 | | | | | | | | | |
| F160.25 | DYSYLQDSDPDSFQD | 2558 | | | | | | | | | |
| 852.04 | KYVKQNTLKLAT | 2559 | | | | | | | | | |
| F042.06 | P(X)KQNTLKLAT | 2560 | | | | | | | | | |
| 1466.50 | EEDIEIIPIQEEEY | 2561 | >6742.18 | | 128305 | >20576.13 | | | | | 46083 |
| 1387.20 | HQAISPRTLNSPAIF | 2562 | 39701 | 14848 | 286179 | 33686 | 1036 | 8106 | >83333.33 | 130 | >200000 |
| 1438.06 | YTDVFSLDPTFTIETT | 2563 | | | | | | | | | |
| 1519.02 | YAGIRRDGLLLRLVD | 2564 | | | | | | | | | |
| F192.01 | LFFYRKSVWSKLQSI | 2565 | 84 | 65 | | 12 | 121 | 20 | 5915 | 1933 | 18 |
| F192.02 | RPIVNMDYVVGARTFRREKR | 2566 | 346 | 748 | | 222 | 73 | 43 | 3324 | 160 | 6.6 |
| F192.03 | RPGLLGASVLGLDDI | 2567 | 506 | >61250 | | >93896.71 | 2056 | 6000 | 30212 | 22038 | >88888.89 |
| F192.04 | LYFVKVDVTGAYDTI | 2568 | 5892 | 413 | | 221 | 79 | 9753 | 16 | 22 | 4962 |
| F192.05 | FAGIRRDGLLLRLVD | 2569 | 41148 | 7650 | | 804 | 1294 | 28 | 553 | 1670 | 1355 |
| F192.06 | AKTFLRTLVRGVPEY | 2570 | 25 | 9.2 | | 6.3 | 94 | 829 | 546 | 472 | 3484 |
| F192.07 | YGAVVNLRKTVVNFP | 2571 | 8274 | 113 | | 89 | 11236 | 470 | 51496 | 302 | 36 |
| F192.08 | GTAFVQMPAHGLFPW | 2572 | 90 | 99 | | 17 | 2819 | 1.2 | 769 | 2361 | 43 |
| F192.09 | WAGLLLDTRTLEVQS | 2573 | 186 | >61250 | | 20960 | 92 | 3468 | | 862 | >102040.82 |
| F192.10 | RTSIRASLTFNRGFK | 2574 | 411 | 5475 | | 4807 | 49 | 497 | | 79 | 52 |
| F195.01 | RVIKNSIRLTL | 2575 | 2239 | 1175 | 2566 | 1740 | 32 | 4317 | | 143 | 8834 |
| F195.02 | PVIKNSIKLRL | 2576 | 4091 | 541 | 2851 | 2772 | 77 | 2579 | | 198 | 1039 |
| NASE 001-20 | ATSTKKLHKEPATLIKAIDG | 2577 | 2083 | | | >6666.67 | | | 462 | | 267 |

TABLE 20

| Peptide | Sequence | SEQ ID NO | AA | Organism | Protein | Posi-tion | Ana-log | Dd | Kb | Kd | Db | Ld | Kk |
|---|---|---|---|---|---|---|---|---|---|---|---|---|---|
| 1079.06 | SGPSNTPPEI | 2578 | 10 | Adenovirus | E1A | | | 18500 | >31000 | >10000 | 8.1 | | |
| 1079.14 | RNPRFYNL | 2579 | 8 | Artificial sequence | Con-sensus | | | | 7.9 | | >44000 | | |
| 1164.09 | QPQRGYENF | 2580 | 9 | Artificial sequence | Con-sensus | | A | | | | | 319 | |
| 1420.32 | SEAAYAKKI | 2581 | 9 | Artificial sequence | pool consensus | | A | | | | | | 3.9 |
| 1114.01 | AYAPAKAAI | 2582 | 9 | Artificial sequence | | | Poly | | | 3.5 | | | |
| 1114.03 | AYAEAKAAI | 2583 | 9 | Artificial sequence | | | Poly | | | 50 | | | |
| 1114.05 | AYANAKAAI | 2584 | 9 | Artificial sequence | | | Poly | | | 60 | | | |
| 1114.07 | AYAGAKAAI | 2585 | 9 | Artificial sequence | | | Poly | | | 48 | | | |
| 1114.09 | AYAVAKAAI | 2586 | 9 | Artificial sequence | | | Poly | | | 42 | | | |
| F079.05 | AAAAYAAM | 2587 | 8 | Artificial sequence | | | | | 375 | | >44000 | | |
| F079.06 | AAAAYAAAAM | 2588 | 10 | Artificial sequence | | | | | 228 | | >44000 | | |
| F079.08 | AAAANAAAM | 2589 | 9 | Artificial sequence | | | | | 10960 | | 23 | | |
| F079.09 | AAAAAANAAAM | 2590 | 11 | Artificial sequence | | | | | 31000 | | 257 | | |
| 17.0284 | NAIVFKGL | 2591 | 8 | Chicken | Ova | 176 | | | 484 | | | | |
| 17.0285 | SIINFEKL | 2592 | 8 | Chicken | Ova | 257 | | | 3.7 | | | | |
| 17.0286 | IFYCPIAI | 2593 | 8 | Chicken | Ova | 27 | | | 195 | | | | |
| 17.0296 | KVVRFDKL | 2594 | 8 | Chicken | Ova | 55 | | | 92 | | | | |
| 17.0436 | VYSFSLASRL | 2595 | 10 | Chicken | Ova | 96 | | | | 303 | | | |
| 1025.02 | SIINFEKL | 2596 | 8 | Chicken | Ova | 257 | | >37000 | 1.5 | >10000 | 30508 | | |
| 1152.01 | KVVRFDKL | 2597 | 8 | Chicken | Ova | 55 | | | 37 | | | | |
| 1420.09 | SENDRYRLL | 2598 | 9 | EBV | BZLFI | 209 | A | | | | | | 13 |
| 1091.02 | SFYRNLLWL | 2599 | 9 | Flu | HA | 142 | | | | >10000 | 304 | | |
| 1420.29 | YEANGNLI | 2600 | 8 | Flu | HA | 259 | A | | | | | | 0.65 |
| 17.0043 | MGLIYNRM | 2601 | 8 | Flu | M1 | 128 | | | 16 | | | | |
| 35.0003 | MGYIYNRM | 2602 | 8 | Flu | M1 | 128 | | | 2.3 | | | | |
| 35.0004 | MGIIYNRM | 2603 | 8 | Flu | M1 | 128 | | | 14 | | | | |
| 35.0005 | MGLIFNRM | 2604 | 8 | Flu | M1 | 128 | | | 21 | | | | |
| 1170.05 | MGLIYNRM | 2605 | 8 | Flu | M1 | 128 | | | 9.9 | | | | |
| 35.0006 | RMIQNSLTI | 2606 | 9 | Flu | NP | 55 | | | | | 4.6 | | |
| 35.0007 | RLIQNFLTI | 2607 | 9 | Flu | NP | 55 | | | | | 40 | | |
| 35.0009 | GMRQNATEI | 2608 | 9 | Flu | NP | 17 | | | | | 81 | | |
| 35.0012 | YMRVNGKWM | 2609 | 9 | Flu | NP | 97 | | | | | 50 | | |
| 35.0016 | FYIQMATEL | 2610 | 9 | Flu | NP | 39 | | | | 0.31 | | | |
| 35.0017 | FYIQMCTFL | 2611 | 9 | Flu | NP | 39 | | | | 1.1 | | | |
| 35.0019 | AYERMANIL | 2612 | 9 | Flu | NP | 218 | | | | 233 | | | |
| 35.0021 | AYQRMCNIL | 2613 | 9 | Flu | NP | 218 | | | | 2.7 | | | |
| 35.0022 | AYERMCTIL | 2614 | 9 | Flu | NP | 218 | | | | 4.1 | | | |
| 931.01 | ASNENMETM | 2615 | 9 | Flu | NP | 366 | | >37000 | >31000 | >10000 | 33 | | |
| 1120.13 | TYQRTRALM | 2616 | 9 | Flu | NP | 147 | A | | | 69 | | | |
| 1120.19 | TYQKTRALV | 2617 | 9 | Flu | NP | 147 | A | | | 44 | | | |
| 1120.20 | TYQPTRALV | 2618 | 9 | Flu | NP | 147 | A | | | 17 | | | |
| 1120.22 | TYQFTRALV | 2619 | 9 | Flu | NP | 147 | A | | | 371 | | | |
| 1120.23 | TYQLTRALV | 2620 | 9 | Flu | NP | 147 | A | | | 110 | | | |
| 1420.30 | SDYEGRLI | 2621 | 8 | Flu | NP | 50 | | | | | | | 0.60 |
| 17.0060 | MITQFESL | 2622 | 8 | Flu | NS | 31 | | | 64 | | | | |
| 17.0063 | RTFSFQLI | 2623 | 8 | Flu | NS | 114 | | | 26 | | | | |
| 17.0065 | FSVIFDRL | 2624 | 8 | Flu | NS | 134 | | | 201 | | | | |
| 1170.06 | RTFSFQLI | 2625 | 8 | Flu | NSI | 114 | | | 27 | | | | |
| 1170.12 | MITQFESL | 2626 | 8 | Flu | NSI | 31 | | | 42 | | | | |
| 1170.19 | FSVIFDRL | 2627 | 8 | Flu | NS2 | 134 | | | 115 | | | | |
| 17.0031 | KSSFYRNL | 2628 | 8 | FluA | HA | 158 | | | 209 | | | | |
| 17.0035 | SSLPFQNI | 2629 | 8 | FluA | HA | 305 | | | 53 | | | | |
| 17.0143 | MNIQFTAV | 2630 | 8 | FluA | HA | 403 | | | 131 | | | | |
| 17.0171 | MNYYWTLL | 2631 | 8 | FluA | HA | 244 | | | 169 | | | | |
| 17.0307 | SFYRNLLWL | 2632 | 9 | FluA | HA | 160 | | | | | 46 | | |
| 1170.08 | SSLPFQNI | 2633 | 8 | FluA | HA | 305 | | | 9.5 | | | | |
| 1170.13 | MNIQFTAV | 2634 | 8 | FluA | HA | 403 | | | 26 | | | | |
| 1170.17 | MNYYWTLL | 2635 | 8 | FluA | HA | 244 | | | 56 | | | | |
| 1170.18 | KSSFYRNL | 2636 | 8 | FluA | HA | 158 | | | 117 | | | | |
| 17.0178 | SIIPSGPL | 2637 | 8 | FluA | M1 | 13 | | | 393 | | | | |
| 17.0179 | LSYSAGAL | 2638 | 8 | FluA | M1 | 117 | | | 60 | | | | |
| 1170.10 | LSYSAGAL | 2639 | 8 | FluA | M1 | 117 | | | 31 | | | | |
| 17.0145 | SSISFCGV | 2640 | 8 | FluA | NM | 426 | | | 29 | | | | |
| 17.0319 | TGICNQNII | 2641 | 9 | FluA | NM | 46 | | | | | 13 | | |

TABLE 20-continued

| Peptide | Sequence | SEQ ID NO | AA | Organism | Protein | Position | Analog | Dd | Kb | Kd | Db | Ld | Kk |
|---|---|---|---|---|---|---|---|---|---|---|---|---|---|
| 17.0320 | ITYKNSTWV | 2642 | 9 | FluA | NM | 54 | | | | | 409 | | |
| 17.0324 | FCGVNSDTV | 2643 | 9 | FluA | NM | 430 | | | | | 206 | | |
| 1170.01 | TGICNQNII | 2444 | 9 | FluA | NM | 46 | | | | | 21 | | |
| 1170.03 | FCGVNSDTV | 2645 | 9 | FluA | NM | 430 | | | | | 166 | | |
| 1170.04 | ITYKNSTWV | 2646 | 9 | FluA | NM | 54 | | | | | 276 | | |
| 1170.07 | SSISFCGV | 2647 | 8 | FluA | NM | 426 | | | 2.3 | | | | |
| 17.0051 | IGRFYIQM | 2648 | 8 | FluA | NP | 36 | | | 42 | | | | |
| 17.0197 | MMIWHSNL | 2649 | 8 | FluA | NP | 136 | | | 238 | | | | |
| 17.0328 | ASNENMETM | 2650. | 9 | FluA | NP | 366 | | | | | 41 | | |
| 1170.09 | IGRFYIQM | 2651 | 8 | FluA | NP | 36 | | | 24 | | | | |
| 1170.20 | MMIWHSNL | 2652 | 8 | FluA | NP | 136 | | | 287 | | | | |
| 17.0147 | FFYRYGFV | 2653 | 8 | FluA | POLI | 495 | | | 350 | | | | |
| 17.0208 | KMITQRTI | 2654 | 8 | FluA | POLI | 198 | | | 300 | | | | |
| 17.0209 | RSYLIRAL | 2655 | 8 | FluA | POLI | 215 | | | 103 | | | | |
| 17.0216 | RFYRTCKL | 2656 | 8 | FluA | POLI | 465 | | | 117 | | | | |
| 17.0333 | TALANTIEV | 2657 | 9 | FluA | POLI | 141 | | | | | 16 | | |
| 1170.02 | TALANTIEV | 2658 | 9 | FluA | POLl | 141 | | | | | 3.7 | | |
| 1170.14 | RSYLIRAL | 2659 | 8 | FluA | POLl | 215 | | | 78 | | | | |
| 1170.16 | RFYRTCKL | 2660 | 8 | FluA | POLl | 465 | | | 47 | | | | |
| 17.0225 | VYINTALL | 2661 | 8 | FluA | POL2 | 463 | | | 65 | | | | |
| 1170.11 | VYINTALL | 2662 | 8 | FluA | POL2 | 463 | | | 14 | | | | |
| 17.0232 | VYIEVLHL | 2663 | 8 | FluA | POL3 | 227 | | | 75 | | | | |
| 1170.15 | VYIEVLHL | 2664 | 8 | FluA | POL3 | 227 | | | 21 | | | | |
| F057.08 | WYIPPSLRTL | 2665 | 10 | GAD | | | | | | 96 | | | |
| F163.06 | MURTAZAKDPEPTIDES | 2666 | 0 | GAD65 | | 107 | | | | 0.96 | | | |
| 35.0014 | IYSTVASSL | 2667 | 9 | HA | | 553 | | | | 4.1 | | | |
| 35.0023 | LYEKVKSQL | 2668 | 9 | HA | | 462 | | | | 2.2 | | | |
| 35.0024 | LYQKVKSQL | 2669 | 9 | HA | | 462 | | | | 2.8 | | | |
| 35.0025 | LYEKMKSQL | 2670 | 9 | HA | | 462 | | | | 1.6 | | | |
| 35.0026 | LYEKVFSQL | 2671 | 9 | HA | | 462 | | | | 7.4 | | | |
| 1108.01 | LYQNVGTYV | 2672 | 9 | HA | | 204 | | | | 6.9 | | | |
| 17.0114 | MGLKFRQL | 2673 | 8 | HBV | core | 122 | | | 7.4 | | | | |
| 17.0152 | VSYVNTNM | 2674 | 8 | HBV | core | 115 | | | 60 | | | | |
| 17.0396 | SYVNTNMGL | 2675 | 9 | HBV | core | 116 | | | | 19 | | | |
| 1172.07 | MGLKFRQL | 2676 | 8 | HBV | core | 122 | | | 6.3 | | | | |
| 1172.10 | VSYVNTNM | 2677 | 8 | HBV | core | 115 | | | 33 | | | | |
| 1172.18 | SYVNTNMGL | 2678 | 9 | HBV | core | 116 | | | | 12 | | | |
| 17.0003 | WGPSLYSI | 2679 | 8 | HBV | env | 364 | | 17 | | | | | |
| 17.0108 | ASARFSWL | 2680 | 8 | HBV | env | 329 | | | 323 | | | | |
| 17.0381 | WGPSLYSIL | 2681 | 9 | HBV | env | 364 | | 6.6 | | | | | |
| 17.0382 | TGPCRTCMT | 2682 | 9 | HBV | env | 281 | | 108 | | | | | |
| 17.0425 | WYWGPSLYSI | 2683 | 10 | HBV | env | 362 | | | | 8.3 | | | |
| 1158.02 | IPQSLDSWWTSL | 2684 | 12 | HBV | env | 28 | | | | | | 2.2 | |
| 1164.02 | IPQSLDSYWTSL | 2685 | 12 | HBV | env | 28 | A | | | | | 2.7 | |
| 1172.15 | ASARFSWL | 2686 | 8 | HBV | env | 329 | | | 49 | | | | |
| 1172.17 | WYWGPSLYSI | 2687 | 10 | HBV | env | 362 | | | | 16 | | | |
| F126.02 | APQSLDSWWTSL | 2688 | 12 | HBV | env | 28 | | | | | | 15 | |
| F126.05 | IPQALDSWWTSL | 2689 | 12 | HBV | env | 28 | A | | | | | 6.1 | |
| F126.07 | IPQSLASWWTSL | 2690 | 12 | HBV | env | 28 | A | | | | | 4.2 | |
| F126.08 | IPQSLDAWWTSL | 2691 | 12 | HBV | env | 28 | A | | | | | 4.0 | |
| F126.09 | IPQSLDSAWTSL | 2692 | 12 | HBV | env | 28 | A | | | | | 13 | |
| F126.11 | IPQSLDSWWASL | 2693 | 12 | HBV | env | 28 | A | | | | | 0.34 | |
| F126.12 | IPQSLDSWWTAL | 2694 | 12 | HBV | env | 28 | A | | | | | 134 | |
| F126.14 | EPQSLDSWWTSL | 2695 | 12 | HBV | env | 28 | A | | | | | 86 | |
| F126.16 | IPESLDSWWTSL | 2696 | 12 | HBV | env | 28 | A | | | | | 13 | |
| F126.20 | IPQSLDEWWTSL | 2697 | 12 | HBV | env | 28 | A | | | | | 1.9 | |
| F126.24 | IPQSLDSWWTEL | 2698 | 12 | HBV | env | 28 | A | | | | | 3.0 | |
| F126.26 | RPQSLDSWWTSL | 2699 | 12 | HBV | env | 28 | A | | | | | 60 | |
| F126.28 | IPRSLDSWWTSL | 2700 | 12 | HBV | env | 28 | A | | | | | 160 | |
| F126.29 | IPQRLDSWWTSL | 2701 | 12 | HBV | env | 28 | A | | | | | 23 | |
| F126.30 | IPQSRDSWWTSL | 2702 | 12 | HBV | env | 28 | A | | | | | 21 | |
| F126.31 | IPQSLRSWWTSL | 2703 | 12 | HBV | env | 28 | A | | | | | 12 | |
| F126.32 | IPQSLDRWWTSL | 2704 | 12 | HBV | env | 28 | A | | | | | 5.0 | |
| F126.33 | IPQSLDSRWTSL | 2705 | 12 | HBV | env | 28 | A | | | | | 47 | |
| F126.35 | IPQSLDSWWRSL | 2706 | 12 | HBV | env | 28 | A | | | | | 485 | |
| F126.36 | IPQSLDSWWTRL | 2707 | 12 | HBV | env | 28 | A | | | | | 196 | |
| F126.38 | YPQSLDSWWTSL | 2708 | 12 | HBV | env | 28 | A | | | | | 91 | |
| F126.40 | IPYSLDSWWTSL | 2709 | 12 | HBV | env | 28 | A | | | | | 0.78 | |
| F126.41 | IPQYLDSWWTSL | 2710 | 12 | HBV | env | 28 | A | | | | | 92 | |
| F126.43 | IPQSLYSWWTSL | 2711 | 12 | HBV | env | 28 | A | | | | | 4.7 | |
| F126.44 | IPQSLDYWWTSL | 2712 | 12 | HBV | env | 28 | A | | | | | 1.6 | |
| F126.46 | IPQSLDSWYTSL | 2713 | 12 | HBV | env | 28 | A | | | | | 17 | |
| F126.48 | IPQSLDSWWTYL | 2714 | 12 | HBV | env | 28 | A | | | | | 0.89 | |
| F126.50 | IPGSLDSWWTSL | 2715 | 12 | HBV | env | 28 | A | | | | | 24 | |
| F126.52 | IPQSLDSGWTSL | 2716 | 12 | HBV | env | 28 | A | | | | | 70 | |
| F126.53 | IPQSLDSPWTSL | 2717 | 12 | HBV | env | 28 | A | | | | | 19 | |

TABLE 20-continued

| Peptide | Sequence | SEQ ID NO | AA | Organism | Protein | Position | Analog | Dd | Kb | Kd | Db | Ld | Kk |
|---|---|---|---|---|---|---|---|---|---|---|---|---|---|
| F126.54 | IPQSLDSWGTSL | 2718 | 12 | HBV | env | 28 | A | | | | | 138 | |
| F126.55 | IPQSLDSWPTSL | 2719 | 12 | HBV | env | 28 | A | | | | | 60 | |
| F126.56 | IPQSLDSWWTGL | 2720 | 12 | HBV | env | 28 | A | | | | | 2.5 | |
| F126.57 | IPQSLDSWWTPL | 2721 | 12 | HBV | env | 28 | A | | | | | 1.2 | |
| F126.66 | IPQVLDSWWTSL | 2722 | 12 | HBV | env | 28 | A | | | | | 5.1 | |
| F126.67 | IPQFLDSWWTSL | 2723 | 12 | HBV | env | 28 | A | | | | | 4.3 | |
| F126.68 | IPQPLDSWWTSL | 2724 | 12 | HBV | env | 28 | A | | | | | 6.3 | |
| F126.69 | IPQMLDSWWTSL | 2725 | 12 | HBV | env | 28 | A | | | | | 4.1 | |
| F126.70 | IPQILDSWWTSL | 2726 | 12 | HBV | env | 28 | A | | | | | 12 | |
| F126.71 | IPQLLDSWWTSL | 2727 | 12 | HBV | env | 28 | A | | | | | 0.25 | |
| F126.72 | IPQGLDSWWTSL | 2728 | 12 | HBV | env | 28 | A | | | | | 2.7 | |
| F126.73 | IPQTLDSWWTSL | 2729 | 12 | HBV | env | 28 | A | | | | | 7.7 | |
| F126.74 | IPQHLDSWWTSL | 2730 | 12 | HBV | env | 28 | A | | | | | 39 | |
| F126.75 | IPQCLDSWWTSL | 2731 | 12 | HBV | env | 28 | A | | | | | 25 | |
| F126.76 | IPQNLDSWWTSL | 2732 | 12 | HBV | env | 28 | A | | | | | 12 | |
| F126.77 | IPQQLDSWWTSL | 2733 | 12 | HBV | env | 28 | A | | | | | 1.7 | |
| F126.78 | IPQWLDSWWTSL | 2734 | 12 | HBV | env | 28 | A | | | | | 3.7 | |
| F126.79 | IPQDLDSWWTSL | 2735 | 12 | HBV | env | 28 | A | | | | | 22 | |
| F126.80 | IPQKLDSWWTSL | 2736 | 12 | HBV | env | 28 | A | | | | | 9.3 | |
| F126.81 | IPQSLVSWWTSL | 2737 | 12 | HBV | env | 28 | A | | | | | 11 | |
| F126.82 | IPQSLFSWWTSL | 2738 | 12 | HBV | env | 28 | A | | | | | 11 | |
| F126.83 | IPQSLPSWWTSL | 2739 | 12 | HBV | env | 28 | A | | | | | 16 | |
| F126.84 | IPQSLMSWWTSL | 2740 | 12 | HBV | env | 28 | A | | | | | 0.95 | |
| F126.85 | IPQSLISWWTSL | 2741 | 12 | HBV | env | 28 | A | | | | | 17 | |
| F126.86 | IPQSLLSWWTSL | 2742 | 12 | HBV | env | 28 | A | | | | | 0.84 | |
| F126.87 | IPQSLGSWWTSL | 2743 | 12 | HBV | env | 28 | A | | | | | 2.7 | |
| F126.88 | IPQSLSSWWTSL | 2744 | 12 | HBV | env | 28 | A | | | | | 0.49 | |
| F126.89 | IPQSLTSWWTSL | 2745 | 12 | HBV | env | 28 | A | | | | | 1.7 | |
| F126.90 | IPQSLHSWWTSL | 2746 | 12 | HBV | env | 28 | A | | | | | 1.5 | |
| F126.91 | IPQSLCSWWTSL | 2747 | 12 | HBV | env | 28 | A | | | | | 1.1 | |
| F126.92 | IPQSLNSWWTSL | 2748 | 12 | HBV | env | 28 | A | | | | | 1.5 | |
| F126.93 | IPQSLQSWWTSL | 2749 | 12 | HBV | env | 28 | A | | | | | 0.81 | |
| F126.94 | IPQSLWSWWTSL | 2750 | 12 | HBV | env | 28 | A | | | | | 2.4 | |
| F126.95 | IPQSLKSWWTSL | 2751 | 12 | HBV | env | 28 | A | | | | | 1.1 | |
| F126.96 | IPSLDSWWTSL | 2752 | 11 | HBV | env | 28 | A | | | | | 119 | |
| F126.97 | IPQSLDSWTSL | 2753 | 11 | HBV | env | 28 | A | | | | | 0.22 | |
| F126.98 | IPQSLDSWWTL | 2754 | 11 | HBV | env | 28 | A | | | | | 1.3 | |
| F126.99 | IPQALASWWTSL | 2755 | 12 | HBV | env | 28 | A | | | | | 26 | |
| F128.06 | IPQSLDSWWTSM | 2756 | 12 | HBV | env | 28 | A | | | | | 0.80 | |
| F128.07 | IPQSLDSWWTSF | 2757 | 12 | HBV | env | 28 | A | | | | | 1.9 | |
| 17.0117 | KTPSFPNI | 2758 | 8 | HBV | pol | 75 | | | 270 | | | | |
| 17.0121 | HAVEFHNL | 2759 | 8 | HBV | pol | 289 | | | 49 | | | | |
| 17.0122 | VSAAFYHL | 2760 | 8 | HBV | pol | 419 | | | 7.0 | | | | |
| 17.0127 | VIGCYGSL | 2761 | 8 | HBV | pol | 588 | | | 157 | | | | |
| 17.0362 | KQYLNLYPV | 2762 | 9 | HBV | pol | 668 | | | | | 3.4 | | |
| 17.0431 | CYGSLPQEHI | 2763 | 10 | HBV | pol | 591 | | | | 303 | | | |
| 1172.06 | VSAAFYHL | 2764 | 8 | HBV | pol | 419 | | | 5.2 | | | | |
| 1172.09 | HAVEFHNL | 2765 | 8 | HBV | pol | 289 | | | 158 | | | | |
| 1172.11 | VIGCYGSL | 2766 | 8 | HBV | pol | 588 | | | 63 | | | | |
| 1172.14 | KTPSFPNI | 2767 | 8 | HBV | pol | 75 | | | 155 | | | | |
| F139.01 | RPQSLDSWWTSL | 2768 | 12 | HBVs | env | 28 | A | | | | | 144 | |
| F139.04 | IPQRLDSWWTSL | 2769 | 12 | HBVs | env | 28 | A | | | | | 34 | |
| F139.06 | IPQSLRSWWTSL | 2770 | 12 | HBVs | env | 28 | A | | | | | 11 | |
| F139.07 | IPQSLDRWWTSL | 2771 | 12 | HBVs | env | 28 | A | | | | | 2.0 | |
| F139.08 | IPQSLDSRWTSL | 2772 | 12 | HBVs | env | 28 | A | | | | | 2.6 | |
| F139.10 | IPQSLDSWWRSL | 2773 | 12 | HBVs | env | 28 | A | | | | | 335 | |
| F139.11 | IPQSLDSWWTRL | 2774 | 12 | HBVs | env | 28 | A | | | | | 27 | |
| F139.14 | IPQELDSWWTSL | 2775 | 12 | HBVs | env | 28 | A | | | | | 18 | |
| F139.16 | IPQSLYSWWTSL | 2776 | 12 | HBVs | env | 28 | A | | | | | 8.3 | |
| F139.17 | IPQSLDSWETSL | 2777 | 12 | HBVs | env | 28 | A | | | | | 5.3 | |
| F139.18 | IPQSLDSWWESL | 2778 | 12 | HBVs | env | 28 | A | | | | | 394 | |
| 64.0036 | VESENKVV | 2779 | 8 | HCV | Entire | 2253 | | | | | | | 349 |
| 21.0126 | AGPYRAFVTI | 2780 | 10 | HIV | env | 18 | A | 5.0 | | | | | |
| 21.0127 | RAPYRAFVTI | 2781 | 10 | HIV | env | 18 | A | 176 | | | | | |
| 21.0134 | RGPYRAFVTA | 2782 | 10 | HIV | env | 18 | A | 126 | | | | | |
| 21.0135 | KGPYRAFVTI | 2783 | 10 | HIV | env | 18 | A | 5.8 | | | | | |
| 21.0145 | RGPYRAFVTK | 2784 | 10 | HIV | env | 18 | A | 91 | | | | | |
| 1087.01 | RGPGRAFVTI | 2785 | 10 | HIV | env | 18 | | 9.7 | 31000 | >10000 | 22000 | | |
| 1087.03 | RGPGRYFVTI | 2786 | 10 | HIV | env | 18 | A | 2.7 | | | | | |
| 1087.04 | RGPGRAYVTI | 2787 | 10 | HIV | env | 18 | A | 14 | | | | | |
| 1087.05 | RGPGRAFYTI | 2788 | 10 | HIV | env | 18 | A | 7.2 | | | | | |
| 64.0007 | VESMNKEL | 2789 | 8 | HIV | POL | 903 | | | | | | | 114 |
| 64.0055 | TDSQYALGI | 2790 | 9 | HIV | POL | 689 | | | | | | | 179 |
| 21.0128 | RGAYRAFVTI | 2791 | 10 | HIV | 18 | | A | 3.4 | | | | | |
| 21.0129 | RGPARAFVTI | 2792 | 10 | HIV | 18 | | A | 1.04 | | | | | |
| 21.0131 | RGPYRAAVTI | 2793 | 10 | HIV | 18 | | A | 2.0 | | | | | |

TABLE 20-continued

| Peptide | Sequence | SEQ ID NO | AA | Organism | Protein | Position | Analog | Dd | Kb | Kd | Db | Ld | Kk |
|---|---|---|---|---|---|---|---|---|---|---|---|---|---|
| 21.0132 | RGPYRAFATI | 2794 | 10 | HIV | 18 | | A | 2.1 | | | | | |
| 21.0133 | RGPYRAFVAI | 2795 | 10 | HIV | 18 | | A | 1.3 | | | | | |
| 21.0137 | RGKYRAFVTI | 2796 | 10 | HIV | 18 | | A | 67 | | | | | |
| 21.0138 | RGPFRAFVTI | 2797 | 10 | HIV | 18 | | A | 0.78 | | | | | |
| 21.0139 | RGPYKAFVTI | 2798 | 10 | HIV | 18 | | A | 13 | | | | | |
| 21.0141 | RGPYRKFVT1 | 2799 | 10 | HIV | 18 | | A | 3.6 | | | | | |
| 21.0142 | RGPYRAYVTI | 2800 | 10 | HIV | 18 | | A | 2.1 | | | | | |
| 21.0143 | RGPYRAFKTI | 2801 | 10 | HIV | 18 | | A | 2.3 | | | | | |
| 21.0144 | RGPYRAFVKI | 2802 | 10 | HIV | 18 | | A | 3.9 | | | | | |
| 78.0425 | NEILIRCII | 2803 | 9 | HPV | E6 | 97 | | | | | | | 12 |
| 78.0426 | QEKKRHVDL | 2804 | 9 | HPV | E6 | 113 | | | | | | | 256 |
| 1511.05 | LFVVYRDSI | 2805 | 9 | HPV | E6 | 52 | | | | 453 | | | |
| 1520.18 | FYSRIRELRF | 2806 | 10 | HPV | E6 | 71 | A | | | 447 | | | |
| 1108.07 | SSIEFARL | 2807 | 8 | HSV | | 498 | | | 1.8 | >10000 | | | |
| F142.01 | KVPRNQDWL | 2808 | 9 | Human | gp100 | | | | | | 38 | | |
| F117.07 | VYDFYVWM | 2809 | 8 | Human | TRP2 | | A | | 145 | | | | |
| 22.0011 | KNKFFSYL | 2810 | 8 | Human | Tyrosinase | 131 | | | 57 | | | | |
| 22.0012 | LAVLYCLL | 2811 | 8 | Human | Tyrosinase | 3 | | | 72 | | | | |
| 22.0021 | YMVPFIPL | 2812 | 8 | Human | Tyrosinase | 425 | | | 70 | | | | |
| 22.0090 | GQMNNGSTPM | 2813 | 10 | Human | Tyrosinase | 157 | | | | | 242 | | |
| 14.0008 | IVTMFEAL | 2814 | 8 | LCMV | GP | 4 | | | 82 | | | | |
| 14.0011 | ISHNFCNL | 2815 | 8 | LCMV | GP | 118 | | | 411 | | | | |
| 14.0018 | GVYQFKSV | 2816 | 8 | LCMV | GP | 70 | | | 11 | | | | |
| 14.0137 | HYISMGTSGL | 2817 | 10 | LCMV | GP | 99 | | | | 83 | | | |
| 928.07 | SGVENPGGYCL | 2818 | 11 | LCMV | GP | 276 | | | >31000 | | 60 | | |
| 928.20 | KAVYNFATM | 2819 | 9 | LCMV | GP | 33 | | | | | 3.3 | | |
| F110.02 | CMANNSHHYI | 2820 | 10 | LCMV | GP | 92 | A | | | | 220 | | |
| F110.03 | CSANNSHHYM | 2821 | 10 | LCMV | GP | 92 | A | | | | 42 | | |
| F110.04 | SMVENPGGYCL | 2822 | 11 | LCMV | GP | 276 | A | | | | 154 | | |
| F110.05 | SGVENPGGYCM | 2823 | 11 | LCMV | GP | 276 | A | | | | 128 | | |
| F114.06 | KAVYNFATM | 2824 | 9 | LCMV | GP | 33 | | | | | 1.5 | >27000 | |
| F114.07 | KAVYNAATM | 2825 | 9 | LCMV | GP | 33 | A | | | | 2.0 | >27000 | |
| F114.08 | KAVANFATM | 2826 | 9 | LCMV | GP | 33 | A | | | | 1.2 | 27000 | |
| F114.09 | KAVYNYATM | 2827 | 9 | LCMV | GP | 33 | A | | | | 2.1 | >27000 | |
| F114.10 | KAVYNFAAM | 2828 | 9 | LCMV | GP | 33 | A | | | | 4.4 | 27000 | |
| 14.0029 | YTVKYPNL | 2829 | 8 | LCMV | NP | 205 | | | 204 | | | | |
| 14.0100 | FQPQNGQFI | 2830 | 9 | LCMV | NP | 396 | | | | | 6.9 | | |
| 14.0118 | VGLSYSQTM | 2831 | 9 | LCMV | NP | 356 | | | 71 | | | | |
| 928.09 | FQPQNGQFI | 2832 | 9 | LCMV | NP | 396 | | | >31000 | | 4.9 | | |
| 928.15 | FQPQNGQFIHFY | 2833 | 12 | LCMV | NP | 396 | | | 15500 | | 280 | | |
| 1076.05 | RPQASGVYM | 2834 | 9 | LCMV | NP | 118 | | | >31000 | | >44000 | 0.99 | |
| 1164.01 | RPQASQVYM | 2835 | 9 | LCMV | NP | 118 | A | | | | | 3.8 | |
| F110.01 | YTYKYPNL | 2836 | 8 | LCMV | NP | 205 | A | | 1.8 | | | | |
| F114.02 | RPQASGVYM | 2837 | 9 | LCMV | NP | 118 | A | | | | | 3.0 | |
| F114.03 | RPQASGVAM | 2838 | 9 | LCMV | NP | 118 | A | | | | | 12 | |
| F114.04 | RPQGSGVYM | 2839 | 9 | LCMV | NI, | 118 | A | | | | | 39 | |
| F114.05 | RPNASGVYM | 2840 | 9 | LCMV | NP | 118 | A | | | | | 19 | |
| F141.02 | KAVYNFATCGI | 2841 | 11 | LCMV | | | | | | | 29 | | |
| F141.04 | KAVYNFATB | 2842 | 9 | LCMV | | | | | | | 7.9 | | |
| 1115.09 | VYAKECTGL | 2843 | 9 | Lysteria | listeriolysin | 479 | | | | 129 | | | |
| 1164.03 | YPHFMPTNL | 2844 | 9 | MCMV | | 168 | | | | | | 7.5 | |
| 1164.04 | YPHYMPTNL | 2845 | 9 | MCMV | | 168 | A | | | | | 9.5 | |
| 1420.26 | HETTYNSI | 2846 | 8 | Mouse | beta actin | 275 | A | | | | | | 1.8 |
| 1420.27 | YEDTGKTI | 2847 | 8 | Mouse | p40 phox RNA | 245 | | | | | | | 0.86 |
| 16.0004 | LGYDYSYL | 2848 | 8 | Mouse | Tyrosinase | 445 | | | 3.4 | | | | |
| 16.0029 | SSMHNALHI | 2849 | 9 | Mouse | Tyrosinase | 360 | | | | | 7.6 | | |
| 16.0031 | ANFSFRNTL | 2850 | 9 | Mouse | Tyrosinase | 336 | | | 6.0 | | | | |
| F078.03 | SYLTLAKHT | 2851 | 9 | Mouse | Tyrosinase | 136 | | | | 188 | | | |
| F078.05 | HYYVSRDTL | 2852 | 9 | Mouse | Tyrosinase | 180 | | | | 43 | | | |
| F078.06 | YYVSRDTLL | 2853 | 9 | Mouse | Tyrosinase | 181 | | | | 99 | | | |
| F078.07 | SFFSSWQII | 2854 | 9 | Mouse | Tyrosinase | 267 | | | | 16 | | | |
| F078.11 | SYMVPFIPL | 2855 | 9 | Mouse | Tyrosinase | 424 | | | | 144 | | | |
| F078.14 | PYLEQASRI | 2856 | 9 | Mouse | Tyrosinase | 466 | | | | 173 | | | |
| F078.18 | SYLTLAKHTI | 2857 | 10 | Mouse | Tyrosinase | 136 | | | | 4.4 | | | |
| F078.21 | HYYVSRDTLL | 2858 | 10 | Mouse | Tyrosinase | 180 | | | | 167 | | | |
| F100.04 | SQVMNLHNL | 2852 | 9 | Mouse | TYRP2 | 363 | | | | | 2.3 | | |
| 1420.31 | YENDIEKKI | 2860 | 9 | *P. falciparum* | CSP | 375 | | | | | | | 3.8 |
| 64.0083 | NEEPSDKHI | 2861 | 9 | *P. falciparum* | CSPZ | 347 | | | | | | | 40 |
| 64.0094 | EEKHEKKHV | 2862 | 9 | *P. falciparum* | LSA1 | 52 | | | | | | | 284 |
| 1081.06 | SYVPSAEQIL | 2863 | 10 | *P. yoelii* | CSP | 280 | | | | 280 | | | |
| 1074.15 | RYLENGKETL | 2864 | 10 | Unknown | HLA-A24 | 170 | | | | 80 | | | |
| 1074.13 | RYLKNGKETL | 2865 | 10 | Unknown | HLA-Cw3 | 170 | | | | 217 | | | |

TABLE 20-continued

| Peptide | Sequence | SEQ ID NO | AA | Organism | Protein | Position | Analog | Dd | Kb | Kd | Db | Ld | Kk |
|---|---|---|---|---|---|---|---|---|---|---|---|---|---|
| 1108.06 | IYTQNRRAL | 2866 | 9 | Unknown | P815 | 12 | | | | 144 | | | |
| F117.03 | VYDFFVWM | 2867 | 8 | Unknown | TRP2 | 181 | A | | 464 | | | | |
| Fl17.14 | SVYDFFVWL | 2868 | 9 | Unknown | TRP2 | 180 | | | 1.0 | | | | |
| F138.03 | SVYDFYVWM | 2869 | 9 | Unknown | TRP2 | 180 | A | | 1.2 | | 3365 | | |
| 1275.03 | ASNENMDAM | 2870 | 9 | unknown | | | | | | | 28 | | |
| 1275.04 | FAPGYNPAL | 2871 | 9 | unknown | | | | | 2.0 | | | | |
| F079.03 | SIQFFGERAL | 2872 | 10 | unknown | | | | | 21 | | >44000 | | |
| F079.04 | SIQFFGEL | 2873 | 8 | unknown | | | | | 16 | | >44000 | | |
| 1079.09 | RGYVYQGL | 2874 | 8 | VSV | NP | 52 | | >37000 | 2.1 | >10000 | >44000 | | |
| 1476.05 | RGPRLNTL | 2875 | 8 | | | | | 186 | | | | | |
| 1476.12 | HMWNFIGV | 2876 | 8 | | | | | | 202 | | | | |
| 1476.18 | GGAYRLIVF | 2877 | 9 | | | | | 3.5 | | | | | |
| 1476.20 | KYLVTRHADV | 2878 | 19 | | | | | | | 33 | | | |
| 1476.21 | FSPRRNGYL | 2879 | 9 | | | | | 2.7 | | | | | |
| F190.04 | SHYAFSPM | 2880 | 8 | | | | | | 250 | | >88000 | | |
| F190.10 | FQPQNGQFI | 2881 | 9 | | | | | | 9513 | | 17 | | |

TABLE 21

| MURINE CLASS I SUPERTYPE | | | | | | | |
|---|---|---|---|---|---|---|---|
| Sequence | SEQ ID NO. | Db | Kb | Kd | Db | Ld | Kk |
| SGPSNTPPEI | 2882 | 18500 | >31000 | >10000 | 8.1 | | |
| RNPRFYNL | 2883 | | 7.9 | | >44000 | | |
| QPQRGYENF | 2884 | | | | | 319 | |
| SEAAYAKKI | 2885 | | | | | | 3.9 |
| AYAPAKAAI | 2886 | | | 3.5 | | | |
| AYAEAKAAI | 2887 | | | 50 | | | |
| AYANAKAAI | 2888 | | | 60 | | | |
| AYAGAKAAI | 2889 | | | 48 | | | |
| AYAVAKAAI | 2890 | | | 42 | | | |
| AAAAYAAM | 2891 | | 375 | | >44000 | | |
| AAAAYAAAAM | 2892 | | 228 | | >44000 | | |
| AAAANAAAM | 2893 | | 10960 | | 23 | | |
| AAAAAANAAAM | 2894 | | 31000 | | 257 | | |
| NAIVFKGL | 2895 | | 484 | | | | |
| SIINFEKL | 2896 | | 3.7 | | | | |
| IFYCPIAI | 2897 | | 195 | | | | |
| KVVRFDKL | 2898 | | 92 | | | | |
| VYSFSLASRL | 2899 | | | 303 | | | |
| SIINFEKL | 2900 | >37000 | 1.5 | >10000 | 30508 | | |
| KVVRFDKL | 2901 | | 37 | | | | |
| SENDRYRLL | 2902 | | | | | | 13 |
| SFYRNLLWL | 2903 | | | >10000 | 304 | | |
| YEANGNLI | 2904 | | | | | | 0.65 |
| MGLIYNRM | 2905 | | 16 | | | | |
| MGYIYNRM | 2906 | | 2.3 | | | | |
| MGIIYNRM | 2907 | | 14 | | | | |
| MGLIFNRM | 2908 | | 21 | | | | |
| MGLIYNRM | 2909 | | 9.9 | | | | |
| RMIQNSLTI | 2910 | | | | 4.6 | | |
| RLIQNFLTI | 2911 | | | | 40 | | |
| GMRQNATEI | 2912 | | | | 81 | | |
| YMRVNGKWM | 2913 | | | | 50 | | |
| FYIQMATEL | 2914 | | | 0.31 | | | |
| FYIQMCTFL | 2915 | | | 1.1 | | | |
| AYERMANIL | 2916 | | | 233 | | | |
| AYQRMCNIL | 2917 | | | 2.7 | | | |
| AYERMCTIL | 2918 | | | 4.1 | | | |
| ASNENMETM | 2919 | >37000 | >31000 | >10000 | 33 | | |
| TYQRTRALM | 2920 | | | 69 | | | |
| TYQKTRALV | 2921 | | | 44 | | | |
| TYQPTRALV | 2922 | | | 17 | | | |
| TYQFTRALV | 2923 | | | 371 | | | |
| TYQLTRALV | 2924 | | | 110 | | | |
| SDYEGRLI | 2925 | | | | | | 0.60 |
| MITQFESL | 2926 | | 64 | | | | |
| RTFSFQLI | 2927 | | 26 | | | | |
| FSVIFDRL | 2928 | | 201 | | | | |
| RTFSFQLI | 2929 | | 27 | | | | |
| MITQFESL | 2930 | | 42 | | | | |
| FSVIFDRL | 2931 | | 115 | | | | |

TABLE 21-continued

| MURINE CLASS I SUPERTYPE | | | | | | | |
|---|---|---|---|---|---|---|---|
| Sequence | SEQ ID NO. | Db | Kb | Kd | Db | Ld | Kk |
| KDDFYRNL | 2932 | | 209 | | | | |
| SSLPFQNI | 2933 | | 53 | | | | |
| MNIQFTAV | 2934 | | 131 | | | | |
| MNYYWTLL | 2935 | | 169 | | | | |
| SFYRNLLWL | 2936 | | | | 46 | | |
| SSLPFQNI | 2937 | | 9.5 | | | | |
| NMNIQFTAV | 2938 | | 26 | | | | |
| MNYYWTLL | 2939 | | 56 | | | | |
| KSSFYRNL | 2940 | | 117 | | | | |
| SIIPSGPL | 2941 | | 393 | | | | |
| LSYSAGAL | 2942 | | 60 | | | | |
| LSYSAGAL | 2943 | | 31 | | | | |
| SSISFCGV | 2944 | | 29 | | | | |
| TGICNQNII | 2945 | | | | 13 | | |
| ITYKNSTWV | 2946 | | | | 409 | | |
| FCGVNSDTV | 2947 | | | | 206 | | |
| TGICNQNII | 2948 | | | | 21 | | |
| FCGVNSDTV | 2949 | | | | 166 | | |
| ITYKNSTWV | 2950 | | | | 276 | | |
| SSISFCGV | 2951 | | 2.3 | | | | |
| IGRFYIQM | 2952 | | 42 | | | | |
| MMIWHSNL | 2953 | | 238 | | | | |
| ASNENMETM | 2954 | | | | 41 | | |
| IGRFYIQM | 2955 | | 24 | | | | |
| MMIWHSNL | 2956 | | 287 | | | | |
| FFYRYGFV | 2957 | | 350 | | | | |
| KMITQRTI | 2958 | | 300 | | | | |
| RSYLIRAL | 2959 | | 78 | | | | |
| RFYRTCKL | 2960 | | 47 | | | | |
| VYINTALL | 2961 | | 65 | | | | |
| VYINTALL | 2962 | | 14 | | | | |
| VYIEVLHL | 2963 | | 75 | | | | |
| VYIEVLHL | 2964 | | 21 | | | | |
| WYIPPSLRTL | 2965 | | | 96 | | | |
| MURTAZAKD | 2966 | | | 0.96 | | | |
| IYSTVASSL | 2967 | | | 4.1 | | | |
| LYEKVKSQL | 2968 | | | 2.2 | | | |
| LYQKVKSQL | 2969 | | | 2.8 | | | |
| LYEKMKSQL | 2970 | | | 1.6 | | | |
| LYEKVFSQL | 2971 | | | 7.4 | | | |
| LYQNVGTYV | 2972 | | | 6.9 | | | |
| MGLKFRQL | 2973 | | 7.4 | | | | |
| VSYVNTNM | 2974 | | 60 | | | | |
| SYVNTNMGL | 2975 | | | 19 | | | |
| MGLKFRQL | 2976 | | 6.3 | | | | |
| VSYVNTNM | 2977 | | 33 | | | | |
| SYVNTNMGL | 2978 | | | 12 | | | |
| WGPSLYSI | 2979 | 17 | | | | | |
| ASARFSWL | 2980 | | 323 | | | | |
| WGPSLYSIL | 2981 | 6.6 | | | | | |
| TGPCRTCMT | 2982 | 108 | | | | | |
| WYWGPSLYSI | 2983 | | | 8.3 | | | |
| IPQSLDSWWTSL | 2984 | | | | | 2.2 | |
| IPQSLDSYWTSL | 2985 | | | | | 2.7 | |
| ADARFSWL | 2986 | | 49 | | | | |
| WYWGPSLYSI | 2987 | | | 16 | | | |
| APQSLDSWWTSL | 2988 | | | | | 1.5 | |
| IPQALDSWWTSL | 2989 | | | | | 6.1 | |
| IPQSLASWWTSL | 2990 | | | | | 4.2 | |
| IPQSLDAWWTSL | 2991 | | | | | 4.0 | |
| IPQSLDSAWTSL | 2992 | | | | | 13 | |
| IPQSLDSWWASL | 2993 | | | | | 0.34 | |
| IPQSLDSWWTAL | 2994 | | | | | 134 | |
| EPQSLDSWWTSL | 2995 | | | | | 86 | |
| IPESLDSWWTSL | 2996 | | | | | 13 | |
| IPQSLDEWWTSL | 2997 | | | | | 1.9 | |
| IPQSLDSWWTEL | 2998 | | | | | 3.0 | |
| RPQSLDSWWTSL | 2999 | | | | | 60 | |
| IPRSLDSWWTSL | 3000 | | | | | 160 | |
| IPQRLDSWWTSL | 3001 | | | | | 23 | |
| IPQSLDSWWTSL | 3002 | | | | | 21 | |
| IPQSLRSWWTSL | 3003 | | | | | 12 | |
| IPQSLDRWWTSL | 3004 | | | | | 5.0 | |
| IPQSLDSRWTSL | 3005 | | | | | 47 | |
| IPQSLDSWWRSL | 3006 | | | | | 485 | |
| IPQSLDSWWTRL | 3007 | | | | | 196 | |

TABLE 21-continued

| MURINE CLASS I SUPERTYPE | | | | | | | |
|---|---|---|---|---|---|---|---|
| Sequence | SEQ ID NO. | Db | Kb | Kd | Db | Ld | Kk |
| YPQSLDSWWTSL | 3008 | | | | | 91 | |
| IPYSLDSWWTSL | 3009 | | | | | 0.78 | |
| IPQYLDSWWTSL | 3010 | | | | | 92 | |
| IPQSLYSWWTSL | 3011 | | | | | 4.7 | |
| IPQSLDYWWTSL | 3012 | | | | | 1.6 | |
| IPQSLDSWYTSL | 3013 | | | | | 17 | |
| IPQSLDSWWTYL | 3014 | | | | | 0.89 | |
| IPGSLDSWWTSL | 3015 | | | | | 24 | |
| IPQSLDSGWTSL | 3016 | | | | | 70 | |
| IPQSLDSPWTSL | 3017 | | | | | 19 | |
| IPQSLDSWGTSL | 3018 | | | | | 138 | |
| IPQSLDSWPTSL | 3019 | | | | | 60 | |
| IPQSLDSWSWTGL | 3020 | | | | | 2.5 | |
| IPQSLDSWWTPL | 3021 | | | | | 1.2 | |
| IPQVLDSWWTSL | 3022 | | | | | 5.1 | |
| IPQFLDSWWTSL | 3023 | | | | | 4.3 | |
| O[Q[;DSWWTS; | 3024 | | | | | 6.3 | |
| IPQMLDSWWTSL | 3025 | | | | | 4.1 | |
| IPQILDSWWTSL | 3026 | | | | | 12 | |
| IPQLLDSWWTSL | 3027 | | | | | 0.25 | |
| IPQGLDSWWTSL | 3028 | | | | | 2.7 | |
| IPQTLDSWWTSL | 3029 | | | | | 7.7 | |
| IPQHLDSWWTSL | 3030 | | | | | 39 | |
| IPQCLDSWWTSL | 3031 | | | | | 25 | |
| IPQNLDSWWTSL | 3032 | | | | | 12 | |
| IPQQLDSWWTSL | 3033 | | | | | 1.7 | |
| IPQWLDSWWTSL | 3034 | | | | | 3.7 | |
| IPQDLDSWWTSL | 3035 | | | | | 22 | |
| IPQKLDSWWTSL | 3036 | | | | | 9.3 | |
| IPQSLSWWTSL | 3037 | | | | | 11 | |
| IPQSLFSWWTSL | 3038 | | | | | 11 | |
| IPQSLPSWWTSL | 3039 | | | | | 16 | |
| IPQSLMSWWTSL | 3040 | | | | | 0.95 | |
| IPQSLISWWTSL | 3041 | | | | | 17 | |
| IPQSLLSWWTSL | 3042 | | | | | 0.84 | |
| IPQSLGSWWTSL | 3043 | | | | | 2.7 | |
| IPQSLSSWWTSL | 3044 | | | | | 0.49 | |
| IPQSLTSWWTSL | 3045 | | | | | 1.7 | |
| IPQSLHSWWTSL | 3046 | | | | | 1.5 | |
| IPQSLCSWWTSL | 3047 | | | | | 1.1 | |
| IPQSLNSWWTSL | 3048 | | | | | 1.5 | |
| IPQSLQSWWTSL | 3049 | | | | | 0.81 | |
| IPQSLWSWWTSL | 3050 | | | | | 2.4 | |
| IPQSLKSWWTSL | 3051 | | | | | 1.1 | |
| IPSLDSWWTSL | 3052 | | | | | 119 | |
| IPQSLDSWTSL | 3053 | | | | | 0.22 | |
| IPQSLDSWWTL | 3054 | | | | | 1.3 | |
| IPQALASWWTSL | 3055 | | | | | 26 | |
| IPQSLDSWWTSM | 3056 | | | | | 0.80 | |
| IPQSLDSWWTSF | 3057 | | | | | 1.9 | |
| KTPSFPNI | 3058 | | 270 | | | | |
| HAVEFHNL | 3059 | | 49 | | | | |
| VSAAFYHL | 3060 | | 7.0 | | | | |
| VIGCYGSL | 3061 | | 157 | | | | |
| KQYLNLYPV | 3062 | | | | 3.4 | | |
| CYGSLPQEHI | 3063 | | | 303 | | | |
| VSAAFYHL | 3064 | | 5.2 | | | | |
| HAVEFHNL | 3065 | | 158 | | | | |
| VIGCYGSL | 3066 | | 63 | | | | |
| KTPSFPNI | 3067 | | 153 | | | | |
| RPQSLDSWWTSL | 3068 | | | | | 144 | |
| IPQRLDSWWTSL | 3069 | | | | | 34 | |
| IPQSLRSWWTSL | 3070 | | | | | 11 | |
| IPQSLDRWWTSL | 3071 | | | | | 2.0 | |
| IPQSLDSRWTSL | 3072 | | | | | 2.6 | |
| IPQSLDSWWRSL | 3073 | | | | | 335 | |
| IPQSLDSWWTRL | 3074 | | | | | 27 | |
| IPQELDSWWTSL | 3075 | | | | | 18 | |
| IPQSLYWWTSL | 3076 | | | | | 8.3 | |
| IPQSLDSWETSL | 3077 | | | | | 5.3 | |
| IPQSLDSWWESL | 3078 | | | | | 394 | |
| VESENKVV | 3079 | | | | | | 349 |
| AGPYRAFVTI | 3080 | 5.0 | | | | | |
| RAPYRAFVTI | 3081 | 176 | | | | | |
| RGPYRAFVTA | 3082 | 126 | | | | | |
| KGPYRAFVTI | 3083 | 5.8 | | | | | |

TABLE 21-continued

| MURINE CLASS I SUPERTYPE | | | | | | | |
|---|---|---|---|---|---|---|---|
| Sequence | SEQ ID NO. | Db | Kb | Kd | Db | Ld | Kk |
| RGPYRAFVTK | 3084 | 91 | | | | | |
| RGPGRAFVTI | 3085 | 9.7 | 31000 | >10000 | 22000 | | |
| RGPGRYFVTI | 3086 | 2.7 | | | | | |
| RGPGRAYVTI | 3087 | 14 | | | | | |
| RGPGRAFYTI | 3088 | 7.2 | | | | | |
| VESMNKEL | 3089 | | | | | | 114 |
| TDSQYALGI | 3090 | | | | | | 179 |
| RGAYRAFVTI | 3091 | 3.4 | | | | | |
| RGPARAFVTI | 3092 | 1.04 | | | | | |
| RGPYRAAVTI | 3093 | 2.0 | | | | | |
| RGPYRAFATI | 3094 | 2.1 | | | | | |
| RGPYRAFVAI | 3095 | 1.3 | | | | | |
| RGKYRAFVTI | 3096 | 67 | | | | | |
| RGPFRAFVTI | 3097 | 0.78 | | | | | |
| RGPYKAFVTI | 3098 | 13 | | | | | |
| RGPYRKFVTI | 3099 | 3.6 | | | | | |
| RGPYRAYVTI | 3100 | 2.1 | | | | | |
| RGPYRAFKTI | 3101 | 2.3 | | | | | |
| RGPYRAFVKI | 3102 | 3.9 | | | | | |
| NEILIRCII | 3103 | | | | | | 12 |
| QEKKRHVDL | 3104 | | | | | | 256 |
| LFVVYRDSK | 3105 | | | 453 | | | |
| FYSRIRELRF | 3106 | | | 447 | | | |
| SSIEFARL | 3107 | | 1.8 | >10000 | | | |
| KVPRNQDWL, | 3108 | | | | 38 | | |
| VYDFYVWM | 3109 | | 145 | | | | |
| KNKFFSYL | 3110 | | 57 | | | | |
| LAVLYCLL | 3111 | | 72 | | | | |
| YMVPFIPL | 3112 | | 70 | | | | |
| CQMNNGSTPM | 3113 | | | | 242 | | |
| IVTMFEAL | 3114 | | 82 | | | | |
| ISFINFCNL | 3115 | | 411 | | | | |
| GVYQFKSF | 3116 | | 11 | | | | |
| HYIMGTSGL | 3117 | | | 83 | | | |
| SGVENPGGYCL | 3118 | | >31000 | | 60 | | |
| KAVYNFATM | 3119 | | | | 3.3 | | |
| CMANNSHHYI | 3120 | | | | 220 | | |
| CSANNSHHYM | 3121 | | | | 42 | | |
| SMVENPGGYCL | 3122 | | | | 154 | | |
| SGVENPGGYCM | 3123 | | | | 128 | | |
| KAVYNFATM | 3124 | | | | 1.5 | >27000 | |
| KAVYNAATM | 3125 | | | | 2.0 | >27000 | |
| KAVANFATM | 3126 | | | | 1.2 | 27000 | |
| KAVYNYATM | 3127 | | | | 2.1 | >27000 | |
| KAVYNFAAM | 3128 | | | | 4.4 | 27000 | |
| YTVKYPNL | 3129 | | 204 | | | | |
| FQPQNGQFI | 3130 | | | | 6.9 | | |
| VGLSYSQTM | 3131 | | 71 | | | | |
| FQPQNGQFI | 3132 | | >31000 | | | | |
| TQPQNGQFIHFY | 3133 | | 15500 | | 280 | | |
| RPQASGVYM | 3134 | | >31000 | | >44000 | 0.99 | |
| RPQASQVYM | 3135 | | | | | 3.8 | |
| YTYKYPNL | 3136 | | 1.8 | | | | |
| RPQASGVYM | 3137 | | | | | 3.0 | |
| RPQASGVAM | 3138 | | | | | 12 | |
| TPQGSGVYM | 3139 | | | | | 39 | |
| RPNASGVYM | 3140 | | | | | 19 | |
| KAVYNFATCGI | 3141 | | | | 29 | | |
| KAVYNFATB | 3142 | | | | 7.9 | | |
| VYAKECTGL | 3143 | | | 129 | | | |
| YPHFMPTNL | 3144 | | | | | 7.5 | |
| YPHYMPTNL | 3145 | | | | | 9.5 | |
| HETTYNSI | 3146 | | | | | | 1.8 |
| YEDTGKTI | 3147 | | | | | | 0.86 |
| LGYDYSYL | 3148 | | 3.4 | | | | |
| SSMHNALHI | 3149 | | | | 7.6 | | |
| NAFSFRNTL | 3150 | | 6.0 | | | | |
| SYLTLAKHT | 3151 | | | 188 | | | |
| HYYVSRDTL | 3152 | | | 43 | | | |
| YYVSRDTLL | 3153 | | | 99 | | | |
| SFFSSWQII | 3154 | | | 16 | | | |
| SYMVPFIPL | 3155 | | | 144 | | | |
| PYLEQASRI | 3156 | | | 173 | | | |
| SYLTLAKHTI | 3157 | | | 4.4 | | | |
| HYYVSRDTLL | 3158 | | | 167 | | | |
| SQVMNLEINL | 3159 | | | | 2.3 | | |

TABLE 21-continued

| MURINE CLASS I SUPERTYPE | | | | | | | |
|---|---|---|---|---|---|---|---|
| Sequence | SEQ ID NO. | Db | Kb | Kd | Db | Ld | Kk |
| YENDIEKKI | 3160 | | | | | | 3.8 |
| NEEPSDKHI | 3161 | | | | | | 40 |
| EEKHEKKHV | 3162 | | | | | | 284 |
| SYVPSAEQIL | 3163 | | | 280 | | | |
| RYLENGKETL | 3164 | | | 80 | | | |
| RYLKNGKETL | 3165 | | | 217 | | | |
| EYTQNRRAL | 3166 | | | 144 | | | |
| VVDFFVWM | 3167 | | 464 | | | | |
| SVYDEFVWL | 3168 | | 1.0 | | | | |
| SVYDFYVWM | 3169 | | 1.2 | | 3365 | | |
| ASNENMDAM | 3170 | | | | 28 | | |
| FAPGYNPAL | 3171 | | 2.0 | | | | |
| SIQFFGERAL | 3172 | | 21 | | >44000 | | |
| SIQFFGEL | 3173 | | 16 | | >44000 | | |
| RGYVYQGL | 3174 | >37000 | 2.1 | >10000 | >44000 | | |
| RGPRLNTL | 3175 | 186 | | | | | |
| HMWNFIGV | 3176 | | 202 | | | | |
| GGAYRLIVF | 3177 | 3.5 | | | | | |
| KYLVTRHADV | 3178 | | | 33 | | | |
| FSPRRNGYL | 3179 | 2.7 | | | | | |
| SHYAFSPM | 3180 | | 250 | | >88000 | | |
| FQPQNGQFI | 3181 | | | | | | |

TABLE 22

| Summary of Population Coverage by Currently Available Assays | | | | | | | |
|---|---|---|---|---|---|---|---|
| | | | Phenotypic (Allelic) Frequency | | | | |
| Antigen | HLA Allele | Cell Line(s) | Caucasian | Negro | Japanese | Chinese | Hispanic |
| Al | A*0101 | Steinlin | 28.6 | 10.1 | 1.4 | 9.2 | 10.1 |
| A2.1 | A*0201 | JY | 45.8 | 30.3 | 42.4 | 54.0 | 43.0 |
| A3.2 | A*0301 | GM3107 | 20.6 | 16.3 | 1.2 | 7.1 | 14.8 |
| A11 | A*1101 | BVR | 9.9 | 3.8 | 19.7 | 33.1 | 7.3 |
| A24 | A*2401 | KT3 | 16.8 | 8.8 | 58.1 | 32.9 | 26.7 |
| All A | | | 88.9 | 59.8 | 91.6 | 94.6 | 80.2 |
| B7 | B*0701 | GM3107 | 17.7 | 15.5 | 9.6 | 6.9 | 11.8 |
| B8 | B*0801 | Steinlin | 18.1 | 6.3 | 0.0 | 3.6 | 9.0 |
| B27 | B*2705 | LG2 | 7.5 | 2.6 | 0.8 | 3.4 | 4.9 |
| B35 | B*3503 | BHM | 15.4 | 14.8 | 15.4 | 9.8 | 28.1 |
| B54 | B15401 | KT3 | 0.0 | 0.0 | 12.4 | 8.6 | 0.0 |
| All B | | | 51.9 | 36.5 | 35.6 | 30.2 | 48.7 |
| Cw6 | Cw0601 | C1R | 17.6 | 13.7 | 2.2 | 19.0 | 12.2 |
| TOTAL | | | 95.7 | 76.5 | 94.7 | 96.6 | 91.0 |

TABLE 23

| HUMAN CELL LINES (HLA-B and HLA-C SOURCES) | |
|---|---|
| | B cell line |
| HLA-B allele | |
| B1801 | DVCAF |
| B3503 | EHM |
| B0701 | GM3107 |
| B1401 | LWAGS |
| B5101 | KAS116 |
| B5301 | AMAI |
| B0801 | MAT |
| B2705 | LG2 |
| B5401 | KT3 |
| B1302 | CBUF |
| B4403 | PITOUT |
| B3502 | TISI |

TABLE 23-continued

| HUMAN CELL LINES (HLA-B and HLA-C SOURCES) | |
|---|---|
| | B cell line |
| B3501 | BUR |
| B4001 | LB |
| HLA-C allele | |
| Cw0601 | C1R |

TABLE 24

| ANTIBODY REAGENTS | |
|---|---|
| anti-HLA | Name |
| HLA-A2 | BB7.2 |
| HLA-A1 | 12/18 |
| HLA-A3 | GAPA3 (ATCC, HB122) |
| HLA-11, 24.1 | A11.1M (ATCC, HB164) |
| HLA-A, B, C monomorphic | W6/32 (ATCC, HB95) |
| | B9.12.1 |
| HLA-B, C monomorphic | B.1.23.2 |

TABLE 25

| PEPTIDE | AA | SEQUENCE | SEQ ID NO | SOURCE | B*0701 |
|---|---|---|---|---|---|
| 1021 | 9 | FPFKYAAAF | 3182 | B35consensus peptid | 0 |
| 1054 | 9 | YPKVKQWPL | 3183 | Y1 analog of 1054.05 | 0 |
| 1075 | 11 | CILESCFRAVI | 3184 | MAGE-1 | 0 |
| 1080 | 9 | YPAEITLYW | 3185 | B53 self peptide | 0 |
| 1086 | 9 | FAMPNFQTL | 3186 | Cw3 consensus | 0 |
| 1086 | 9 | FAMPNFYTL | 3187 | Cw3 consensus | 0 |
| 1086 | 9 | QPDDAVYKL | 3188 | Cw4 consensus | 0 |
| 1086 | 9 | 1PYPIVRICL | 3189 | Cw6 consensus | 1 |
| 1086 | 9 | IPYPIVRSL | 3190 | Cw6 consensus | 1 |
| 1086 | 9 | IPFPIVRYL | 3191 | Cw6 consensus | 0 |
| 1086 | 9 | RYRPGTVAL | 3192 | Histone H3.3 | 0 |
| | 9 | MPRGVVVTL | 3193 | B7 Nat. Processed | 3 |
| | 10 | LPENNVLSPL | 3194 | p53, 26-35 | 0 |

TABLE 25-continued

| PEP-TIDE | AA SEQUENCE | SEQ ID NO | SOURCE | B*0701 |
|---|---|---|---|---|
| 10 | APAPAPSWPL | 3195 | p53, 84-93 | 1 |
| 11 | SPALNKMFCQL | 3196 | p53, 127-137 | 0 |
| 9 | GTRVRAMAI | 3197 | p53, 154-162 | 0 |
| 9 | RPILTIITL | 3198 | p53, 249-257 | 0 |
| 10 | LPPGSTKRAL | 3199 | p53, 299-308 | 0 |
| 9 | SPQPKKKPL | 3200 | p53, 315-323 | 0 |
| 10 | KPLDGEYFTL | 3201 | p53, 321-330 | 0 |
| 9 | GSRAHSSHL | 3202 | p53, 361-369 | 0 |

TABLE 26

Relative Binding of HLA-A or B Restricted Peptides

| PEPTIDE | AA | 1234567891011 | SEQ ID NO | SOURCE | RESTRICTION | A1 | A2.1 | A3.2 | A11 | A24 | B7 | B8 | B27 | B35 |
|---|---|---|---|---|---|---|---|---|---|---|---|---|---|---|
| 958.01 | 9 | EADPTGHSY | 3203 | MAGE-1 | A1 | 0.56+ | - | - | 0.0002 | - | - | - | - | - |
| 1013.01 | 9 | WLSLLVPFV | 3204 | HBVadr-ENV (S Ag 335-343) | A2.1 | - | 0.96 | 0.0001 | - | 0.0002 | - | 0.0006 | - | - |
| 924.07 | 10 | FLPSDFFPSV | 3205 | HBc 18-27 | A2.1 | 0.0002 | 1.7 | - | - | - | - | - | - | 0.0027 |
| 941.03 | 9 | ILKEPVHGV | 3206 | HIV RT | A2.1 | - | 0.019 | 0.0001 | 0.0002 | - | - | 0.0003 | - | - |
| 963.02 | 9 | GILGFVFTL | 3207 | Influenza A, M1 58-66 | A2.1 | 0.0012 | 0.76 | 0.0018 | - | 0.0006 | - | 0.0013 | - | 0.010 |
| 986.01 | 9 | LLGRNSFEV | 3208 | p53 264-272 A8 | A2.1 | - | 0.12 | - | - | - | - | 0.0013 | - | - |
| 940.01 | 11 | RLRDLLLIVTR | 3209 | HIV-1 NL43 env gp41 768-778 | A3.1 | 0.0022 | 0.0006 | 1.1 | 0.0009 | 0.0033 | 0.0005 | - | - | 0.0019 |
| 940.03 | 10 | QVPLRPMTYK | 3210 | HIV nef 73-82 | A3, A11 | - | - | 0.99 | 0.382 | - | - | 0.0001 | - | - |
| 940.05 | 9 | AVDLSHFLK | 3211 | HIV nef 84-94 | A11 | 0.0039 | - | 0.074 | 1.1 | - | - | - | - | - |
| 1055.01 | 9 | IVTDFSVIK | 3212 | EBNA4 416-424 | A11 | - | - | 0.035 | 0.27 | - | - | - | - | - |
| 1083.1 | 11 | STLPETTVVRR | 3213 | HCV 141-15 | A31 Aw68 | - | - | 0.019 | 1.4 | - | - | - | 0.0002 | - |
| 1054.01 | 9 | ELRSRYWAI | 3214 | NP 380-388 | B8 | - | 0.0001 | - | - | 0.0004 | - | 4.9 | 0.0002 | - |
| 1054.02 | 9 | FLRGRAYGI | 3215 | EBVEBNA-3 | B8 | - | 0.0031 | - | - | 0.0002 | 0.0008 | 12 | - | - |
| 1054.03 | 9 | GEIYKRWII | 3216 | HIV gag 261-269 | B8 | 0.0007 | - | 0.0005 | - | 0.0003 | - | 0.020 | - | - |
| 1054.04 | 9 | DCKTILKAL | 3217 | HIV gag 331-339 | B8 | - | - | - | - | - | - | 0.0014 | - | - |
| 1054.05 | 9 | DPKVKQWPL | 3218 | HIV pol 185-193 | B8 | - | - | - | - | - | 0.038 | 8.6 | - | 0.0039 |
| 1054.07 | 9 | YLKDQQLYL | 3219 | HIV gp41 586-593 | B8 | - | 0.0040 | - | - | 0.0002 | - | 0.048 | - | - |
| 1054.09 | 9 | GGKKKYKLK | 3220 | HIV gap p17.3 | B8 | - | - | - | - | - | - | 0.0013 | - | - |
| 960.01 | 8 | YLKDQQLL | 3221 | HIV gp 41 586-593 | B8 | - | 0.0001 | 0.0001 | - | 0.0001 | - | 0.40 | - | - |

| PEPTIDE | AA | 1234567891011 | SEQ ID NO | SOURCE | RESTRICTION | A1 | A2.1 | A3.2 | A11 | A24 | B7 | B8 | B27 | B35 |
|---|---|---|---|---|---|---|---|---|---|---|---|---|---|---|
| 1054.01 | 9 | ELRSRYWAI | 3214 | NP 380-388 | B8 | - | 0.0001 | - | - | 0.0004 | - | 4.9 | 0.0002 | - |
| 1054.02 | 9 | FLRGRAYGI | 3215 | EBVEBNA-3 | B8 | - | 0.0031 | - | - | 0.0002 | 0.0008 | 12 | - | - |
| 1054.03 | 9 | GEIYKRWII | 3216 | HIV gag 261-269 | B8 | 0.0007 | - | 0.0005 | - | 0.0003 | - | 0.020 | - | - |
| 1054.04 | 9 | DCKTILKAL | 3217 | HIV gag 331-339 | B8 | - | - | - | - | - | - | 0.0014 | - | - |
| 1054.05 | 9 | DPKVKQWPL | 3218 | HIV pol 185-193 | B8 | - | - | - | - | - | 0.038 | 8.6 | - | 0.0039 |
| 1054.07 | 9 | YLKDQQLYL | 3219 | HIV gp41 586-593 | B8 | - | 0.0040 | - | - | 0.0002 | - | 0.048 | - | - |
| 1054.09 | 9 | GGKKKYKLK | 3220 | HIV gap p17.3 | B8 | - | - | - | - | - | - | 0.0013 | - | - |
| 960.01 | 8 | YLKDQQLL | 3221 | HIV gp 41 586-593 | B8 | - | 0.0001 | 0.0001 | - | 0.0001 | - | 0.40 | - | - |

TABLE 26-continued

| Relative Binding of HLA-A or B Restricted Peptides | | | | | | | | | | | | | | |
|---|---|---|---|---|---|---|---|---|---|---|---|---|---|---|
| 1080.07 | 9 | SRYWAIRTR | 3222 | NP 383-391 | B27 | 0.0003 | - | - | - | - | - | - | 0.72 | - |
| 1080.08 | 10 | KRWIILGLNK | 3223 | HIV gag p24 265-274 | B27 | - | - | 0.0051 | 0.0082 | - | - | - | 0.87 | - |
| 1080.04 | 9 | TPYDINQML | 3224 | HIV-2 | B53 | - | - | - | - | - | 0.0015 | 0.0002 | - | 0.0038 |
| 1080.05 | 9 | KPIVQYDNF | 3225 | P. falciparum liver Ag 1788-1794 | B53 | - | - | - | - | - | 0.0002 | - | - | 0.0001 |
| 1080.06 | 9 | YPAEITLTW | 3226 | B53 self peptide | B53 | - | - | - | - | 0.0009 | 0.040 | 0.0001 | - | 0.025 |

TABLE 27

| Relative Binding of HLA-B Naturally Processed Peptides. | | | | | | | | | | | | | | |
|---|---|---|---|---|---|---|---|---|---|---|---|---|---|---|
| PEPTIDE | AA | 1234567891011 | SEQ ID NO | SOURCE | ORIGIN | A1 | A2.1 | A3.2 | A11 | A24 | B7 | B8 | B27 | B35 |
| F01.07 | 9 | RVMAPRALL | 3227 | B7 naturally processed | B7 | - | 0.0006 | 0.012* | 0.0018 | 0.0011 | 1.5+ | 0.0042 | 0.20 | - |
| F01.08 | 9 | RPKSNIVLL | 3228 | B7 naturally processed | B7 | - | - | 0.0021 | 0.0006 | - | 0.77 | - | - | - |
| F01.09 | 11 | AASKERGSVSL | 3229 | B7 naturally processed | B7 | - | 0.0002 | - | - | - | 0.14 | 0.0001 | - | - |
| F01.12 | 9 | APRTLVYLL | 3230 | Class I hvy chain sig seq 5-13 | B7 | - | - | - | - | - | 0.92 | 0.0040 | - | - |
| F13.01 | 9 | APRTVALTA | 3231 | B7 Nat. Processed | B7 | - | - | - | - | - | 0.84 | 0.0033 | - | - |
| F13.03 | 10 | APRTVALTAL | 3232 | B7 Nat. Processed | B7 | - | - | - | - | - | 0.97 | 0.0023 | - | - |
| F13.04 | 9 | APRASRPSL | 3233 | B7 Nat. Processed | B7 | - | - | - | - | - | 1.1 | 0.11 | - | - |
| F13.05 | 9 | LVMAPRTVL | 3234 | B7 Nat. Processed | B7 | - | - | - | - | - | 0.66 | 0.10 | - | - |
| 959.01 | 9 | RRYQKSTEL | 3235 | Flu Histone H3.3 | B27 | - | - | 0.0004 | - | - | - | 0.19 | 0.50 | - |
| 959.02 | 9 | KRYEGLTQR | 3236 | PEP 1-14 | B27 | - | - | 0.0008 | - | - | - | - | 0.17 | - |
| 959.03 | 9 | ARLYGIRAK | 3237 | PEP 2-62a | B27 | - | - | 0.0021 | - | - | - | - | 0.79 | - |
| 959.04 | 9 | FRYNGLIHR | 3238 | RAT 60S L28 | B27 | - | - | 0.028 | - | - | - | 0.0001 | 1.0 | - |

*Shaded areas indicate good or intermediate cross-reactive binding to alleles other than the reported restriction element.
+Boxed areas give the binding capacity of epitopes to their reported restriction element.

TABLE 28

| Compilation of "Known" HLA Motifs | | | | | | | | | | | |
|---|---|---|---|---|---|---|---|---|---|---|---|
| Motif | B Pocket | F Pocket | | | | Phenotypic (Allelic) Frequency | | | | | Assay |
| Type* | Motif | Motif | Antigen | HLA Allele | Cell Line | Caucasian | Negro | Japanese | Chinese | Hispanic | Available |
| A | T, S | Y | A1 | A*0101 | Steinlin | 28.6 | 10.1 | 1.4 | 9.2 | 10.1 | yes |
| B | Y | F, L, I | A24 | A*2401 | KT3 | 16.8 | 8.8 | 58.1 | 32.9 | 26.7 | yes |
| C | V, L, M | L, I, V | Aw69.1** | A*6901 | C1R | 0.5 | 0.0 | 0.0 | 0.8 | 0.0 | |
| | L, M | L, I, V | A2.1 | A*0201 | JY | 45.8 | 30.3 | 42.4 | 54.0 | 43.0 | yes |
| All C | | | | | | 46.2 | 30.3 | 42.4 | 54.5 | 43.0 | |
| D | V, L, M | K, R | Aw68.1 | A*6801 | LB | 3.5 | 6.2 | 0.0 | 0.0 | 4.2 | |
| | T, V | K, R | A11 | A*1101 | BVR | 9.9 | 3.8 | 19.7 | 33.1 | 7.3 | yes |
| | V, L, M | K, R | A3.2 | A*0301 | GM3107 | 20.6 | 16.3 | 1.2 | 7.1 | 14.8 | yes |
| | hydrophobic | K, R | Aw31 | A*3101 | | 4.4 | 3.8 | 14.8 | 9.6 | 10.1 | |
| All D | | | | | | 35.9 | 28.6 | 33.9 | 46.3 | 33.9 | |
| E | P | F, Y | B35 | B*3503 | EHM | 15.4 | 14.8 | 15.4 | 9.8 | 28.1 | yes |
| F | P | L, I, V (Y, F, W) | B7 | B*0701 | GM3107 | 17.7 | 15.5 | 9.6 | 6.9 | 11.8 | yes |
| | P | L, I, V | B14 | B*1401 | LWAGS | 7.6 | 6.3 | 0.4 | 0.8 | 12.4 | |
| | P | L, I, V | B51 | B*5101 | KAS116 | 6.9 | 6.7 | 17.2 | 13.0 | 7.6 | |
| | P | L, I, V, M, V, F, W | B53 | B*5301 | AMAI | 1.6 | 22.6 | 0.2 | 0.0 | 4.2 | |
| | P, (R) | L, I, V, M, Y, F, W | Cw6 | Cw*0602 | C1R | 17.6 | 13.7 | 2.2 | 19.0 | 12.2 | yes |

TABLE 28-continued

Compilation of "Known" HLA Motifs

| Motif Type* | B Pocket Motif | F Pocket Motif | Antigen | HLA Allele | Cell Line | Phenotypic (Allelic) Frequency Caucasian | Negro | Japanese | Chinese | Hispanic | Assay Available |
|---|---|---|---|---|---|---|---|---|---|---|---|
| All F | | | | | | 43.9 | 53.6 | 28.0 | 35.3 | 41.7 | |
| G | P, K | P, K | B27 | B*2705 | LG2 | 7.5 | 2.6 | 0.8 | 3.4 | 4.9 | yes |
| H | RR/K3, R/K5 | L, I, V | B8 | B*0801 | Steinlin | 18.1 | 6.3 | 0.0 | 3.6 | 9.0 | yes |

*Motifs are grouped as shown below:

| Motif Type | Position 2 | C-terminus |
|---|---|---|
| A | sm. polar | tyrosine |
| B | aromatic | hydrophobic |
| C | aliphatic | aliphatic |
| D | aliphatic | basic |
| E | proline | aromatic |
| F | proline | hydrophobic |
| G | basic | basic |
| H | basic/basic | aliphatic |

To date, motifs A-D have been found only in A alleles; F,G, and H are found in B alleles.
**A28 is split into A*6801, A*6802, A*6803, and A*6901. The population distribution of the A28 subtypes was estimated from the overall frequency of the A28 allele and the distribution of the subtypes reported by Fernandez-Vina (Hu. Imm. 33:163)

TABLE 29

F (C-terminal) Pocket Residues

| Antigen | Allele | MHC Residue 77 | 80 | 81 | 84 | 95 | 116 | MOTIF |
|---|---|---|---|---|---|---|---|---|
| A3.2 | A*3101 | D | T | L | Y | I | D | K, R, Y |
| A11 | A*1101 | D | T | L | Y | I | D | K |
| Aw31 | A*3101 | D | T | L | Y | I | D | R, K |
| Aw68.1 | A*6801 | D | T | L | Y | I | D | K, R |
| B27 | A*2705 | D | T | L | Y | L | D | K, H, R |

TABLE 29-continued

F (C-terminal) Pocket Residues

| Antigen | Allele | 77 | 80 | 81 | 84 | 95 | 116 | MOTIF |
|---|---|---|---|---|---|---|---|---|
| A1 | A*0101 | N | T | L | Y | I | D | Y |
| A2.1 | A*0201 | D | T | L | Y | V | Y | L, M, I, V |
| A24 | A*2401 | K | I | A | Y | L | Y | F, L, I, W |
| B7 | A*0701 | S | N | L | Y | L | Y | L, I, V |
| B8 | A*0801 | S | N | L | Y | L | Y | L, I |
| B35 | A*3501 | S | N | L | Y | I | S | Y, F, M, I, L |
| B37 | A*3701 | D | T | L | Y | I | F | L, F, M, I, V |
| B54 | A*5401 | S | N | L | Y | W | L | F, (L, I, V, Y?) |

TABLE 30

| Peptide | AA | Sequence | SEQ ID NO | Antigen | Protein or Molecule | 1st Position | B*0702 |
|---|---|---|---|---|---|---|---|
| 1292.01 | 9 | SPRTLNAWI | 3239 | HIV | GAG | 180 | 0.42 |
| 1292.02 | 9 | KPCVKLTPI | 3240 | HIV | ENV | 130 | 0.11 |
| 1292.03 | 9 | SPAIFQSSI | 3241 | HIV | POL | 335 | 0.31 |
| 1292.07 | 10 | LPQGWKGSPI | 3242 | HIV | POL | 328 | 0.074 |
| 1292.13 | 9 | HPVHAGPIA | 3243 | HIV | GAG | 248 | 0.11 |
| 1292.14 | 9 | HPVHAGPII | 3244 | HIV | GAG | 248 | 0.41 |
| 1292.17 | 9 | PPVVHGCPL | 3245 | HIV | NS5 | 2317 | 0.014 |
| 1292.19 | 10 | KPTLHGPTPI | 3246 | HIV | NS3 | 1614 | 0.26 |
| 1292.2 | 10 | APTLWARMII | 3247 | HIV | NS5 | 2835 | 0.39 |
| 1292.22 | 10 | LPRRGPRLGI | 3248 | HIV | Core | 37 | 0.67 |
| 1292.23 | 9 | SPGQRVEFI | 3249 | HIV | NS5 | 2615 | 0.014 |
| 1292.24 | 9 | LPGCSFSII | 3250 | HIV | Core | 169 | 0.15 |
| 1292.26 | 10 | SPGALWGVI | 3251 | HIV | NS4 | 1887 | 0.022 |
| 1292.27 | 10 | TPLLYRLGAI | 3252 | HIV | NS3 | 1621 | 0.022 |
| 27.0136 | 9 | APAAPTPAA | 3253 | p53 | | 76 | 0.3 |
| 27.0262 | 10 | APAPAAPTPA | 3254 | p53 | | 74 | 0.019 |
| 27.0264 | 10 | APSWPLSSSV | 3255 | p53 | | 88 | 0.023 |
| 28.0418 | 9 | FPWDILFPA | 3256 | HDV | | 194 | 0.02 |
| 34.0074 | 8 | IPWQRLLL | 3257 | CEA | | 13 | 0.11 |
| 34.0075 | 8 | RPGVNLSL | 3258 | CEA | | 428 | 0.072 |
| 34.0081 | 8 | SPGGLREL | 3259 | HER2/neu | | 133 | 0.055 |
| 34.0084 | 8 | WPDSLPDL | 3260 | HER2/neu | | 415 | 0.02 |
| 34.0085 | 8 | IPVAIKVL | 3261 | HER2/neu | | 748 | 0.012 |
| 34.0086 | 8 | SPYVSRLL | 3262 | HER2/neu | | 779 | 0.044 |
| 34.0087 | 8 | VPIKWMAL | 3263 | HER2/neu | | 884 | 1.4 |
| 34.0089 | 8 | SPKANKEI | 3264 | HER2/neu | | 760 | 0.058 |
| 34.0095 | 8 | RPRFRELV | 3265 | HER2/neu | | 966 | 0.041 |
| 34.0099 | 8 | SPGKNGW | 3266 | HER2/neu | | 1174 | 0.023 |
| 34.011 | 8 | VPISHLYI | 3267 | MAGE2 | | 170 | 0.017 |
| 34.0111 | 8 | MPKTGLLI | 3268 | MAGE2 | | 196 | 0.019 |

TABLE 30-continued

| Peptide | AA | Sequence | SEQ ID NO | Antigen | Protein or Molecule | 1st Position | B*0702 |
|---|---|---|---|---|---|---|---|
| 34.0117 | 8 | MPKAGLLI | 3269 | MAGE3 | | 196 | 0.13 |
| 34.0121 | 8 | APAPSWPL | 3270 | p53 | | 86 | 0.054 |
| 34.0178 | 9 | GPLPAARPI | 3271 | HER2/neu | | 1155 | 0.055 |
| 34.018 | 9 | LPTNASLSI | 3272 | HER2/neu | | 65 | 0.011 |
| 34.0181 | 9 | SPAFDNLYI | 3273 | HER2/neu | | 1214 | 0.019 |
| 34.0182 | 9 | SPKANKEII | 3274 | HER2/neu | | 760 | 0.015 |
| 34.0183 | 9 | SPLTSIISI | 3275 | HER2/neu | | 649 | 0.064 |
| 34.0184 | 9 | SPREGPLPI | 3276 | HER2/neu | | 1151 | 0.12 |
| 34.0187 | 9 | GPHISYPPI | 3277 | MAGE3 | | 296 | 0.022 |
| 34.019 | 9 | RPILTIITI | 3278 | p53 | | 249 | 0.046 |
| 34.0192 | 9 | SPQPKKKPI | 3279 | p53 | | 315 | 0.048 |
| 34.026 | 10 | GPASPLDSTF | 3280 | HER2/neu | | 995 | 0.011 |
| 34.0265 | 10 | SPREGPLPAI | 3281 | HER2/neu | | 1151 | 0.066 |
| 34.0268 | 10 | VPISHLYILI | 3282 | MAGE2 | | 170 | 0.015 |
| 34.0271 | 10 | MPKAGLLIII | 3283 | MAGE3 | | 196 | 0.017 |
| 34.0273 | 10 | APAPAPSWPI | 3284 | p53 | | 84 | 0.13 |
| 34.0361 | 11 | SPLDSTFYRSL | 3285 | HER2/neu | | 998 | 0.064 |
| 34.0362 | 11 | LPAARPAGATL | 3286 | HER2/neu | | 1157 | 0.014 |
| 34.0365 | 11 | KPYDGIPAREI | 3287 | HER2/neu | | 921 | 0.043 |
| 34.0368 | 11 | SPLTSIISAVV | 3288 | HER2/neu | | 649 | 0.025 |
| 34.0374 | 11 | CPSGVKPDLSY | 3289 | HER2/neu | | 600 | 0.03 |
| 34.0382 | 11 | GPRALIETSYV | 3290 | MAGE2 | | 274 | 0.13 |
| 34.0387 | 11 | MPKAGLLIIVL | 3291 | MAGE3 | | 196 | 0.028 |
| 34.0389 | 11 | GPRALVETSYV | 3292 | MAGE3 | | 274 | 0.19 |
| 34.039 | 11 | APRMPEAAPPV | 3293 | p53 | | 63 | 0.45 |
| 34.0397 | 11 | SPALNKMFBQI | 3294 | p53 | | 127 | 0.18 |

TABLE 31

B Pocket Comparison of A3-Like Alleles

| Antigen | Allele | MHC Residue 7 | 9 | 24 | 34 | 45 | 63 | 66 | 67 | 70 | 99 | MOTIF |
|---|---|---|---|---|---|---|---|---|---|---|---|---|
| A3.2 | A*0301 | Y | F | A | V | M | E | N | V | Q | Y | V, L, M |
| A11 | A*1101 | Y | Y | A | V | M | E | N | V | Q | Y | T, M |
| Aw31 | A*3101 | Y | T | A | V | M | E | N | V | H | Y | hydrophobic |
| Aw68.1 | A*6801 | Y | Y | A | V | M | N | N | V | Q | Y | V, T |
| A1 | A*0101 | Y | T | A | V | M | E | N | M | H | Y | T, S 2 or D, E 3 |
| A2.1 | A*0201 | Y | F | A | V | M | E | K | V | H | Y | L, M |
| A24 | A*2401 | Y | S | A | V | M | E | K | V | H | F | Y |
| B8 | B*0801 | Y | D | S | V | E | N | I | F | N | Y | R, K 3, R, K 5 |
| B14 | B*1401 | Y | Y | S | V | E | N | I | C | N | Y | P |
| B27 | B*2705 | Y | H | T | V | E | E | I | C | K | Y | R |
| B35 | B*3501 | Y | Y | A | V | T | N | I | F | N | Y | P |
| B35 | B*3503 | Y | Y | A | V | T | N | I | F | N | Y | P |
| B51 | B*5101 | Y | Y | A | V | T | N | I | F | N | Y | P |
| B53 | B*5301 | Y | Y | A | V | T | N | I | F | N | Y | P |
| B54 | B*5401 | Y | Y | A | V | G | N | I | Y | Q | Y | P |

TABLE 32

Predicted Motifs Based on Structure of B and F Pockets

| Motif Type* | B Pocket Predicted Motif | F Pocket Predicted Motif | Antigen | HLA Allele | Cell Line |
|---|---|---|---|---|---|
| A | — | Y | B44 | B*4403 | Pitout |
| C | V, L, M | L, I, V | Aw68.2 | A*6802 | C1R |
| D | V, L, M | K, R | Aw68.3 | A*6803 | C1R |

TABLE 32-continued

Predicted Motifs Based on Structure of B and F Pockets

| Motif Type* | B Pocket Predicted Motif | F Pocket Predicted Motif | Antigen | HLA Allele | Cell Line |
|---|---|---|---|---|---|
| | V, L, M | K, R | A30 | A*3001/3003 | DUCAF, LBUF |
| | (L, I, V, M, S, T) | K, R | A33 | A*3301 | LWAGS |
| E | P | F | B54 | B*5401 | KT3 |
| F | — | L, I, V, M, Y, F, W | Cw3 | Cw*0301 | |
| | P, Y | L, I, V, M, Y, F, W | Cw4 | Cw*0401 | |
| | P, Y | L, I, V, M, Y, F, W | Cw7 | Cw*0701/0702 | C1R, JY |

TABLE 33

B Pocket Comparison of Alleles Preferring Proline in Position 2

| | | MHC Residue | | | | | | | | | | |
|---|---|---|---|---|---|---|---|---|---|---|---|---|
| Antigen | Allele | 7 | 9 | 24 | 34 | 45 | 63 | 66 | 67 | 70 | 99 | MOTIF |
| B7 | B0701 | Y | Y | S | V | E | N | I | Y | Q | Y | P |
| B14 | B1401 | Y | Y | S | V | E | N | I | C | N | Y | P |
| B35 | B3501 | Y | Y | A | V | T | N | I | F | N | Y | P |
| B35 | B3503 | Y | Y | A | V | T | N | I | F | N | Y | P |
| B51 | B5101 | Y | Y | A | V | T | N | I | F | N | Y | P |
| B53 | B5301 | Y | Y | A | V | T | N | I | F | N | Y | P |
| B54 | B5401 | Y | Y | A | V | G | N | I | Y | Q | Y | P |
| A1 | A0101 | Y | F | A | V | M | E | N | M | H | Y | T, S 2 or D, E 3 |
| A2.1 | A0201 | Y | F | A | V | M | E | K | V | H | Y | L, M |
| A3.2 | A0302 | Y | F | A | V | M | E | N | V | Q | Y | V, L, M |
| A11 | A1101 | Y | Y | A | V | M | E | N | V | Q | Y | T, M |
| A24 | A2401 | Y | S | A | V | M | E | K | V | H | F | Y |
| Aw31 | A3101 | Y | T | A | V | M | E | N | V | H | Y | hydrophobic |
| Aw68.1 | A6801 | Y | Y | A | V | M | N | N | V | Q | Y | V, T |
| B8 | B0801 | Y | D | S | V | E | N | I | F | N | Y | R, K 3, R, K 5 |
| B27 | B2705 | Y | H | T | V | E | E | I | C | K | Y | R |

TABLE 34

| Synthesis | Antigen | Mole | Size | Pos1 | Sequence | SEQ ID NO | A1 | A2 | A3 | A1 | A24 | P1 | P2 | MHC Alleles |
|---|---|---|---|---|---|---|---|---|---|---|---|---|---|---|
| CH-15 | CSP | | 9 | 293 | MPNDPNRNV | 3295 | | | | | | + | | P1 |
| CH-15 | CSP | | 10 | 101 | NPDPNANPNV | 3296 | | | | | | + | | P1 |
| CH-15 | CSP | | 10 | 328 | EPSDKHIKEY | 3297 | – | | | | | | + | A01/P2 |
| CH-15 | HBV | | 9 | 191 | IPQSLDSWW | 3298 | | | | | | | + | P2 |
| CH-15 | HBV | | 9 | 232 | CPGYRWMCL | 3299 | | | | | | + | | P1 |
| CH-15 | HBV | ENV | 9 | 313 | IPIPSSWAF | 3300 | | | | | | | + | P2 |
| CH-15 | HBV | ENV | 9 | 365 | TPARVTGGV | 3301 | | | | | | + | | P1 |
| CH-15 | HBV | ENV | 9 | 379 | LPIFFCLWV | 3302 | | | | | | + | | P1 |
| CH-15 | HBV | POL | 9 | 404 | WPKFAVPNL | 3303 | | | | | | + | | P1 |
| CH-15 | HBV | POL | 9 | 440 | HPAAMPHLL | 3304 | | | | | | + | | P1 |
| CH-15 | HBV | POL | 9 | 541 | FPHCLAFSY | 3305 | | | | | | | + | P2 |
| CH-15 | HBV | POL | 9 | 789 | DPSRGRLGL | 3306 | | | | | | + | | P1 |
| CH-15 | HBV | POL | 10 | 19 | GPLEEELPRL | 3307 | | | | | | + | | P1 |
| CH-15 | HBV | POL | 10 | 50 | IPWTHKVGNE | 3308 | | | | | | | + | P2 |
| CH-15 | HBV | POL | 10 | 123 | LPLDKGIKPY | 3309 | | | | | | | + | P2 |
| CH-15 | HBV | CORE | 10 | 134 | PPNAPILSTL | 3310 | | | | | | + | | P1 |
| CH-15 | HBV | ENV | 10 | 173 | GPLLVLQAGF | 3311 | | | | | | | + | P2 |
| CH-15 | HBV | ENV | 10 | 340 | VPFVQWFVGL | 3312 | | | | | | + | | P1 |
| CH-15 | HBV | POL | 10 | 365 | TPARVTGGVF | 3313 | | | | | | | + | P2 |
| CH-15 | HBV | ENV | 10 | 379 | LPIFFCLWVY | 3314 | | | | | | | + | P2 |
| CH-15 | HBV | POL | 10 | 409 | VPNLQSLTNL | 3315 | | | | | | + | | P1 |
| CH-15 | HBV | POL | 10 | 541 | FPHCLAFSYM | 3316 | | | | | | + | | P1 |
| CH-15 | HCV | CORE | 9 | 57 | QPRGRRQPI | 3317 | | | | | | + | | P1 |

TABLE 34-continued

| Synthesis | Antigen | Mole | Size | Pos1 | Sequence | SEQ ID NO | A1 | A2 | A3 | A1 | A24 | P1 | P2 | MHC Alleles |
|---|---|---|---|---|---|---|---|---|---|---|---|---|---|---|
| CH-15 | HCV | CORE | 9 | 78 | QPGYPWPLY | 3318 | | | | | | | + | P2 |
| CH-15 | HCV | CORE | 9 | 83 | WPLYGNEGL | 3319 | | | | | | + | | P1 |
| CH-15 | HCV | CORE | 9 | 99 | SPRGSRPSW | 3320 | | | | | | | + | P2 |
| CH-15 | HCV | CORE | 9 | 111 | DPRRRSRNL | 3321 | | | | | | + | | P1 |
| CH-15 | HCV | CORE | 9 | 168 | LPGCSFSIF | 3322 | | | | | | | + | P2 |
| CH-15 | HCV | E1 | 9 | 339 | IPQAVVDMV | 3323 | | | | | | + | | P1 |
| CH-15 | HCV | E2 | 9 | 600 | GPWLTPRCM | 3324 | | | | | | + | | P1 |
| CH-15 | HCV | E2 | 9 | 622 | YPCTVNFTI | 3325 | | | | | | + | | P1 |
| CH-15 | HCV | E2 | 9 | 681 | LPALSTGLI | 3326 | | | | | | + | | P1 |
| CH-15 | HCV | NS3 | 9 | 1358 | HPNIEEVAL | 3327 | | | | | | + | | P1 |
| CH-15 | HCV | NS3 | 9 | 1530 | TPAETTVRL | 3328 | | | | | | + | | P1 |
| CH-15 | HCV | NS3 | 9 | 1598 | APPPSWDQM | 3329 | | | | | | + | | P1 |
| CH-15 | HCV | NS3 | 9 | 1599 | PPPSWDQMW | 3330 | | | | | | | + | P2 |
| CH-15 | HCV | NS3 | 9 | 1619 | GPTPLLYRL | 3331 | | | | | | + | | P1 |
| CH-15 | HCV | NS4 | 9 | 1887 | SPGALVVGV | 3332 | | | | | | + | | P1 |
| CH-15 | HCV | NS4 | 9 | 1906 | GPEGAVQW | 3333 | | | | | | | + | P2 |
| CH-15 | HCV | NS5 | 9 | 2159 | LPCEPEPDV | 3334 | | | | | | + | | P1 |
| CH-15 | HCV | NS5 | 9 | 2162 | EPEPDVAVL | 3335 | | | | | | + | | P1 |
| CH-15 | HCV | NS5 | 9 | 2396 | DPDLSDGSW | 3336 | | | | | | | + | P2 |
| CH-15 | HCV | NS5 | 9 | 2512 | PPHSAKSKF | 3337 | | | | | | | + | P2 |
| CH-15 | HCV | NS5 | 9 | 2615 | SPGQRVEFL | 3338 | | | | | | + | | P1 |
| CH-15 | HCV | NS5 | 9 | 2771 | DPPQPEYDL | 3339 | | | | | | + | | P1 |
| CH-15 | HCV | NS5 | 9 | 2774 | QPEYDLELI | 3340 | | | | | | + | | P1 |
| CH-15 | HCV | NS5 | 9 | 2835 | APTLWARMI | 3341 | | | | | | + | | P1 |
| CH-15 | HCV | CORE | 10 | 37 | LPRRGPRLGV | 3342 | | | | | | + | | P1 |
| CH-15 | HCV | CORE | 10 | 142 | APLGGAARAL | 3343 | | | | | | + | | P1 |
| CH-15 | HCV | CORE | 10 | 168 | LPGCSFSIFL | 3344 | | | | | | + | | P1 |
| CH-15 | HCV | E1 | 10 | 252 | IPTTTIRRHV | 3345 | | | | | | + | | P1 |
| CH-15 | HCV | E1 | 10 | 308 | YPGHVSGHRM | 3346 | | | | | | + | | P1 |
| CH-15 | HCV | E2 | 10 | 497 | VPASQVCGPV | 3347 | | | | | | + | | P 1 |
| CH-l5 | HCV | e2 | 10 | 600 | GPWLTPRCMV | 3348 | | | | | | + | | P1 |
| CH-15 | HCV | E2 | 10 | 622 | YPCTVNFTIF | 3349 | | | | | | | + | P2 |
| CH-15 | HCV | E2 | 10 | 663 | SPLLLSTTEW | 3350 | | | | | | | + | P2 |
| CH-15 | HCV | E2 | 10 | 793 | WPLLLLLLAL | 3351 | | | | | | + | | P1 |
| CH-15 | HCV | NS3 | 10 | 1120 | TPCTCGSSDL | 3352 | | | | | | + | | P1 |
| CH-15 | HCV | NS3 | 10 | 1239 | APAAYAAQGY | 3353 | + | | | | | | + | A01/P2 |
| CH-15 | HCV | NS3 | 10 | 1254 | NPSVAATLGF | 3354 | | | | | | | + | P2 |
| CH-15 | HCV | NS3 | 10 | 1506 | RPSGMFDSSV | 3355 | | | | | | + | | P1 |
| CH-15 | HCV | NS3 | 10 | 1547 | LPVCQDHLER | 3356 | | | | | | | − | P2 |
| CH-15 | HCV | NS3 | 10 | 1598 | APPPSWDQMW | 3357 | | | | | | | + | P2 |
| CH-15 | HCV | NS3 | 10 | 1514 | KPTLHGPTPL | 3358 | | | | | | | + | P1 |
| CH-15 | HCV | NS3 | 10 | 1521 | TPLLYRLGAV | 3359 | | | | | | | + | P1 |
| CH-15 | HCV | NS4 | 10 | 1730 | LPGNPAIASL | 3360 | | | | | | | + | P1 |
| CH-15 | HCV | NS4 | 10 | 1783 | NPAIASLMAF | 3361 | | | | | | | + | P2 |
| CH-15 | HCV | NS4 | 10 | 1882 | LPSILDPGAL | 3362 | | | | | | | + | P1 |
| CH-15 | HCV | NS4 | 10 | 1387 | SPGALVVGVV | 3363 | | | | | | | + | P1 |
| CH-15 | HCV | NS4 | 10 | 1906 | GPGEGAVQWM | 3364 | | | | | | | + | P1 |
| CH-15 | HCV | NS4 | 10 | 1934 | VPESDAAARV | 3365 | | | | | | | + | P1 |
| CH-15 | HCV | NS5 | 10 | 2164 | EPDVAVLTSM | 3366 | | | | | | | + | P1 |
| CH-15 | HCV | NS5 | 10 | 2615 | SPGQRVEFLV | 3367 | | | | | | | + | P1 |
| CH-15 | HCV | NS5 | 10 | 2768 | PPGDPPQPEY | 3368 | | | | | | | + | P2 |
| CH-15 | HCV | NS5 | 10 | 2772 | PPQPEYDLEL | 3369 | | | | | | | + | P1 |
| CH-15 | HCV | NS5 | 10 | 2822 | TPVNSWLGNI | 3370 | | | | | | | + | P1 |
| CH-15 | HCV | NS5 | 10 | 2835 | APTLWARMIL | 3371 | | | | | | | + | P1 |
| CH-15 | HIV | VPR | 9 | 34 | FPRIWLHJL | 3372 | | | | | | | + | P1 |
| CH-15 | HIV | POL | 9 | 37 | SPTRRELQV | 3373 | | | | | | | + | P1 |
| CH-15 | HIV | NEF | 9 | 34 | FPVRPQVPL | 3374 | | | | | | | + | P1 |
| CH-15 | HIV | NEF | 9 | 37 | RPQVPLRPM | 3375 | | | | | | | + | P1 |
| CH-15 | HIV | VIF | 9 | 99 | DPDLADQLI | 3376 | | | | | | | + | P1 |
| CH-15 | HIV | POL | 9 | 110 | LPGRWKPKM | 3377 | | | | | | | + | P1 |
| CH-15 | HIV | ENV | 9 | 123 | KPCVKLTPL | 3378 | | | | | | | + | P1 |
| CH-15 | HIV | GAG | 9 | 153 | SPRTLNAWV | 3379 | | | | | | | + | P1 |
| CH-15 | HIV | VIF | 9 | 161 | PPLPSVJKL | 3380 | | | | | | | + | P1 |
| CH-15 | HIV | POL | 9 | 171 | FPISPIETV | 3381 | | | | | | | + | P1 |
| CH-15 | HIV | POL | 9 | 179 | VPVKLKPGM | 3382 | | | | | | | + | P1 |
| CH-15 | HIV | POL | 9 | 184 | KPGMDGPKV | 3383 | | | | | | | + | P1 |
| CH-15 | HIV | GAG | 9 | 185 | TPQDLNTML | 3384 | | | | | | | + | P1 |
| CH-15 | HIV | POL | 9 | 189 | GPVKVKQWPL | 3385 | | | | | | | + | P1 |
| CH-15 | HIV | GAG | 9 | 185 | TPQDLNTML | 3386 | | | | | | | + | P1 |
| CH-15 | HIV | POL | 9 | 189 | GPKVKQWPL | 3387 | | | | | | | + | P1 |
| CH-15 | HIV | GAG | 9 | 258 | NPPIPVGEI | 3388 | | | | | | | + | P1 |
| CH-15 | IHV | GAG | 9 | 259 | PPIPVGETY | 3389 | | | | | | | + | P2 |
| CH-15 | HIV | GAG | 9 | 293 | GPKEPFRDY | 3390 | | | | | | | + | P2 |
| CH-15 | HIV | POL | 9 | 327 | SPAIFQSSM | 3391 | | | | | | | + | P1 |
| CH-15 | HIV | GAG | 9 | 343 | GPAATLEEM | 3392 | | | | | | | + | P1 |
| CH-15 | HIV | POL | 9 | 346 | NPDIVIYQY | 3393 | | | | | | | + | A01/P2 |
| CH-15 | HIV | GAG | 9 | 360 | GPGHKARVL | 3394 | | | | | | | + | P1 |

TABLE 34-continued

| Synthesis | Antigen | Mole | Size | Pos1 | Sequence | SEQ ID NO | A1 | A2 | A3 | A1 | A24 | P1 | P2 | MHC Alleles |
|---|---|---|---|---|---|---|---|---|---|---|---|---|---|---|
| CH-15 | HIV | POL | 9 | 395 | EPPFLWMGY | 3395 | | | | | | | + | P2 |
| CH-15 | HIV | ENV | 9 | 404 | DPEIVMHSF | 3396 | | | | | | | + | P2 |
| CH-15 | HIV | POL | 9 | 417 | LPEKDSWTV | 3397 | | | | | | | + | P1 |
| CH-15 | HIV | GAG | 9 | 507 | YPLASLRSL | 3398 | | | | | | | + | P1 |
| CH-15 | HIV | ENV | 9 | 547 | APTKAKRRV | 3399 | | | | | | | + | P1 |
| CH-15 | HIV | POL | 9 | 590 | TPPLVKLWY | 3400 | | | | | | | + | P2 |
| CH-15 | HIV | POL | 9 | 603 | EPIVGAETF | 3401 | | | | | | | + | P2 |
| CH-15 | HIV | POL | 9 | 680 | QPDKSESEL | 3402 | | | | | | | + | P1 |
| CH-15 | HIV | POL | 9 | 759 | LPPVVAKEI | 3403 | | | | | | | + | P1 |
| CH-15 | HIV | POL | 9 | 760 | PPVVAKEIV | 3404 | | | | | | | + | P1 |
| CH-15 | HIV | POL | 9 | 991 | VPRRKAKII | 3405 | | | | | | | + | P1 |
| CH-15 | HIV | TAT | 10 | 2 | EPVDPRLEPW | 3406 | | | | | | | + | P2 |
| CH-15 | HIV | POL | 10 | 37 | SPTRRELQVW | 3407 | | | | | | | + | P2 |
| CH-15 | HIV | POL | 10 | 110 | LPGRQKPKMI | 3408 | | | | | | | + | P1 |
| CH-15 | HIV | POL | 10 | 152 | TPVNRGRNL | 3409 | | | | | | | + | P1 |
| CH-15 | HIV | VIF | 10 | 160 | KPPLPSVJKL | 3410 | | | | | | | + | P1 |
| CH-15 | HIV | POL | 10 | 174 | SPIETVPVKL | 3411 | | | | | | | + | P1 |
| CH-15 | HIV | POL | 10 | 222 | GPENPYNTPV | 3412 | | | | | | | + | P1 |
| CH-15 | HIV | POL | 10 | 325 | NPYNTPVFAI | 3413 | | | | | | | + | P1 |
| CH-15 | HIV | GAG | 10 | 258 | NPPIPVGEIY | 3414 | | | | | | | + | P2 |
| CH-15 | HIV | GAG | 10 | 261 | IPVGEIYKRW | 3415 | | | | | | | + | P2 |
| CH-15 | HIV | POL | 10 | 289 | VPLDKDFRKY | 3416 | | | | | | | + | P2 |
| CH-15 | HIV | GAG | 10 | 293 | GPKEPFRDYV | 3417 | | | | | | | + | P1 |
| CH-15 | HIV | GAG | 10 | 296 | EPFRDYVDRF | 3418 | | | | | | | + | P2 |
| CH-15 | HIV | POL | 10 | 110 | TPGIRYQYNV | 3419 | | | | | | | + | P1 |
| CH-15 | HIV | POL | 10 | 340 | EPFRKQNPDI | 3420 | | | | | | | + | P1 |
| CH-15 | HIV | GAG | 10 | 343 | GPAATLEEMM | 3421 | | | | | | | + | P1 |
| CII-15 | HIV | POL | 10 | 346 | NPDIVIYQYM | 3422 | | | | | | | + | P1 |
| CH-15 | HIV | POL | 10 | 396 | PPFLWMGYEL | 3423 | | | | | | | + | P1 |
| CH-15 | HIV | POL | 10 | 406 | HPDKWINQPI | 3424 | | | | | | | + | P1 |
| CH-15 | HIV | GAG | 10 | 473 | EPTAPPEESF | 3425 | | | | | | | + | P2 |
| CH-15 | HIV | GAG | 10 | 507 | YPLASLRSLF | 3426 | | | | | | | + | P2 |
| CH-15 | HIV | ENV | 10 | 547 | APTKAKRRVV | 3427 | | | | | | | + | P1 |
| CH-15 | HIV | POL | 10 | 591 | PPLVKLWYQL | 3428 | | | | | | | + | P1 |
| CH-15 | HIV | POL | 10 | 603 | EPIVGAETFY | 3429 | | | | | | | + | P2 |
| CH-15 | HIV | POL | 10 | 680 | QPDKSESELV | 3430 | | | | | | | + | P1 |
| CH-15 | HIV | POL | 10 | 759 | LPPVVAKEIV | 3431 | | | | | | | + | P1 |
| CH-15 | HIV | POL | 10 | 372 | IPYNPQSQGV | 3432 | | | | | | | + | P1 |
| CH-15 | HIV | POL | 10 | 963 | DPLQKGPAKL | 3433 | | | | | | | + | P1 |
| CH-15 | HPV15 | E7 | 9 | 5 | TPILHEYML | 3434 | | | | | | | + | P1 |
| CH-15 | HPV16 | E6 | 9 | 11 | DPQERPRKL | 3435 | | | | | | | + | P1 |
| CH-15 | HPV16 | E7 | 9 | 46 | EPDRAHYNI | 3436 | | | | | | | + | P1 |
| CH-15 | HPV16 | E6 | 9 | 118 | CPEEKQRHL | 3437 | | | | | | | + | P1 |
| CH-15 | HPV16 | E7 | 10 | 46 | EPDRAHYNIV | 3438 | | | | | | | | P1 |
| CH-15 | HPV16 | E6 | 10 | 65 | NPYAVCDKCL | 3439 | | | | | | | + | P1 |
| CH-15 | HPV18 | E7 | 9 | 3 | GPKATLQDI | 3440 | | | | | | | + | P1 |
| CH-15 | HPV18 | E6 | 9 | 6 | DPTRRPYKL | 3441 | | | | | | | + | P1 |
| CH-15 | HPV18 | E6 | 9 | 110 | KPLNPAEKL | 3442 | | | | | | | + | P1 |
| CH-15 | HPV18 | E6 | 9 | 113 | NPAEKLRHL | 3443 | | | | | | | | P1 |
| CH-15 | HPV18 | E7 | 10 | 3 | GPKATLQDIV | 3444 | | | | | | | + | P1 |
| CH-15 | HPV18 | E7 | 10 | 16 | EPQNEIPVDL | 3445 | | | | | | | + | P1 |
| CH-15 | HPV18 | E7 | 10 | 55 | EPQRHTMLCM | 3446 | | | | | | | + | P1 |
| CH-15 | HPV18 | E6 | 10 | 60 | IPHAACHKCI | 3447 | | | | | | | | P1 |
| CH-15 | LSA1 | | 9 | 1663 | LPSENERGY | 3448 | | | | | | | + | A01/P2 |
| CH-15 | LSA1 | | 9 | 1786 | KPIVQYDNF | 3449 | | | | | | | + | P2 |
| CH-15 | LSA1 | | 10 | 1663 | LPSENERGYY | 3450 | | | | | | | + | A01/P2 |
| CH-15 | MAGE2 | | 9 | 170 | VPISHLYIL | 3451 | | | | | | | + | P1 |
| CH-15 | MAGE2 | | 9 | 196 | MPKTGLLII | 3452 | | | | | | | + | P1 |
| CH-15 | MAGE2 | | 9 | 265 | DPACYEFLW | 3453 | | | | | | | + | P2 |
| CH-15 | MAGE2 | | 9 | 296 | EPHISYPPL | 3454 | | | | | | | + | P1 |
| CH-15 | MAGE2 | | 9 | 301 | YPPLHERAL | 3455 | | | | | | | + | P1 |
| CH-15 | MAGE2 | | 10 | 170 | VPISHLYILV | 3456 | | | | | | | + | P1 |
| CH-15 | MAGE2 | | 10 | 196 | MPKTGLLIIV | 3457 | | | | | | | + | P1 |
| CH-15 | MAGE2 | | 10 | 241 | HPRKLLMQDL | 3458 | | | | | | | + | P1 |
| CH-15 | MAGE2 | | 10 | 274 | GPRALIETSY | 3459 | | | | | | | + | P2 |
| CH-15 | MAGE2/3 | | 9 | 128 | EPVTKAEML | 3460 | | | | | | | + | P1 |
| CH-15 | MAGE2/3 | | 9 | 261 | VPGSDPACY | 3461 | | | | | | | + | P2 |
| CH-15 | MAGE2/3 | | 10 | 216 | APEEKIWEEL | 3462 | | | | | | | + | P1 |
| CH-15 | MAGE3 | | 9 | 71 | LPTTMNYPL | 3463 | | | | | | | + | P1 |
| CH-15 | MAGE3 | | 9 | 170 | DPIGHLYIF | 3464 | | | | | | | + | P2 |
| CH-15 | MAGE3 | | 9 | 196 | MPKAGLLII | 3465 | | | | | | | + | P1 |
| CH-15 | MAGE3 | | 9 | 296 | GPHISYPPL | 3466 | | | | | | | + | P1 |
| CH-15 | MAGE3 | | 9 | 301 | YPPLHEWVL | 3467 | | | | | | | + | P1 |
| CH-15 | MAGE3 | | 10 | 71 | LPTTMNYPLW | 3468 | | | | | | | + | P2 |
| CH-15 | MAGE3 | | 10 | 196 | MPKAGLLIV | 3469 | | | | | | | + | P1 |
| CH-15 | MAGE3 | | 10 | 241 | DPKKLLTQHF | 3470 | | | | | | | + | P2 |
| CH-15 | MAGE3 | | 10 | 274 | GPRALVETSY | 3471 | | | | | | | + | P2 |

TABLE 34-continued

| Synthesis | Antigen | Mole | Size | Pos1 | Sequence | SEQ ID NO | A1 | A2 | A3 | A1 | A24 | P1 | P2 | MHC Alleles |
|---|---|---|---|---|---|---|---|---|---|---|---|---|---|---|
| CH-15 | SSP2 | | 9 | 164 | IPDSIQDWL | 3472 | | | | | | | + | P1 |
| CH-15 | SSP2 | | 9 | 206 | HPSDGKCNL | 3473 | | | | | | | + | P1 |
| CH-15 | SSP2 | | 9 | 228 | GPFMKAVCV | 3474 | | | | | | | + | P1 |
| CH-15 | SSP2 | | 9 | 287 | KPKREPLDV | 3475 | | | | | | | + | P1 |
| CH-15 | SSP2 | | 9 | 305 | RPRGDNFAV | 3476 | | | | | | | + | P1 |
| CH-15 | SSP2 | | 9 | 364 | PPNPPDPDI | 3477 | | | | | | | + | P1 |
| CH-15 | SSP2 | | 9 | 379 | IPEDSEKEV | 3478 | | | | | | | + | P1 |
| CH-15 | SSP2 | | 9 | 544 | EPAPFDETL | 3479 | | | | | | | + | P1 |
| CH-15 | SSP2 | | 9 | 303 | QPRPRGDNF | 3480 | | | | | | | + | P2 |
| CH-15 | SSP2 | | 9 | 419 | LPNDKSDRY | 3481 | | | | | | | + | P2 |
| CH-15 | SSP2 | | 10 | 363 | NPPNPPNPDI | 3482 | | | | | | | + | P1 |
| CH-15 | SSP2 | | 10 | 419 | LPDNKSDRYI | 3483 | | | | | | | + | P1 |
| CH-15 | SSP2 | | 10 | 428 | IPYSPLSPKV | 3484 | | | | | | | + | P1 |
| CH-15 | SSP2 | | 10 | 236 | HPSDGKCNLY | 3485 | | | | | | | + | A01/P2 |
| CH-15 | SSP2 | | 10 | 394 | NPEDDREENF | 3486 | | | | | | | + | P2 |
| CH-15 | SSP2 | | 10 | 539 | TPYAGEPAPF | 3487 | | | | | | | + | P2 |

| X | Source | Mol. | Pos. | Cytel# | Sequence | SEQ ID NO. | AA | Motif |
|---|---|---|---|---|---|---|---|---|
| 1 | HBV | ENV | 14 | 16.006 | FPDHQLDPA | 14519 | 9 | P2A |
| 2 | HBV | NUC | 129 | 16.007 | PPAYRPPNA | 14520 | 9 | P2A |
| 3 | HBV | POL | 640 | 16.008 | YPALMPLYA | 14521 | 9 | P2A |
| 4 | HBV | X | 58 | 16.009 | LPVCAFSSA | 14522 | 9 | P2A |
| 5 | HCV | | 142 | 16.010 | APLGGAARA | 14523 | 9 | P2A |
| 6 | HCV | | 2806 | 16.011 | DPTTPLARA | 14524 | 9 | P2A |
| 7 | HCV | | 1582 | 16.012 | FPYLVAYQA | 14525 | 9 | P2A |
| 8 | HCV | | 1882 | 16.013 | LPAILSPGA | 14526 | 9 | P2A |
| 9 | HCV | | 1783 | 16.014 | NPAIASLMA | 14527 | 9 | P2A |
| 10 | HCV | | 2897 | 16.015 | SPGEINRVA | 14528 | 9 | P2A |
| 11 | HCV | | 2551 | 16.016 | TPIDTTIMA | 14529 | 9 | P2A |
| 12 | HCV | | 1621 | 16.017 | TPLLYRLGA | 14530 | 9 | P2A |
| 13 | HCV | | 242 | 16.018 | TPTLAARNA | 14531 | 9 | P2A |
| 14 | HCV | NEF | 793 | 16.019 | WPLLLLLLA | 14532 | 9 | P2A |
| 15 | HIV | POL | 38 | 16.020 | EPAADGVGA | 14533 | 9 | P2A |
| 16 | HIV | | 225 | 16.021 | NPYNTPVFA | 14534 | 9 | P2A |
| 17 | MAGE2 | | 60 | 16.022 | SPPHSPQGA | 14535 | 9 | P2A |
| 18 | MAGE3 | | 30 | 16.023 | APATEEQEA | 14536 | 9 | P2A |
| 19 | MAGE3 | | 60 | 16.024 | DPPGSPQGA | 14537 | 9 | P2A |
| 20 | PAP | TRAP | 4 | 16.032 | APLLLARAA | 14538 | 9 | P2A |
| 21 | Plasmodium | | 522 | 16.175 | VPGAATPYA | 14539 | 9 | P2A |
| 22 | PSA | ENV | 52 | 16.176 | HPQWVLTAA | 14540 | 9 | P2A |
| 23 | HBV | NUC | 313 | 16.177 | IPIPSSWAFA | 14541 | 10 | P2A |
| 24 | HBV | NUC | 49 | 16.178 | SPHHTALRQA | 14542 | 10 | P2A |
| 25 | HBV | POL | 128 | 16.179 | TPPAYRPPNA | 14543 | 10 | P2A |
| 26 | HBV | POL | 633 | 16.180 | APFTQCGYPA | 14544 | 10 | P2A |
| 27 | HBV | X | 712 | 16.181 | LPIHTAELLA | 14545 | 10 | P2A |
| 28 | HBV | | 67 | 16.182 | GPCALRFTSA | 14546 | 10 | P2A |
| 29 | HCV | | 2181 | 16.183 | DPSHITAETA | 14547 | 10 | P2A |
| 30 | HCV | | 2806 | 16.184 | DPTTPLARAA | 14548 | 10 | P2A |
| 31 | HCV | | 339 | 16.185 | IPQAVVMVA | 14549 | 10 | P2A |
| 32 | HCV | | 2159 | 16.186 | LPCEPEPDVA | 14550 | 10 | P2A |
| 33 | HCV | | 674 | 16.187 | LPCSIIILPA | 14551 | 10 | P2A |
| 34 | HCV | | 2567 | 16.168 | QPEKGGRKPA | 14552 | 10 | P2A |
| 35 | HCV | | 1356 | 16.189 | VPHPNIEEVA | 14553 | 10 | P2A |
| 36 | HIV | GAG | 360 | 16.190 | GPGHKARVLA | 14554 | 10 | P2A |
| 37 | HIV | GAG | 332 | 16.191 | NPDCKTILKA | 14555 | 10 | P2A |
| 38 | HIV | GAG | 170 | 16.192 | SPEVIPMFSA | 14556 | 10 | P2A |
| 39 | HIV | POL | 820 | 16.195 | IPAETGQETA | 14557 | 10 | P2A |
| 40 | HIV | POL | 320 | 16.196 | LPQGWKGSPA | 14558 | 10 | P2A |
| 41 | HIV | POL | 760 | 16.197 | PPVVAKEIVA | 14559 | 10 | P2A |
| 42 | MAGE2 | | 30 | 16.198 | APATEEQQTA | 14560 | 10 | P2A |
| 43 | MAGE213 | | 98 | 16.199 | FPDLESEFQA | 14561 | 10 | P2A |
| 44 | MAGE3 | | 30 | 16.200 | APATEEQEAA | 14562 | 10 | P2A |
| 45 | MAGE3 | | 170 | 16.201 | DPIGHLYIFA | 14563 | 10 | P2A |
| 46 | PAP | CSP | 348 | 16.202 | SPSCPLERFA | 14564 | 10 | P2A |
| 47 | Plasmodium | EXP-1 | 327 | 16.218 | DPNRNVDENA | 14565 | 10 | P2A |
| 48 | Plasmodium | EXP-1 | 116 | 16.243 | DPADNANPDA | 14566 | 10 | P2A |
| 49 | Plasmodium | LSA1 | 132 | 16.244 | EPNADPQVTA | 14567 | 10 | P2A |
| 50 | Plasmodium | TRAP | 1728 | 16.307 | KPEQKEDKSA | 14568 | 10 | P2A |
| 51 | Plasmodium | | 303 | 16.342 | QPRPRGDNFA | 14569 | 10 | P2A |
| 52 | PSA | | 141 | 16.343 | EPALGTTCYA | 14570 | 10 | P2A |

TABLE 35

Binding of B7-like supermotif containing peptides to B7-like supertype HLA alleles

| SEQUENCE | SEQ ID NO | SOURCE | RESTRICTION (or ORIGIN) | REFERENCE | BINDING CAPACITY (IC50 nM) B'0701 | B*3501 | B*3502 | B*3503 | B*5401 |
|---|---|---|---|---|---|---|---|---|---|
| YPAEITLTW | 3488 | B*5301 self peptide | B*5301 | 38 | 104a | 54 | 1160 | 176 | 25 |
| MPLETQLAI | 3489 | *P. talciparum* SHEBA 77-85 | B*5101, B*5301 | 38 | 54 | 28 | 1146 | 12 | 1.6 |
| LPSDFFPSV | 3490 | HBc 19-27 | | | 1323 | 298 | — | 97 | 4.6 |
| XPSDXAAEA | 3491 | B*5401 Nat. Processed | (B*5401) | | 11714 | 207 | 13364 | 136 | 8.4 |
| LPFDFTPGY | 3492 | B*3501 nat. proc. | (B*3501) | 83 | -b) | 5.6 | 1307 | 6286 | 253 |
| APRTVALTA | 3493 | B*0701 Nat. Processed | (B*0701) | 59 | 4.9 | — | — | — | 52 |
| LPGPKFLQY | 3494 | B*3501 nat. proc. | (B*3501) | 83 | — | 148 | — | — | — |
| DPKVKQWPL | 3495 | HIV pot 185-193 | B*0801 | 72 | 105 | 5636 | — | 1128 | 17813 |
| MPNDPNRNV | 3496 | *P. falciparum* cap 300-308 | B*5101, B*5301 | 38 | 3417 | — | — | — | 48 |
| APRTLVYLL | 3497 | A*0201 sig seq 5-13 analog | (B*0701) | 59 | 4.1 | — | — | — | — |
| APRTVALTAL | 3498 | B*0701 Nat. Processed | (B*0701) | 59 | 4.2 | — | — | — | 17273 |
| APRASRPSL | 3499 | B*0701 Nat. Processed | (B*0701) | 59 | 3.9 | — | — | — | — |
| YPFQPPKV | 3500 | B*5401 Nat. Processed | (B5401) | | — | — | — | 14667 | 87 |
| KPIVQYDNF | 3501 | *P. falciperum* isa 1786-1794 | B*5301 | 38 | 27333 | — | — | — | — |
| TPYDINQML | 3502 | HIV-2 | B*5301 | 38 | 2733 | 17714 | — | 1158 | 15833 |
| DPYEVSYRI | 3503 | B*5401 Nat. Processed | (B*5401) | | — | — | — | — | — |
| YPAEITLTW | 3504 | B*5301 self peptide | B*5301 | 38 | 104a | 54 | 1160 | 176 | 25 |
| MPLETQLAI | 3505 | *P. talciparum* SHEBA 77-85 | B*5101, B*5301 | 38 | 54 | 28 | 1146 | 12 | 1.6 |
| LPSDFFPSV | 3506 | HBc 19-27 | | | 1323 | 298 | — | 97 | 4.6 |
| XPSDXAAEA | 3507 | B*5401 Nat. Processed | (B*5401) | | 11714 | 207 | 13364 | 136 | 8.4 |
| LPFDFTPGY | 3508 | B*3501 nat. proc. | 03501) | 83 | -b) | 5.6 | 1307 | 6286 | 253 |
| APRTVALTA | 3.509 | B*0701 Nat. Processed | (B*0701) | 59 | 4.9 | — | — | | 52 |
| LPGPKFLQY | 3510 | B*3501 nat. proc. | (B*3501) | 83 | — | 148 | — | — | — |
| DPKVKQWPL | 3511 | HIV pol 185-193 | B*0801 | 72 | 105 | 5636 | — | 1128 | 17813 |
| MPNDPNRNV | 1512 | *P. falciparum* cap 300-308 | B*5101, B*5301 | 38 | 3417 | — | — | — | 48 |
| APRTLVYLL | 3513 | A*0201 sig seq 5-13 analog | (B*0701) | 59 | 4.1 | — | — | — | — |
| APRTVALTAL | 3514 | B*0701 Nat. Processed | (B*0701) | 59 | 4.2 | — | — | — | 17273 |
| APRASRPSL | 3515 | B*0701 Nat. Processed | (B*0701) | 59 | 3.9 | — | — | — | — |
| YPFQPPKV | 3516 | B*5401*5401 Nat. Processed | (B*5401) | | — | — | 14667 | — | 87 |
| KPIVQYDNF | 2512 | *P. falciperum* isa 1786-1794 | B*5301 | 38 | 27333 | — | — | — | — |
| TPYDINQML | 3518 | HIV-2 | B*5301 | 38 | 2733 | 17714 | — | 1158 | 15833 |
| DPYEVSYRI | 3519 | B*5401 Nat. Processed | (B*5401) | | — | — | — | — | — |

a) Shaded areas highlight binding capacity b) A dash indicates an IC50 > 30000 nM

TABLE 36

Binding of Peptides to B7-like Supermotif Alleles

| PEPTIDE | AA | SEQUENCE | SEQ ID NO | SOURCE | B*0701 (nM) | B*3501 (nM) | B*5301 (nM) | B*5401 (nM) | Alleles bound |
|---|---|---|---|---|---|---|---|---|---|
| 15.066 | 9 | FPVRPQVPL | 3520 | HIV NEF 84 | 7.1 | 2.2 | 92 | 44 | 4 |
| 15.032 | 9 | IPIPSSWAF | 3521 | HBV ENV 313 | 60 | 7.8 | 35 | 4000 | 3 |
| 15.037 | 9 | FPHCLAFSY | 3522 | HBV POL 541 | 3375 | 7.5 | 18 | 400 | 3 |
| 15.044 | 9 | LPGCSFSIF | 3523 | HCV Core 168 | 31 | 113 | 122 | 8000 | 3 |
| 15.107 | 9 | VPISHLYIL | 3524 | MAGE2 170 | 22 | 384 | 396 | 3525 | 3 |
| 15.140 | 9 | MPKAGLLII | 3525 | MAGE3 196 | 321 | — | 92 | 112 | 3 |
| 16.009 | 9 | LPVCAFSSA | 3526 | HBV X 58 | 348 | 533 | — | 2.0 | 2 |
| 15.047 | 9 | YPCTVNFTI | 3527 | HCV E2 622 | 10800 | 966 | 102 | 89 | 2 |
| 16.012 | 9 | FPYLVAYQA | 3528 | HCV 1582 | 18000 | 182 | 1706 | 1.2 | 2 |
| 15.064 | 9 | EPRIWLHJL | 3529 | HIV VPR 34 | 5.4 | 10286 | 16909 | 226 | 2 |
| 15.073 | 9 | EPISPIETV | 3530 | WV POL 171 | 3484 | 1051 | 251 | 9.8 | 2 |
| 15.134 | 9 | LPTFMNYPI | 3531 | MAGE3 71 | 71 | 46 | 802 | 3152 | 2 |
| 16.032 | 9 | APLLLARAA | 3532 | PAP 4 | 257 | — | — | 2.6 | 2 |
| 16.176 | 9 | HPQWVLTA | 3533 | PSA 52 | 225 | 1532 | — | 1.1 | 2 |
| 15.030 | 9 | IPQSLDSWW | 3534 | HBV ENV 191 | — | — | 64 | + | 1 |
| 15.033 | 9 | TPARVTGGV | 3535 | HBV POL 365 | 466 | — | — | 18909 | 1 |
| 15.034 | 9 | LPIFFCLWV | 3536 | HBV ENV 379 | — | — | 2345 | 55 | 1 |
| 15.036 | 9 | HPAAMPHLL | 3537 | HBV POL 440 | 58 | 1618 | 580 | 6118 | 1 |
| 15.038 | 9 | DPSRGRLGL | 3538 | HBV POL 789 | 45 | — | — | — | 1 |
| 16.006 | 9 | FPDHQLDPA | 3539 | HBV ENV 14 | — | 8000 | — | 13 | 1 |

TABLE 36-continued

| Binding of Peptides to B7-like Supermotif Alleles | | | | | | | | | |
|---|---|---|---|---|---|---|---|---|---|
| PEPTIDE | AA | SEQUENCE | SEQ ID NO | SOURCE | B*0701 (nM) | B*3501 (nM) | B*5301 (nM) | B*5401 (nM) | Allelles bound |
| 16.008 | 9 | YPALMPLYA | 3540 | HBV POL 640 | 524 | 1134 | 2583 | 0.80 | 1 |
| 15.039 | 9 | QPRGRRQPI | 3541 | HCV Core 57 | 24 | — | — | — | 1 |
| 15.042 | 9 | SPRGSRPSW | 3542 | HCV Core 99 | 14 | — | — | — | 1 |
| 15.043 | 9 | DPRRRSRNL | 3543 | HCV Core111 | 318 | — | — | — | 1 |
| 15.048 | 9 | LPALSTGLI | 3544 | HCV NS3 1358 | 153 | — | 1505 | 20800 | 1 |
| 15.049 | 9 | LPNLEEVAL | 3545 | HCV E2681 | 1500 | 227 | 14308 | 5333 | 1 |
| 15.054 | 9 | SPGALVVGV | 3546 | HCV NS4 1887 | — | — | 81 | — | 1 |
| 15.060 | 9 | SPGQRVEFL | 3547 | HCV NS5 2615 | 44 | — | — | — | 1 |
| 15.063 | 9 | APTLWARMI | 3548 | HCV NS5 2835 | 338 | — | — | — | 1 |
| 16.010 | 9 | APLGGAARA | 3549 | HCV 142 | 1385 | — | — | 330 | 1 |
| 16.013 | 9 | LPAILSPGA | 3550 | HCV 1882 | — | — | — | 11 | 1 |
| 16.014 | 9 | NPAIASLMA | 3551 | HCV 1783 | 5143 | — | — | 263 | 1 |
| 16.017 | 9 | TPLLYRLGA | 3552 | HCV 1621 | 656 | — | — | 45 | 1 |
| 16.019 | 9 | WPLLLLLLA | 3553 | HCV 793 | 10800 | — | 12400 | 270 | 1 |
| 15.065 | 9 | SPTRRELQV | 3554 | HIV POL 37 | 257 | — | — | — | 1 |
| 15.067 | 9 | RPQVPLRPM | 3555 | HIV NEF 87 | 3.3 | 5760 | — | — | 1 |
| 15.070 | 9 | KPCVKLTPL | 3556 | HIV ENV 123 | 13 | — | — | — | 1 |
| 15.071 | 9 | SPRTLNAWV | 3557 | HIV GAG 153 | 9.8 | — | — | 20800 | 1 |
| 15.077 | 9 | GPKVKQWP | 3558 | HIV POL 189 | 372 | — | — | — | 1 |
| 15.081 | 9 | SPAIFQSSM | 3559 | HIV POL 327 | 13 | 1920 | — | 8000 | 1 |
| 15.083 | 9 | NPDIVIYQY | 3560 | FEW POL 346 | — | 343 | — | — | 1 |
| 15.084 | 9 | GPGH1CARVL | 3561 | HIV GAG 360 | 189 | — | — | — | 1 |
| 15.088 | 9 | YPLASLRSL | 3562 | HIV GAG 507 | 5.5 | 847 | 11625 | 1944 | 1 |
| 15.095 | 9 | VPRRICAKII | 3563 | HIV POL 991 | 11 | — | — | — | 1 |
| 16.021 | 9 | NPYNTPVFA | 3564 | HIV POL 225 | — | — | — | 105 | 1 |
| 15.096 | 9 | TPTLHEYML | 3565 | HPV16 E7 5 | 51 | — | — | — | 1 |
| 15.104 | 9 | KPLNPAEKL | 3566 | HPV18 E6 10 | 154 | — | — | — | 1 |
| 15.108 | 9 | MPKTGLLII | 3567 | MAGE2 196 | 2789 | — | 172 | 597 | 1 |
| 15.113 | 9 | DPACYEFLW | 3568 | MAGE2 265 | — | — | 115 | — | 1 |
| 15.117 | 9 | EPHISYPPL | 3569 | MAGE2 296 | 50 | 8000 | — | — | 1 |
| 15.119 | 9 | YPPLHEARA | 3570 | MAGE2 301 | 20 | — | — | 5474 | 1 |
| 15.156 | 9 | GPHISYPPL | 3571 | MAGE3 296 | 6.2 | — | — | — | 1 |
| 15.175 | 9 | HPSDGKCNL | 3572 | SSP2 206 | 245 | — | 6414 | — | 1 |
| 15.178 | 9 | RPRGDNFAV | 3573 | SSP2 305 | 11 | — | — | 3506 | 1 |
| 15.182 | 9 | QPRPRGDNF | 3574 | SSP2 303 | 331 | — | — | — | 1 |
| 15.031 | 9 | CPGYRWMC | 3575 | HBV ENV 232 | 806 | — | — | — | 0 |
| 15.035 | 9 | WPKFAVPNL | 3576 | HBV POL 404 | 1009 | — | — | 7172 | 0 |
| 16.007 | 9 | PPKFAVPNL | 3577 | HBV POL 129 | — | — | — | — | 0 |
| 15.040 | 9 | QPGYPWPLY | 3578 | HCV Core 78 | — | 6545 | — | — | 0 |
| 15.041 | 9 | WPLYGNEGL | 3579 | HCV Core 83 | 859 | — | 6889 | — | 0 |
| 15.045 | 9 | IPQAVVDMV | 3580 | HCV E1 339 | 13500 | — | — | 8667 | 0 |
| 15.046 | 9 | SPWLTPRCM | 3581 | HCV E2 600 | 651 | — | — | — | 0 |
| 15.051 | 9 | APPPSWDQM | 3582 | HCV NS3 1598 | 1929 | — | — | — | 0 |
| 15.052 | 9 | PPPSWDQM | 3583 | HCV NS3 1599 | — | — | — | — | 0 |
| 15.053 | 9 | SPTPLLYRL | 3584 | HCV NS3 1619 | 2298 | — | — | — | 0 |
| 15.055 | 9 | GPGEGAVQ | 3585 | HCV NS4 1906 | — | — | — | — | 0 |
| 15.056 | 9 | LPCEPEPDV | 3586 | HCV NS5 2159 | — | — | — | — | 0 |
| 15.057 | 9 | EPEPDVAVL | 3587 | HCV NS5 2162 | — | — | — | — | 0 |
| 15.058 | 9 | DPDLSDGSW | 3588 | HCV NS5 2396 | — | — | 18600 | — | 0 |
| 15.059 | 9 | PPHSALSKF | 3589 | HCV NS5 2512 | — | — | — | — | 0 |
| 15.061 | 9 | DPPQPEYDL | 3590 | HCV NS5 2771 | — | — | — | — | 0 |
| 15.062 | 9 | WPEYDLELI | 3591 | HCV NS5 2774 | — | — | — | — | 0 |
| 16.011 | 9 | DPTTPLARA | 3592 | HCV 2806 | — | — | — | 800 | 0 |
| 16.015 | 9 | SPGEINRVA | 3593 | HCV 2897 | 18000 | — | — | 2811 | 0 |
| 16.018 | 9 | TPTLAARNA | 3594 | HCV 242 | — | — | — | 5778 | 0 |
| 15.068 | 9 | DPDLADQLI | 3595 | IIIV VIE 99 | — | — | — | — | 0 |
| 15.069 | 9 | LPGRWKPK | 3596 | HIV POL 110 | 1440 | — | — | — | 0 |
| 15.072 | 9 | PPLPSVJKL | 3597 | HIV VIF 161 | — | — | — | — | 0 |
| 15.074 | 9 | VPVKLKPGM | 3598 | HIV POL 179 | 18000 | — | — | 1664 | 0 |
| 15.075 | 9 | KPGMDGPK | 3599 | HIV POL 184 | — | — | — | — | 0 |
| 15.076 | 9 | TPQDLNTML | 3600 | HIV GAG 185 | 7200 | — | — | — | 0 |
| 15.078 | 9 | NPPIPVGEI | 3601 | HIV GAG 258 | — | — | — | — | 0 |
| 15.079 | 9 | PPIPVGEIV | 3602 | HIV GAG 259 | — | — | — | — | 0 |
| 15.080 | 9 | GPICEPERDV | 3603 | HIV GAG 293 | — | — | — | — | 0 |
| 15.082 | 9 | GPAATLEEM | 3604 | HIV GAG 343 | 3857 | — | — | — | 0 |
| 15.085 | 9 | EPPFLWMGY | 3605 | HIV POL 395 | — | — | — | — | 0 |
| 15.086 | 9 | DPEIVMHSF | 3606 | HIV ENV 404 | — | — | — | — | 0 |
| 15.087 | 9 | LPEICDSwTv | 3607 | HIV POL 417 | — | — | — | 895 | 0 |
| 15.089 | 9 | APTKALRRV | 3608 | HIV ENV 547 | 659 | — | — | — | 0 |
| 15.090 | 9 | TPPLVKLWV | 3609 | HIV POL 590 | — | 2667 | — | 4822 | 0 |
| 15.091 | 9 | EPIVGAETF | 3610 | HIV POL 603 | — | 2182 | 4769 | — | 0 |
| 15.092 | 9 | QPDKSESEL | 3611 | HIV POL 680 | 9000 | — | — | — | 0 |
| 15.093 | 9 | LPPVVAKEI | 3612 | HIV POL 759 | 9818 | — | — | — | 0 |
| 15.094 | 9 | PPVVAKEIV | 3613 | HIV POL 760 | — | — | — | — | 0 |
| 16.020 | 9 | EPAADGVGA | 3614 | HIV NEF 38 | — | — | — | 13000 | 0 |

TABLE 36-continued

Binding of Peptides to B7-like Supermotif Alleles

| PEPTIDE | AA | SEQUENCE | SEQ ID NO | SOURCE | B*0701 (nM) | B*3501 (nM) | B*5301 (nM) | B*5401 (nM) | Allelles bound |
|---|---|---|---|---|---|---|---|---|---|
| 15.099 | 9 | DPQERPRKL | 3615 | HPV16 E611 | — | — | — | — | 0 |
| 15.100 | 9 | EPDRAHYNI | 3616 | HPV16 E7 46 | — | — | 5636 | — | 0 |
| 15.101 | 9 | CPEEKQRHL | 3617 | HPV I6 E6 118 | 18000 | — | 15500 | — | 0 |
| 15.102 | 9 | GPKATLQDI | 3618 | HPV16 E7 3 | 13500 | — | — | — | 0 |
| 15.103 | 9 | DPTRRPYKL | 3619 | HPV18 E6 6 | — | — | — | — | 0 |
| 15.105 | 9 | NPAEKLRHL | 3620 | HPV 18 E6 113 | 509 | — | — | — | 0 |
| 16.022 | 9 | SPPHSPQGA | 3621 | MAGE2 60 | — | — | — | 3059 | 0 |
| 15.120 | 9 | EPVTKAEML | 3622 | MAGE2/3 128 | — | — | — | — | 0 |
| 15.121 | 9 | VPGSDPACY | 3623 | MAGE2/3 261 | — | — | — | — | 0 |
| 15.138 | 9 | DPIGHLYIF | 3624 | MAGE3 170 | — | 626 | 2548 | — | 0 |
| 15.157 | 9 | YPPLHEWVL | 3625 | MAGE3 301 | 2038 | 947 | 3957 | 4522 | 0 |
| 16.024 | 9 | DPPQSPQGA | 3626 | MAGE3 60 | — | — | — | 7704 | 0 |
| 15.173 | 9 | MPNDPNRN | 3627 | CSP 293 | — | — | — | 612 | 0 |
| 15.174 | 9 | IPDSIQDSL | 3628 | SSP2 164 | 2455 | — | — | — | 0 |
| 15.176 | 9 | GPFMKAVC | 3629 | SSP2 228 | 2314 | — | — | — | 0 |
| 15.177 | 9 | LPKREPLDV | 3630 | SSP2 287 | 8308 | — | — | — | 0 |
| 15.179 | 9 | PPNPPNPDI | 3631 | SSP2 364 | — | — | — | — | 0 |
| 15.180 | 9 | IPEDSEKEV | 3632 | SSP2 379 | — | — | — | — | 0 |
| 15.181 | 9 | EPAPFDETL | 3633 | SSP2 544 | — | 2939 | 1625 | — | 0 |
| 15.183 | 9 | LPNDKSDRY | 3634 | SSP2 419 | — | 533 | 2214 | — | 0 |
| 15.184 | 9 | LPSENERGY | 3635 | LSAI 1663 | — | 2038 | — | — | 0 |
| 15.185 | 9 | KPIVQYDNF | 3636 | LSAI 1786 | — | 10800 | 2036 | — | 0 |
| 16.071 | 9 | DPQVTAQDV | 3637 | P. falciparum EXP | — | — | — | — | 0 |
| 16.072 | 9 | EPLIDVHDL | 3638 | P. falciparum EXP | — | — | — | — | 0 |
| 16.073 | 9 | QPQGDDNNL | 3639 | P.f alciparum EXP | — | — | — | — | 0 |
| 16.175 | 9 | VPGAATPYA | 3640 | P. falciparum | — | — | — | 5778 | 0 |
| 15.217 | 10 | FPHCLAFSY | 3641 | HBV POL 541 | 99 | 119 | 380 | 671 | 3 |
| 15.268 | 10 | YPLASLRSLF | 3642 | HIV GAG 507 | 400 | 480 | 150 | 759 | 3 |
| 15.350 | 10 | TPYAGEPAP | 3643 | SSP2 539 | 55 | 76 | 420 | 4674 | 3 |
| 15.214 | 10 | TPARVTGGV | 3644 | HBV POL 365 | 75 | 294 | — | — | 2 |
| 15.225 | 10 | YPCTVNFTIF | 3645 | HCV E2 622 | 1521 | 399 | 257 | 315 | 2 |
| 16.185 | 10 | IPQAVVDMV | 3646 | HCV 339 | 7043 | 300 | — | 5.7 | 2 |
| 16.187 | 10 | LPCSFTTLPA | 3647 | HCV 674 | 422 | 24000 | — | 16 | 2 |
| 16.196 | 10 | LPQGWKGSP | 3648 | HIV POL 320 | 450 | — | — | 18 | 2 |
| 15.210 | 10 | LPLDKGIKPY | 3649 | HBV POL 123 | — | 548 | — | — | 1 |
| 16.177 | 10 | IPIPSSWAFA | 3650 | HBV ENV 313 | 4154 | 3064 | 6643 | 23 | 1 |
| 16.180 | 10 | APFTQCGYP | 3651 | HBV POL 633 | 1895 | — | — | 7.7 | 1 |
| 16.181 | 10 | LPIHTAELLA | 3652 | HBV POL 712 | 3086 | 6857 | 5813 | 32 | 1 |
| 16.182 | 10 | GPCALRFTS | 3653 | HBV X 67 | 60 | — | — | 3000 | 1 |
| 15.218 | 10 | LPRRGPRLG | 3654 | HCV Core 37 | 28 | — | — | 4160 | 1 |
| 15.219 | 10 | APLGGAARA | 3655 | HCV Core 142 | 9.4 | — | — | 13867 | 1 |
| 15.223 | 10 | VPASQVCGP | 3656 | HCV E2 497 | 500 | — | — | 5200 | 1 |
| 15.226 | 10 | SPLLLSTTEQ | 3657 | HCV E2 663 | 21600 | — | 55 | 10400 | 1 |
| 15.231 | 10 | RPSGMFDSS | 3658 | HCV NS3 1506 | 149 | — | — | — | 1 |
| 15.234 | 10 | KPTLHGPTP | 3659 | HCV NS3 1614 | 3.8 | — | — | — | 1 |
| 15.235 | 10 | TPLLYRLGA | 3660 | HCV NS3 1621 | 450 | — | — | 940 | 1 |
| 15.237 | 10 | NPAIASLMA | 3661 | HCV NS4 1783 | 393 | 9000 | — | — | 1 |
| 15.238 | 10 | LPAILSPGAL | 3662 | HCV NS4 1882 | 1019 | — | — | 50 | 1 |
| 15.239 | 10 | SPGALVVGV | 3663 | HCV NS4 1887 | 415 | — | — | — | 1 |
| 15.247 | 10 | APTLWARMI | 3664 | HCV NS5 2835 | 6.1 | — | — | — | 1 |
| 16.189 | 10 | VPHPNIEEVA | 3665 | HCV 1356 | — | — | — | 36 | 1 |
| 15.257 | 10 | IPVGEIYKR | 3666 | HIV GAG 261 | — | — | 175 | — | 1 |
| 15.269 | 10 | APTKAKRRV | 3667 | HIV ENV 547 | 44 | — | — | — | 1 |
| 15.282 | 10 | VPISI-ILYILV | 3668 | MAGE2 170 | 2000 | — | 5580 | 100 | 1 |
| 15.283 | 10 | MPKTGLLIIV | 3669 | MAGE2 196 | 18000 | 24000 | — | 170 | 1 |
| 15.285 | 10 | HPRKLLMQD | 3670 | MAGE2 241 | 137 | — | — | — | 1 |
| 16.199 | 10 | FPDLESEFQA | 3671 | MAGE2/3 98 | — | 5760 | — | 297 | 1 |
| 15.307 | 10 | LPTTMNYPL | 3672 | MAGE3 71 | — | 12000 | 174 | 2950 | 1 |
| 15.311 | 10 | MPKAGLLIIV | 3673 | MAGE3 196 | 1770 | — | 14308 | 12 | 1 |
| 16.201 | 10 | DPIGHLYIFA | 3674 | MAGE3 170 | — | — | 20667 | 359 | 1 |
| 15.208 | 10 | GPLEEELPRL | 3675 | HBV POL 19 | — | — | — | — | 0 |
| 15.209 | 10 | IPQTHKVGN | 3676 | HBV POL 50 | 4050 | — | — | — | 0 |
| 15.211 | 10 | PPNAPILSTL | 3677 | HBV CORE 134 | — | — | — | — | 0 |
| 15.212 | 10 | GPLLVLQAG | 3678 | HBV ENV 173 | — | — | — | — | 0 |
| 15.213 | 10 | VPFVQWFVG | 3679 | HBV ENV 340 | 5143 | — | — | 4245 | 0 |
| 15.215 | 10 | LPIFFCLWVY | 3680 | HBV ENV 379 | — | 917 | 16412 | — | 0 |
| 15.216 | 10 | VPNLQSLTN | 3681 | HBV POL 409 | 9000 | — | — | — | 0 |
| 16.178 | 10 | SPITIHTALRQ | 3682 | HBV NUC 49 | 4500 | — | — | 3000 | 0 |
| 16.179 | 10 | TPPAYRPPN | 3683 | HBV NUC 128 | — | — | — | 997 | 0 |
| 15.220 | 10 | LPGCSFSIFL | 3684 | HCV Core 168 | 2512 | 8000 | 686 | 8432 | 0 |
| 15.221 | 10 | IPTITIRRHV | 3685 | HCV E1 252 | 9818 | — | — | — | 0 |
| 15.222 | 10 | YPGHVSGHR | 3686 | HCV E1 308 | 1301 | 3927 | — | — | 0 |
| 15.224 | 10 | GPQLTPRCM | 3687 | HCV E2 600 | — | — | — | — | 0 |
| 15.227 | 10 | WPLLLLLLA | 3688 | HCV E2 793 | 1333 | — | 2620 | 2849 | 0 |
| 15.228 | 10 | TPCTCGSSD | 3689 | HCV NS3 1120 | 10800 | — | — | — | 0 |

TABLE 36-continued

| Binding of Peptides to B7-like Supermotif Alleles | | | | | | | | | | |
|---|---|---|---|---|---|---|---|---|---|---|
| PEPTIDE | AA | SEQUENCE | SEQ ID NO | SOURCE | B*0701 (nM) | B*3501 (nM) | B*5301 (nM) | B*5401 (nM) | Allelles bound |
| 15.229 | 10 | VPAAYAAQ | 3690 | HCV NS3 1239 | — | 9600 | — | — | 0 |
| 15.230 | 10 | NPSVAATLG | 3691 | HCV NS3 1254 | — | — | — | — | 0 |
| 15.232 | 10 | LPVCQDHLE | 3692 | HCV NS3 1547 | — | 1565 | 827 | — | 0 |
| 15.233 | 10 | APPPSWDQM | 3693 | HCV NS3 1598 | — | — | 15500 | — | 0 |
| 15.236 | 10 | LPGNPAIASL | 3694 | HCV NS4 1780 | 752 | 4364 | — | 2311 | 0 |
| 15.240 | 10 | GPGEGAVQ | 3695 | HCV NS4 1906 | — | — | — | — | 0 |
| 15.241 | 10 | VPESDAAAR | 3696 | HCV NS4 1934 | — | — | — | — | 0 |
| 15.242 | 10 | EPDVAVLTS | 3697 | HCV NS5 2164 | 3375 | 1694 | — | — | 0 |
| 15.243 | 10 | SPGQRVEFL | 3698 | HCV NS5 2615 | 18000 | — | — | — | 0 |
| 15.244 | 10 | PPGDPPQPE | 3699 | HCV NS5 2768 | — | — | — | — | 0 |
| 15.245 | 10 | PPQPEYDLE | 3700 | HCV NS5 2772 | — | — | — | — | 0 |
| 15.246 | 10 | TPVNSQLGNI | 3701 | HCV NS5 2822 | — | — | 16909 | — | 0 |
| 16.183 | 10 | DPSHITAETA | 3702 | HCV 2181 | 2348 | — | — | 2600 | 0 |
| 16.184 | 10 | DPTTPLARA | 3703 | HCV 2806 | — | — | 20667 | 800 | 0 |
| 16.186 | 10 | LPCEPEPDV | 3704 | HCV 2159 | — | — | — | 5474 | 0 |
| 16.188 | 10 | QPEKGGRKP | 3705 | HCV 2567 | 4909 | — | — | 547 | 0 |
| 15.248 | 10 | EPVDPRLEP | 3706 | HIV TAT 2 | — | — | 1603 | — | 0 |
| 15.249 | 10 | SPTRRELQV | 3707 | HIV POL 37 | 2189 | — | 10941 | — | 0 |
| 15.250 | 10 | LPGRWKPK | 3708 | HIV POL 110 | — | — | — | — | 0 |
| 15.251 | 10 | TPVNIIGRNL | 3709 | HIV POL | 152 | 18000 | — | — | 0 |
| 15.252 | 10 | KPPLPSVJKL | 3710 | HIV VIF 160 | 3176 | — | — | — | 0 |
| 15.253 | 10 | SPIETVPVKL | 3711 | HIV POL 174 | 1964 | — | — | — | 0 |
| 15.254 | 10 | GPENPYNTP | 3712 | HIV POL 222 | — | — | — | — | 0 |
| 15.255 | 10 | NPYNTPVFAI | 3713 | HIV POL 225 | 1612 | — | — | 6603 | 0 |
| 15.256 | 10 | NPPIPVGEIY | 3714 | HIV GAG 258 | — | — | — | — | 0 |
| 15.258 | 10 | VPLDKDFRK | 3715 | HIV POL 289 | — | 16000 | — | — | 0 |
| 15.259 | 10 | GPKEPFRDY | 3716 | HIV GAG 293 | — | — | — | — | 0 |
| 15.260 | 10 | EPFRDYVDR | 3717 | HIV GAG 296 | — | — | — | — | 0 |
| 15.261 | 10 | TPG1RYQYN | 3718 | HIV POL 310 | 13500 | — | — | — | 0 |
| 15.262 | 10 | EPFRKQNPDI | 3719 | HIV POL 340 | — | — | — | — | 0 |
| 15.263 | 10 | GPAATLEEM | 3720 | HIV GAG 343 | 2700 | — | — | — | 0 |
| 15.264 | 10 | NPDIVIYQY | 3721 | HIV POL 348 | 10800 | 2057 | 7750 | 10400 | 0 |
| 15.265 | 10 | PPFLWMGYE | 3722 | HIV POL 396 | — | — | — | — | 0 |
| 15.266 | 10 | HPDKWTVW | 3723 | HIV POL 406 | 4500 | — | — | — | 0 |
| 15.267 | 10 | EPTAPPEESF | 3724 | HIV GAG 473 | — | — | — | — | 0 |
| 15.270 | 10 | PPLVKLWYQ | 3725 | HIV POL 591 | — | — | — | — | 0 |
| 15.271 | 10 | EPIVGAETFY | 3726 | HIV POL 603 | — | 9000 | — | — | 0 |
| 15.272 | 10 | QPDKSESEL | 3727 | HIV POL 680 | — | — | — | — | 0 |
| 15.273 | 10 | LPPVVAKEIV | 3728 | HIV POL 759 | — | — | — | — | 0 |
| 15.274 | 10 | EPYNPQDQG | 3729 | HIV POL 872 | 2400 | — | — | 1841 | 0 |
| 15.275 | 10 | DPLWKGPA | 3730 | HIV POL 963 | — | — | — | — | 0 |
| 16.190 | 10 | GPGHKARVL | 3731 | HIV GAG 360 | — | — | — | 3059 | 0 |
| 16.191 | 10 | NPDCKTILK | 3732 | HIV GAG 332 | — | — | — | — | 0 |
| 16.192 | 10 | SPEVIPMFSA | 3733 | HIV GAG 170 | — | — | — | 5622 | 0 |
| 16.195 | 10 | IPAETGQETA | 3734 | HIV POL 820 | — | — | — | 594 | 0 |
| 16.197 | 10 | PPVVAKEIV | 3735 | HIV POL 760 | — | — | — | — | 0 |
| 15.276 | 10 | EPDRAHYNI | 3736 | HPV16 E7 46 | — | — | — | — | 0 |
| 15.277 | 10 | NPYAVCDKC | 3737 | HPV16 E6 65 | — | — | — | — | 0 |
| 15.278 | 10 | GPKATLQDI | 3738 | HPV16 E7 3 | — | — | — | — | 0 |
| 15.279 | 10 | EPQNEIPVDL | 3739 | HPV18 E7 16 | — | 16000 | — | — | 0 |
| 15.280 | 10 | EPQRHTMLC | 3740 | HPV16 E7 55 | 2077 | — | 2146 | — | 0 |
| 15.281 | 10 | IPHAACHKCI | 3741 | HPV18 E6 60 | 831 | — | — | 20800 | 0 |
| 15.288 | 10 | GPRALIETSY | 3742 | MAGE2 274 | 6750 | 24000 | — | — | 0 |
| 16.198 | 10 | APATEEQQT | 3743 | MAGE2 301 | — | — | — | — | 0 |
| 15.294 | 10 | APEEKIWEE | 3744 | MAGE2/3 216 | — | — | — | — | 0 |
| 15.317 | 10 | DPKKLLTQH | 3745 | MAGE3 241 | — | — | — | — | 0 |
| 15.321 | 10 | GPRALVETS | 3746 | MAGE3 274 | — | — | — | — | 0 |
| 16.200 | 10 | APATEEQEA | 3747 | MAGE3 301 | — | — | — | — | 0 |
| 15.343 | 10 | NPDPNANPN | 3748 | CSP 101 | — | — | — | — | 0 |
| 15.344 | 10 | EPSDKIIIKEY | 3749 | CSP 318 | — | — | — | — | 0 |
| 15.345 | 10 | NPPNPPNPDI | 3750 | SSP2 363 | — | — | — | — | 0 |
| 15.346 | 10 | LPNDKSDRY | 3751 | SSP2 419 | 3857 | — | 18600 | — | 0 |
| 15.347 | 10 | IPYSPLSPKV | 3752 | SSP2 428 | 15429 | — | — | 723 | 0 |
| 15.348 | 10 | HPSDGKCNL | 3753 | SSP2 206 | — | 3592 | 6909 | — | 0 |

TABLE 36-continued

| Binding of Peptides to B7-like Supermotif Alleles | | | | | | | | | |
|---|---|---|---|---|---|---|---|---|---|
| PEPTIDE | AA | SEQUENCE | SEQ ID NO | SOURCE | B*0701 (nM) | B*3501 (nM) | B*5301 (nM) | B*5401 (nM) | Allelles bound |
| 15.349 | 10 | NPEDDREEN | 3754 | SSP2 394 | — | — | — | — | 0 |
| 15.351 | 10 | LPSENERGY | 3755 | LSA1 1663 | — | 5538 | — | — | 0 |
| 16.218 | 10 | DPNRNVDEN | 3756 | P. falciparum CSP | — | — | — | — | 0 |
| 16.241 | 10 | EPLIDVHDLI | 3757 | P. falciparum EXP | — | — | — | — | 0 |
| 16.242 | 10 | QPQGDDNNL | 3758 | P. falciparum EXP | — | — | — | — | 0 |
| 16.243 | 10 | DPADNANPD | 3759 | P. falciparum EXP | — | — | — | — | 0 |
| 16.244 | 10 | PNADPQVTA | 3760 | P. falciparum EXP | — | — | — | — | 0 |
| 16.307 | 10 | PEQKEDKSA | 3761 | P. falciparum | — | — | — | — | 0 |
| 16.342 | 10 | QPRPRGDNF | 3762 | P. falciparum | 6000 | — | — | 12235 | 0 |
| 16.202 | 10 | SPSCPLERFA | 3763 | PAP 348 | — | — | — | 2447 | 0 |
| 16.343 | 10 | EPALGTTCY | 3764 | PSA 141 | — | — | — | 4522 | 0 |

TABLE 37

| Improved prediction of B7-like supermotif cross-reactive peptides | | |
|---|---|---|
| Selection Criteria | No. of Cross-reactive Peptides Predicted ≥2 alleles bound | Fraction of Cross-reactive Peptides Predicted ≥2 alleles bound |
| none observed | 14/24 (11%) | 14/14 (100%) |
| no negative residues present | 13/54 (24%) | 13/14 (93%) |
| no negative residues present at least one preferred residue present | 12/25 (48%) | 12/14 (86%) |

TABLE 38

| Phenotypic frequencies of A2-supertype alleles in four major ethnic groups | | | | | |
|---|---|---|---|---|---|
| | Phenotypic frequency[a] | | | | |
| Allele | Blacks | Caucasians | Orientals | Hispanics | Average |
| A*0201 | **22.3** | **45.6** | **18.1** | **37.1** | **30.8** |
| A*6802 | **12.7** | 1.8 | 0.0 | 4.2 | 4.7 |

TABLE 38-continued

| Phenotypic frequencies of A2-supertype alleles in four major ethnic groups | | | | | |
|---|---|---|---|---|---|
| | Phenotypic frequency[a] | | | | |
| Allele | Blacks | Caucasians | Orientals | Hispanics | Average |
| A*0206 | 0.0 | 0.4 | **9.3** | **6.3** | 4.0 |
| A*0207 | 0.0 | 0.0 | **11.0** | 0.0 | 2.7 |
| A*0205 | **5.2** | 1.8 | 0.3 | 3.0 | 2.5 |
| A*0203 | 0.0 | 0.0 | **8.8** | 0.0 | 2.2 |
| A*0202 | **6.4** | 0.0 | 0.5 | 1.3 | 2.0 |
| A*6901 | 0.0 | 0.7 | 0.3 | 1.3 | 0.6 |
| A*0211 | 0.0 | 0.0 | 0.0 | 1.3 | 0.3 |
| A*0212 | 0.0 | 0.0 | 0.3 | 0.8 | 0.3 |
| A*0213 | 0.0 | 0.0 | 0.0 | 0.4 | 0.1 |
| A*0214 | 0.0 | 0.0 | 0.0 | 0.0 | 0.0 |
| Total | 43.1 | 48.2 | 45.0 | 51.9 | 47.1 |

[a]Phenotypic frequencies were calculated from unpublished data provided by M. Fernandez-Vina and D. Mann.

Frequencies greater than 5% are indicated by bold font.

TABLE 39

| HCV NS3 590 | | | | | | | |
|---|---|---|---|---|---|---|---|
| Sequence | SEQ ID NO | Relative binding capacity | | | | | |
| 123456789 | | A*0201 | A*0202 | A*0203 | A*0205 | A*0206 | A*6802 |
| YLVAYQATV | 3765 | 1.0[a] | 1.0 | 1.0 | 1.0 | 1.0 | 1.0 |
| KLVAYQATV | 3766 | 0.40 | 0.050 | 0.31 | 0.19 | 0.29 | - |
| YKVAYQATV | 3767 | -[b] | - | - | - | - | - |
| YLKAYQATV | 3768 | 0.53 | 0.093 | 0.60 | 0.63 | 0.064 | 0.022 |
| YLVKYQATV | 3769 | 0.36 | 0.19 | 0.44 | 1.0 | 0.41 | 0.17 |
| YLVAKQATV | 3770 | 0.17 | 0.026 | 0.30 | 0.23 | 0.16 | - |
| YLVAYKATV | 3771 | 0.54 | 0.033 | 0.27 | 0.24 | 0.10 | 0.060 |
| YLVAYQKTV | 3772 | 0.054 | 0.016 | 0.32 | 0.14 | 0.065 | 0.043 |
| YLVAYQAKV | 3773 | 0.24 | 0.13 | 0.37 | 0.79 | 0.14 | 0.13 |
| YLVAYQATK | 3774 | - | - | - | - | - | - |

[a]Binding capacities are expressed as ratios relative to the parent peptide. Peptides whose binding capacities are within 10-fold of the best binder are highlighted by shading, and are considered preferred; those whose relative binding capacities are 10-100-fold less than the best binder are considered tolerated.

[b]A dash ("-") indicates relative binding <0.01.

TABLE 40

| HBV core 18 F6 >Y | | | | | | | | |
|---|---|---|---|---|---|---|---|---|
| Sequence | SEQ ID NO | Relative binding capacity | | | | | | |
| 1234567890 | | A*0201 | A*0202 | A*0203 | A*0205 | A*0206 | A*0207 | A*6802 |
| FLPSDYFPSV | 3775 | 1.0[a] | 1.0 | 1.0 | 1.0 | 1.0 | 1.0 | 1.0 |
| KLPSDYFPSV | 3776 | 0.43 | 0.75 | 0.72 | 0.36 | 1.7 | 0.24 | - |
| FKPSDYFPSV | 3777 | -[b] | - | - | - | - | - | - |
| FLKSDYFPSV | 3778 | 0.44 | 0.39 | 1.3 | 0.27 | 0.17 | - | 0.22 |
| FLPKDYFPSV | 3779 | 0.95 | 0.82 | 3.4 | 0.61 | 1.3 | 1.3 | 0.43 |
| FLPSKYFPSV | 3780 | 0.60 | 0.75 | 1.2 | 0.60 | 0.76 | 0.85 | 0.77 |
| FLPSDKFPSV | 3781 | 0.58 | 0.70 | 6.8 | 0.40 | 0.39 | 1.8 | 1.6 |
| FLPSDYKPSV | 3782 | - | - | 0.079 | - | - | 0.027 | - |
| FLPSDYFKSV | 3783 | 0.25 | 0.22 | 6.1 | 0.076 | 0.29 | 0.25 | 0.092 |
| FLPSDYFPKV | 3784 | 0.14 | 0.18 | 0.21 | 0.18 | 0.25 | 0.14 | 0.42 |
| FLPSDYFPSK | 3785 | - | - | - | - | - | - | - |

[a]Binding capacities are expressed as ratios relative to the parent peptide. Peptides whose binding capacities are within 10-fold of the best binder are highlighted by shading, and are considered preferred; those whose relative binding capacities are 10-100-fold less than the best binder are considered tolerated.
[b]A dash ("-") indicates relative binding <0.01.

TABLE 41

HCV NS3 590

| Relative binding capacity | | | | | | |
|---|---|---|---|---|---|---|
| Residue | A*0201 | A*0202 | A*0203 | A*0205 | A*0206 | A*6802 |
| V | 0.28 | 0.28 | 0.23 | 0.36 | 0.53 | 0.69 |
| T | 0.58 | 0.24 | 0.11 | 0.34 | 0.74 | 1.0 |
| L | 1.0[a] | 1.0 | 1.0 | 0.19 | 1.0 | 0.029 |
| I | 0.49 | 0.24 | 0.64 | 0.24 | 0.81 | 0.045 |
| Q | 0.91 | 0.55 | 0.46 | 1.0 | 0.57 | - |
| P | - | - | - | - | - | - |
| K | - | - | - | - | - | - |
| F | 0.016 | - | 0.012 | - | - | - |
| D | - | - | - | - | - | - |

[a]Binding capacities are expressed as ratios relative to the related analog with the highest binding affinity for each individual molecule. Peptides whose relative binding capacities are in the 1-0.1 range are highlighted by shading, and are considered preferred; those whose relative binding capacities are in the 0.1-0.01 range are considered tolerated.
A dash ("-") indicates relative binding <0.01.

TABLE 42

HBV core 18 $F_6$ >Y

| Relative binding capacity | | | | | | | |
|---|---|---|---|---|---|---|---|
| Residue | A*0201 | A*0202 | A*0203 | A*0205 | A*0206 | A*0207 | A*6802 |
| I | 0.18 | 0.66 | 0.41 | 0.82 | 1.0 | 0.31 | 0.53 |
| L | 1.0[a] | 0.46 | 1.0 | 0.79 | 0.36 | 1.0 | 0.088 |
| V | 0.065 | 1.0 | 0.10 | 1.0 | 0.60 | 0.10 | 0.91 |
| T | 0.013 | 0.35 | 0.025 | 0.25 | 0.11 | - | 1.0 |
| Q | 0.26 | 0.049 | 0.49 | 0.074 | 0.15 | 0.053 | - |
| F | - | - | 0.015 | - | - | - | 0.046 |
| D | - | - | - | - | - | - | - |
| K | - | - | - | - | - | - | - |
| P | - | - | - | - | - | - | - |

[a]Binding capacities are expressed as ratios relative to the related analog with the highest binding affinity for each individual molecule. Peptides whose relative binding capacities are in the 1-0.1 range are highlighted by shading, and are considered preferred; those whose relative binding capacities are in the 0.1-0.01 range are considered tolerated.
A dash ("-") indicates relative binding <0.01.

TABLE 43

Poly-alanine peptide ALAKAAAAV (SEQ ID NO: 3786)

Relative binding capacity

| Residue | A*0201 | A*0202 | A*0203 | A*0205 | A*0206 | A*6802 |
|---|---|---|---|---|---|---|
| L | 1.0[a] | 0.92 | 0.22 | 0.77 | 0.49 | 0.011 |
| M | 0.43 | 0.73 | 0.70 | 0.43 | 0.51 | 0.010 |
| V | 0.051 | 1.0 | 0.40 | 1.0 | 1.0 | 0.68 |
| I | 0.063 | 0.56 | 1.0 | 0.16 | 0.44 | 0.073 |
| T | 0.025 | 0.75 | 0.091 | 0.20 | 0.35 | 1.0 |
| A | 0.013 | 0.26 | 0.070 | 0.089 | 0.075 | 0.31 |
| S | - | 0.12 | 0.023 | 0.011 | 0.025 | 0.057 |
| G | - | 0.031 | 0.011 | - | 0.017 | - |
| P | - | - | - | - | - | 0.016 |
| C | - | - | - | - | - | - |
| D | - | - | - | - | - | - |
| F | - | - | - | - | - | - |
| K | - | - | - | - | - | - |
| N | - | - | - | - | - | - |

[a]Binding capacities are expressed as ratios relative to the related analog with the highest binding affinity for each individual molecule. Peptides whose relative binding capacities are in the 1-0.1 range are highlighted by shading, and are considered preferred; those whose relative binding capacities are in the 0.1-0.01 range are considered tolerated.

A dash ("-") indicates relative binding <0.01.

TABLE 44

Summary
Allele/Peptide combinations[b]

| Residue | Tested | Preferred | Tolerated | % preferred | % tolerated or preferred |
|---|---|---|---|---|---|
| V | 19 | 17 | 2 | 89.5 | 100.0 |
| L | 19 | 16 | 3 | 84.2 | 100.0 |
| I | 19 | 16 | 3 | 84.2 | 100.0 |
| M | 6 | 5 | 1 | 83.3 | 100.0 |
| T | 19 | 14 | 4 | 73.7 | 94.7 |
| A | 6 | 2 | 4 | 33.3 | 100.0 |
| Q | 13 | 8 | 3 | 61.5 | 84.6 |

TABLE 44-continued

Summary
Allele/Peptide combinations[b]

| Residue | Tested | Preferred | Tolerated | % preferred | % tolerated or preferred |
|---|---|---|---|---|---|
| S | 6 | 1 | 4 | 16.7 | 83.3 |
| G | 6 | 0 | 3 | 0.0 | 50.0 |
| F | 19 | 0 | 4 | 0.0 | 21.1 |
| P | 19 | 0 | 1 | 0.0 | 5.3 |
| C | 6 | 0 | 0 | 0.0 | 0.0 |
| K | 19 | 0 | 0 | 0.0 | 0.0 |
| N | 6 | 0 | 0 | 0.0 | 0.0 |
| D | 19 | 0 | 0 | 0.0 | 0.0 |

[b]indicates the number of instances in which a given residue was associated with relative binding in the 1-0.1 range (preferred) or 0.1-0.01 range (tolerated).

TABLE 45

HCV NS3 590

Relative binding capacity

| Residue | A*0201 | A*0202 | A*0203 | A*0205 | A*0206 | A*6802 |
|---|---|---|---|---|---|---|
| V | 1.0[a] | 0.83 | 1.0 | 0.51 | 1.0 | 1.0 |
| I | 0.22 | 0.14 | 0.60 | 0.30 | 0.17 | 0.075 |
| L | 0.95 | 1.0 | 0.72 | 1.0 | 0.38 | 0.062 |
| T | 0.16 | 0.012 | 0.11 | 0.017 | 0.034 | - |
| F | 0.066 | - | 0.044 | - | - | - |
| D | - | - | - | - | - | - |
| K | - | - | - | - | - | - |
| P | - | - | - | - | - | - |
| Q | - | - | - | - | - | - |

[a]Binding capacities are expressed as ratios relative to the related analog with the highest binding affinity for each individual molecule. Peptides whose relative binding capacities are in the 1-0.1 range are highlighted by shading, and are considered preferred; those whose relative binding capacities are in the 0.1-0.01 range are considered tolerated.
A dash ("-") indicates relative binding <0.01.

TABLE 46

HBV core 18 $F_6$ >Y

Relative binding capacity

| Residue | A*0201 | A*0202 | A*0203 | A*0205 | A*0206 | A*0207 | A*6802 |
|---|---|---|---|---|---|---|---|
| I | 0.21 | 0.70 | 0.15 | 0.19 | 0.26 | 0.15 | 0.39 |
| V | 1.0[a] | 1.0 | 1.0 | 1.0 | 1.0 | 1.0 | 1.0 |
| L | 0.18 | 0.43 | 0.23 | 0.26 | 0.077 | 0.23 | 0.087 |
| T | 0.033 | 0.045 | 0.027 | 0.022 | 0.10 | 0.027 | - |
| P | 0.023 | - | - | - | 0.012 | 0.010 | - |
| D | - | - | - | - | - | - | - |
| F | - | - | - | - | - | - | - |
| K | - | - | - | - | - | - | - |
| Q | - | - | - | - | - | - | - |

[a]Binding capacities are expressed as ratios relative to the related analog with the highest binding affinity for each individual molecule. Peptides whose relative binding capacities are in the 1-0.1 range are highlighted by shading, and are considered preferred; those whose relative binding capacities are in the 0.1-0.01 range are considered tolerated.

A dash ("-") indicates relative binding <0.01.

TABLE 47

Poly-alanine peptide ALAKAAAAV (SEQ ID NO: 3786)

| | Relative binding capacity | | | | | |
|---|---|---|---|---|---|---|
| Residue | A*0201 | A*0202 | A*0203 | A*0205 | A*0206 | A*6802 |
| I | 0.18 | 0.29 | 0.37 | 0.11 | 0.10 | 0.38 |
| V | 1.0[a] | 0.73 | 0.20 | 1.0 | 1.0 | 1.0 |
| L | 0.040 | 1.0 | 1.0 | 0.36 | 0.085 | 0.26 |
| M | 0.025 | 0.18 | 0.031 | 0.049 | 0.034 | - |
| A | 0.072 | - | 0.077 | - | - | 0.025 |
| S | - | - | 0.011 | - | - | - |
| T | - | - | 0.043 | - | - | - |
| C | - | - | - | - | - | - |
| F | - | - | - | - | - | - |
| G | - | - | - | - | - | - |
| N | - | - | - | - | - | - |
| P | - | - | - | - | - | - |
| R | - | - | - | - | - | - |
| Y | - | - | - | - | - | - |

[a]Binding capacities are expressed as ratios relative to the related analog with the highest binding affinity for each individual molecule. Peptides whose relative binding capacities are in the 1-0.1 range are highlighted by shading, and are considered preferred; those whose relative binding capacities are in the 0.1-0.01 range are considered tolerated.

A dash ("-") indicates relative binding <0.01.

TABLE 48

| Summary Allele/Peptide combinations[b] | | | | | |
|---|---|---|---|---|---|
| Residue | Tested | Preferred | Tolerated | % preferred | % tolerated or preferred |
| V | 19 | 19 | 0 | 100.0 | 100.0 |
| I | 19 | 18 | 1 | 93.3 | 100.0 |
| L | 19 | 14 | 5 | 66.7 | 100.0 |
| M | 6 | 1 | 4 | 20.0 | 83.3 |
| T | 19 | 3 | 9 | 20.0 | 63.2 |
| A | 6 | 0 | 3 | 0.0 | 50.0 |
| S | 6 | 0 | 1 | 0.0 | 16.7 |
| P | 19 | 0 | 3 | 0.0 | 15.8 |
| F | 19 | 0 | 2 | 0.0 | 10.5 |
| C | 6 | 0 | 0 | 0.0 | 0.0 |
| G | 6 | 0 | 0 | 0.0 | 0.0 |
| N | 6 | 0 | 0 | 0.0 | 0.0 |
| R | 6 | 0 | 0 | 0.0 | 0.0 |
| K | 13 | 0 | 0 | 0.0 | 0.0 |
| Y | 6 | 0 | 0 | 0.0 | 0.0 |
| D | 13 | 0 | 0 | 0.0 | 0.0 |
| Q | 13 | 0 | 0 | 0.0 | 0.0 |

[b]indicates the number of instances in which a given residue was associated with relative binding in the 1-0.1 range (preferred) or 0.1-0.01 range (tolerated).

TABLE 49

| Binding as a function of peptide size | | | |
|---|---|---|---|
| Peptide length | (n) | % Binding peptides | ARB[a] |
| 8 | 171 | 3.5 | 0.072 |
| 9 | 2066 | 27.6 | 1.0 |
| 10 | 1451 | 17.8 | 0.27 |
| 11 | 179 | 14.5 | 0.20 |
| Total | 3867 | 22.2 | |

[a]ARB values are standardized to the peptide set carrying preferred residues in both primary anchor positions.

TABLE 50

Binding as a function of main anchor motifs

| Motif | | | % Binding | |
|---|---|---|---|---|
| Position 2 | C-terminus | (n) | peptides | ARB[a] |
| Preferred | Preferred | 526 | 48.7 | 1.0 |
| Preferred | Tolerated | 1446 | 28.4 | 0.31 |
| Tolerated | Preferred | 558 | 17.6 | 0.098 |
| Non-tolerated | Preferred | 27 | 0.0 | 0.031 |
| Preferred | non-tolerated | 66 | 6.1 | 0.026 |
| Tolerated | Tolerated | 1337 | 7.1 | 0.026 |
| Non-tolerated | Tolerated | 46 | 0.0 | 0.015 |
| Non-tolerated | non-tolerated | 71 | 0.0 | 0.014 |
| Tolerated | non-tolerated | 105 | 0.0 | 0.013 |
| Total | | 4182 | 20.7 | |

[a]ARB values are standardized to the peptide set carrying preferred residues in both primary anchor positions.

TABLE 51

8-mer peptides

| | **Position (ARB)[a]** | | | | | | | |
|---|---|---|---|---|---|---|---|---|
| **Residue** | 1 | 2 | 3 | 4 | 5 | 6 | 7 | 8 |
| **A** | 0.47 | **0.052** | 2.0 | 0.57 | 1.8 | **8.9** | 0.83 | **0.28** |
| **C** | 1.3 | 0.0010 | 0.70 | 1.3 | 0.59 | 2.3 | 1.1 | 0.0010 |
| **D** | *0.23* | 0.0010 | 0.42 | 0.43 | 0.34 | 0.43 | 0.50 | 0.0010 |
| **E** | *0.23* | 0.0010 | 0.42 | 0.43 | 0.34 | 0.43 | 0.50 | 0.0010 |
| **F** | 2.5 | 0.0010 | 1.4 | 1.3 | *0.27* | **3.4** | 1.2 | 0.0010 |
| **G** | 1.5 | 0.0010 | **17** | 1.8 | 2.7 | 0.38 | **4.8** | 0.0010 |
| **H** | 0.95 | 0.0010 | *0.30* | 0.54 | 0.61 | 0.40 | 0.55 | 0.0010 |
| **I** | 2.4 | **0.17** | 1.4 | 2.0 | **9.9** | 1.5 | 1.0 | **0.35** |
| **K** | 0.95 | 0.0010 | *0.30* | 0.54 | 0.61 | 0.40 | 0.55 | 0.0010 |
| **L** | 2.4 | **1.0** | 1.4 | 2.0 | **9.9** | 1.5 | 1.0 | **0.34** |
| **M** | 2.4 | **0.73** | 1.4 | 2.0 | **9.9** | 1.5 | 1.0 | **0.13** |
| **N** | 0.90 | 0.0010 | 1.0 | 0.51 | 0.38 | 0.38 | 0.66 | 0.0010 |
| **P** | *0.33* | 0.0010 | 0.38 | 0.40 | 0.75 | 0.50 | **3.4** | 0.0010 |
| **Q** | 0.90 | **0.076** | 1.0 | 0.51 | 0.38 | 0.38 | 0.66 | 0.0010 |
| **R** | 0.95 | 0.0010 | *0.30* | 0.54 | 0.61 | 0.40 | 0.55 | 0.0010 |
| **S** | 1.3 | 0.0010 | 0.70 | 1.3 | 0.59 | 2.3 | 1.1 | 0.0010 |
| **T** | 1.3 | **0.075** | 0.70 | 1.3 | 0.59 | 2.3 | 1.1 | **0.11** |
| **V** | 2.4 | **0.084** | 1.4 | 2.0 | **9.9** | 1.5 | 1.0 | **1.0** |
| **W** | 2.5 | 0.0010 | 1.4 | 1.3 | *0.27* | **3.4** | 1.2 | 0.0010 |
| **Y** | 2.5 | 0.0010 | 1.4 | 1.3 | *0.27* | **3.4** | 1.2 | 0.0010 |

[a]A panel of 93 8-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIG. 1. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 14420 nM.

TABLE 52

| 9-mer peptides | | | | | | | | | |
|---|---|---|---|---|---|---|---|---|---|
| **Residue** | **Position (ARB)**[a] | | | | | | | | |
| | 1 | 2 | 3 | 4 | 5 | 6 | 7 | 8 | 9 |
| **A** | 1.8 | **0.052** | 1.2 | 2.3 | 1.9 | 0.45 | 2.3 | 0.80 | **0.28** |
| **C** | 0.70 | 0.0010 | 0.57 | 2.7 | 1.4 | 2.1 | 0.86 | 1.2 | 0.0010 |
| **D** | *0.065* | 0.0010 | 1.2 | 1.7 | 0.84 | 0.52 | *0.21* | 0.34 | 0.0010 |
| **E** | *0.065* | 0.0010 | *0.14* | 1.5 | *0.31* | 0.58 | *0.32* | 1.4 | 0.0010 |
| **F** | **9.1** | 0.0010 | **4.4** | 1.1 | 2.4 | 2.6 | **6.8** | **4.1** | 0.0010 |
| **G** | 0.84 | 0.0010 | 0.58 | 1.6 | 0.68 | 0.43 | 0.28 | 0.79 | 0.0010 |
| **H** | 0.68 | 0.0010 | 0.79 | 0.83 | **3.8** | *0.26* | 1.7 | 1.3 | 0.0010 |
| **I** | 1.3 | **0.17** | 1.8 | 0.56 | 2.1 | 2.0 | 1.5 | 0.45 | **0.35** |
| **K** | 1.5 | 0.0010 | *0.14* | 0.56 | 0.57 | *0.17* | *0.19* | 0.46 | 0.0010 |
| **L** | 1.9 | **1.0** | 2.2 | 0.70 | 1.3 | 2.6 | 2.9 | 2.1 | **0.34** |
| **M** | 1.4 | **0.73** | **4.6** | *0.20* | 0.97 | 1.5 | 1.0 | *0.30* | **0.13** |
| **N** | 1.1 | 0.0010 | 0.78 | 0.52 | *0.32* | 0.90 | 0.47 | 0.47 | 0.0010 |
| **P** | *0.074* | 0.0010 | 0.64 | 0.62 | 0.47 | 0.89 | 1.6 | 1.6 | 0.0010 |
| **Q** | *0.33* | **0.076** | 1.2 | 0.74 | 1.0 | 0.83 | 0.62 | 0.78 | 0.0010 |
| **R** | 1.6 | 0.0010 | *0.13* | 0.47 | 0.47 | *0.17* | *0.17* | 0.49 | 0.0010 |
| **S** | 0.99 | 0.0010 | 0.65 | 1.2 | 0.45 | 0.97 | 0.51 | 2.0 | 0.0010 |
| **T** | 0.60 | **0.075** | 0.53 | 2.1 | 0.59 | 1.9 | 0.98 | 1.3 | **0.11** |
| **V** | 0.93 | **0.084** | 1.2 | 0.56 | 1.7 | 2.7 | 0.75 | *0.30* | **1.0** |
| **W** | 0.58 | 0.0010 | **25** | **5.1** | 2.7 | 1.3 | **7.6** | 1.9 | 0.0010 |
| **Y** | **10** | 0.0010 | **4.3** | 0.52 | **3.2** | 1.0 | **7.4** | 1.7 | 0.0010 |

[a]A panel of 1389 9-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and were derived for each residue considered individually. At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIG. 1. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 1581 nM.

TABLE 53

10-mer peptides

| Residue | Position (ARB)[a] | | | | | | | | | |
|---|---|---|---|---|---|---|---|---|---|---|
| | 1 | 2 | 3 | 4 | 5 | 6 | 7 | 8 | 9 | 10 |
| **A** | 1.3 | **0.052** | 1.7 | 1.6 | 1.4 | 1.1 | 0.62 | 1.2 | 1.0 | **0.28** |
| **C** | 0.63 | 0.0010 | 1.3 | 1.3 | 1.8 | 0.51 | 1.3 | 2.6 | 1.2 | 0.0010 |
| **D** | *0.12* | 0.0010 | 0.85 | 1.4 | 1.1 | 1.1 | 0.39 | *0.22* | 0.38 | 0.0010 |
| **E** | *0.11* | 0.0010 | *0.17* | 2.8 | *0.28* | 0.75 | 0.43 | 0.40 | 0.92 | 0.0010 |
| **F** | **4.4** | 0.0010 | **4.1** | 1.4 | **3.2** | 2.3 | 3.0 | **5.0** | **5.3** | 0.0010 |
| **G** | 1.5 | 0.0010 | 0.44 | 2.1 | 0.91 | 0.91 | 0.81 | 0.67 | 1.1 | 0.0010 |
| **H** | 0.54 | 0.0010 | 0.90 | 0.76 | 1.2 | 0.42 | 0.74 | 1.6 | 0.52 | 0.0010 |
| **I** | 1.4 | **0.17** | **3.1** | 0.67 | 2.4 | 1.6 | 2.7 | 1.5 | 0.57 | **0.35** |
| **K** | 1.8 | 0.0010 | *0.13* | 0.44 | *0.26* | 0.39 | 0.48 | *0.22* | 0.47 | 0.0010 |
| **L** | 1.9 | **1.0** | **3.6** | 1.2 | 1.3 | 1.3 | **4.5** | 2.5 | 1.2 | **0.34** |
| **M** | 1.4 | **0.73** | **9.8** | 1.1 | 0.58 | 1.7 | 2.2 | **4.6** | 0.38 | **0.13** |
| **N** | 0.58 | 0.0010 | 0.56 | 1.4 | 0.39 | 1.1 | 0.43 | *0.33* | 0.79 | 0.0010 |
| **P** | *0.11* | 0.0010 | 0.53 | 0.66 | 0.40 | 0.92 | 0.86 | 1.7 | 0.85 | 0.0010 |
| **Q** | *0.30* | **0.076** | 0.97 | *0.30* | 1.7 | 0.48 | 0.41 | *0.32* | 0.70 | 0.0010 |
| **R** | 1.1 | 0.0010 | *0.19* | 0.35 | *0.33* | 0.77 | *0.27* | *0.17* | 0.38 | 0.0010 |
| **S** | 1.7 | 0.0010 | 0.38 | 0.60 | 0.43 | 0.58 | 0.49 | 0.87 | 1.1 | 0.0010 |
| **T** | 0.83 | **0.075** | 0.44 | 1.1 | 1.6 | 0.89 | 1.0 | 0.49 | 1.2 | **0.11** |
| **V** | 1.2 | **0.084** | 0.96 | 0.54 | 2.0 | 2.2 | 1.1 | 1.8 | 1.4 | **1.0** |
| **W** | 0.71 | 0.0010 | 1.8 | **4.2** | **3.5** | 1.1 | 2.6 | **4.8** | 1.5 | 0.0010 |
| **Y** | **9.0** | 0.0010 | **7.4** | 0.74 | 0.67 | 0.52 | 2.0 | 2.7 | 2.0 | 0.0010 |

[a]A panel of 953 10-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and were derived for each residue considered individually. At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIG. 1. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 3155 nM.

TABLE 54

| 11-mer peptides | | | | | | | | | | | |
|---|---|---|---|---|---|---|---|---|---|---|---|
| | Position (ARB)[a] | | | | | | | | | | |
| **Residue** | 1 | 2 | 3 | 4 | 5 | 6 | 7 | 8 | 9 | 10 | 11 |
| **A** | 0.34 | **0.052** | 1.8 | 2.7 | 2.4 | 2.2 | 1.0 | *0.23* | *0.074* | 1.3 | **0.28** |
| **C** | 2.2 | 0.0010 | *0.17* | *0.21* | 0.98 | 1.4 | 1.9 | 0.63 | 0.79 | 1.4 | 0.0010 |
| **D** | *0.21* | 0.0010 | 0.40 | **12** | 0.94 | *0.30* | *0.21* | *0.25* | *0.28* | 1.5 | 0.0010 |
| **E** | *0.21* | 0.0010 | 0.40 | **12** | 0.94 | *0.30* | *0.21* | *0.25* | *0.28* | 1.5 | 0.0010 |
| **F** | 1.2 | 0.0010 | **6.1** | 0.40 | 2.6 | *0.11* | 1.4 | **8.8** | **6.1** | *0.17* | 0.0010 |
| **G** | **3.3** | 0.0010 | *0.13* | 1.0 | *0.30* | **14** | **21** | 5.3 | 0.76 | **9.0** | 0.0010 |
| **H** | **12** | 0.0010 | 0.42 | 0.58 | *0.12* | *0.088* | 1.4 | 0.51 | *0.16* | *0.33* | 0.0010 |
| **I** | **4.4** | **0.17** | **9.2** | 1.4 | 2.4 | **3.7** | 0.87 | 2.1 | **5.5** | 0.83 | **0.35** |
| **K** | **12** | 0.0010 | 0.42 | 0.58 | *0.12* | *0.088* | 1.4 | 0.51 | *0.16* | *0.33* | 0.0010 |
| **L** | **4.4** | **1.0** | **9.2** | 1.4 | 2.4 | **3.7** | 0.87 | 2.1 | **5.5** | 0.83 | **0.34** |
| **M** | **4.4** | **0.73** | **9.2** | 1.4 | 2.4 | **3.7** | 0.87 | 2.1 | **5.5** | 0.83 | **0.13** |
| **N** | *0.12* | 0.0010 | *0.092* | 1.7 | 0.57 | 1.3 | *0.19* | 1.6 | 1.1 | *0.21* | 0.0010 |
| **P** | *0.056* | 0.0010 | 1.7 | 0.38 | 1.4 | *0.13* | 0.35 | 1.1 | *0.088* | **12** | 0.0010 |
| **Q** | *0.12* | **0.076** | *0.092* | 1.7 | 0.57 | 1.3 | *0.19* | 1.6 | 1.1 | *0.21* | 0.0010 |
| **R** | **12** | 0.0010 | 0.42 | 0.58 | *0.12* | *0.088* | 1.4 | 0.51 | *0.16* | *0.33* | 0.0010 |
| **S** | 2.2 | 0.0010 | *0.17* | *0.21* | 0.98 | 1.4 | 1.9 | 0.63 | 0.79 | 1.4 | 0.0010 |
| **T** | 2.2 | **0.075** | *0.17* | *0.21* | 0.98 | 1.4 | 1.9 | 0.63 | 0.79 | 1.4 | **0.11** |
| **V** | **4.4** | **0.084** | **9.2** | 1.4 | 2.4 | **3.7** | 0.87 | 2.1 | **5.5** | 0.83 | **1.0** |
| **W** | 1.2 | 0.0010 | **6.1** | 0.40 | 2.6 | *0.11* | 1.4 | **8.8** | **6.1** | *0.17* | 0.0010 |
| **Y** | 1.2 | 0.0010 | **6.1** | 0.40 | 2.6 | *0.11* | 1.4 | **8.8** | **6.1** | *0.17* | 0.0010 |

[a]A panel of 95 11-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIG. 1. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 3793 nM.

TABLE 55

| A*0202 | | |
|---|---|---|
| Peptide length | (n) | ARB[a] |
| 8 | 6 | 0.050 |
| 9 | 268 | 0.79 |
| 10 | 120 | 1.0 |
| 11 | 16 | 0.90 |
| Total | 410 | |

[a]ARB values are standardized to the peptide set carrying preferred residues in both primary anchor positions.

TABLE 56

| A*0203 | | |
|---|---|---|
| Peptide length | (n) | ARB[a] |
| 8 | 6 | 0.11 |
| 9 | 272 | 1.0 |
| 10 | 122 | 0.75 |
| 11 | 16 | 0.36 |
| Total | 416 | |

[a]ARB values are standardized to the peptide set carrying preferred residues in both primary anchor positions.

TABLE 57

| A*0206 | | |
|---|---|---|
| Peptide length | (n) | ARB[a] |
| 8 | 6 | 0.066 |
| 9 | 268 | 1.0 |
| 10 | 120 | 0.38 |
| 11 | 16 | 0.66 |
| Total | 410 | |

[a]ARB values are standardized to the peptide set carrying preferred residues in both primary anchor positions.

TABLE 58

| A*6802 | | |
|---|---|---|
| Peptide length | (n) | ARB[a] |
| 8 | 6 | 0.071 |
| 9 | 268 | 1.0 |
| 10 | 120 | 0.60 |
| 11 | 16 | 0.47 |
| Total | 410 | |

[a]ARB values are standardized to the peptide set carrying preferred residues in both primary anchor positions.

TABLE 59

9-mer peptides

| **Residue** | **Position (ARB)[a]** | | | | | | | | |
|---|---|---|---|---|---|---|---|---|---|
| | 1 | 2 | 3 | 4 | 5 | 6 | 7 | 8 | 9 |
| **A** | 1.1 | **0.16** | **4.2** | 1.5 | 0.86 | *0.23* | 2.4 | 1.1 | **0.43** |
| **C** | *0.30* | 0.0010 | 0.71 | 1.2 | 2.1 | 2.1 | 0.95 | 0.95 | 0.0010 |
| **D** | *0.083* | 0.0010 | *0.097* | 1.2 | 0.78 | 0.71 | *0.23* | 0.95 | 0.0010 |
| **E** | *0.083* | 0.0010 | *0.097* | 1.2 | 0.78 | 0.71 | *0.23* | 0.95 | 0.0010 |
| **F** | 2.0 | 0.0010 | 2.1 | 0.59 | 1.9 | 0.51 | 0.77 | 3.0 | 0.0010 |
| **G** | 0.46 | 0.0010 | 0.66 | 1.9 | *0.23* | 0.36 | 0.71 | 0.64 | 0.0010 |
| **H** | 1.6 | 0.0010 | 0.34 | 0.74 | 0.58 | 0.43 | 1.8 | 1.1 | 0.0010 |
| **I** | 1.1 | **0.17** | 1.1 | 1.4 | 0.79 | 2.2 | 0.75 | 0.41 | **1.0** |
| **K** | 1.6 | 0.0010 | 0.34 | 0.74 | 0.58 | 0.43 | 1.8 | 1.1 | 0.0010 |
| **L** | 1.1 | 0.081 | 1.1 | 1.4 | 0.79 | 2.2 | 0.75 | 0.41 | **0.76** |
| **M** | 1.1 | **0.14** | 1.1 | 1.4 | 0.79 | 2.2 | 0.75 | 0.41 | **0.17** |
| **N** | 0.37 | 0.0010 | 0.35 | *0.24* | 1.8 | 0.87 | 1.5 | 1.3 | 0.0010 |
| **P** | 0.42 | 0.0010 | 2.8 | 0.43 | 0.55 | *0.26* | 0.75 | 1.9 | 0.0010 |
| **Q** | 0.37 | **1.0** | 0.35 | *0.24* | 1.8 | 0.87 | 1.5 | 1.3 | 0.0010 |
| **R** | 1.6 | 0.0010 | 0.34 | 0.74 | 0.58 | 0.43 | 1.8 | 1.1 | 0.0010 |
| **S** | *0.30* | 0.0010 | 0.71 | 1.2 | 2.1 | 2.1 | 0.95 | 0.95 | 0.0010 |
| **T** | *0.30* | **0.18** | 0.71 | 1.2 | 2.1 | 2.1 | 0.95 | 0.95 | **0.15** |
| **V** | 1.1 | **0.29** | 1.1 | 1.4 | 0.79 | 2.2 | 0.75 | 0.41 | **0.92** |
| **W** | 2.0 | 0.0010 | 2.1 | 0.59 | 1.9 | 0.51 | 0.77 | 3.0 | 0.0010 |
| **Y** | 2.0 | 0.0010 | 2.1 | 0.59 | 1.9 | 0.51 | 0.77 | 3.0 | 0.0010 |

[a]A panel of 268 9-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 401 nM.

TABLE 60

10-mer peptides

| | Position (ARB)[a] | | | | | | | | | |
|---|---|---|---|---|---|---|---|---|---|---|
| Residue | 1 | 2 | 3 | 4 | 5 | 6 | 7 | 8 | 9 | 10 |
| A | 1.2 | **0.16** | 1.1 | 0.81 | 1.4 | **3.1** | 0.56 | 1.4 | 2.4 | **0.43** |
| C | *0.27* | 0.0010 | 0.44 | **3.0** | 1.2 | 0.95 | 0.43 | 1.6 | 1.5 | 0.0010 |
| D | *0.16* | 0.0010 | *0.28* | 2.2 | **9.1** | **3.6** | 2.2 | *0.0077* | 1.8 | 0.0010 |
| E | *0.16* | 0.0010 | *0.28* | 2.2 | **9.1** | **3.6** | 2.2 | *0.0077* | 1.8 | 0.0010 |
| F | **3.9** | 0.0010 | **5.8** | 1.3 | 0.83 | 2.8 | 1.3 | 1.5 | 1.1 | 0.0010 |
| G | *0.32* | 0.0010 | *0.098* | 0.88 | 1.0 | 0.44 | *0.32* | 1.0 | 0.59 | 0.0010 |
| H | 2.1 | 0.0010 | 2.0 | 0.52 | 0.89 | *0.21* | 0.74 | **9.9** | *0.22* | 0.0010 |
| I | 0.76 | **0.17** | 0.85 | 0.65 | 0.67 | 0.60 | **6.7** | 0.40 | 0.60 | **1.0** |
| K | 2.1 | 0.0010 | 2.0 | 0.52 | 0.89 | *0.21* | 0.74 | **9.9** | *0.22* | 0.0010 |
| L | 0.76 | **0.081** | 0.85 | 0.65 | 0.67 | 0.60 | **6.7** | 0.40 | 0.60 | **0.76** |
| M | 0.76 | **0.14** | 0.85 | 0.65 | 0.67 | 0.60 | **6.7** | 0.40 | 0.60 | **0.17** |
| N | **4.2** | 0.0010 | 0.38 | 1.4 | 0.66 | 0.36 | *0.26* | 0.79 | 0.91 | 0.0010 |
| P | 0.46 | 0.0010 | 1.1 | *0.091* | 2.3 | 2.5 | *0.14* | 1.2 | **3.8** | 0.0010 |
| Q | **4.2** | **1.0** | 0.38 | 1.4 | 0.66 | 0.36 | *0.26* | 0.79 | 0.91 | 0.0010 |
| R | 2.1 | 0.0010 | 2.0 | 0.52 | 0.89 | *0.21* | 0.74 | **9.9** | *0.22* | 0.0010 |
| S | *0.27* | 0.0010 | 0.44 | **3.0** | 1.2 | 0.95 | 0.43 | 1.6 | 1.5 | 0.0010 |
| T | *0.27* | **0.18** | 0.44 | **3.0** | 1.2 | 0.95 | 0.43 | 1.6 | 1.5 | **0.15** |
| V | 0.76 | **0.29** | 0.85 | 0.65 | 0.67 | 0.60 | **6.7** | 0.40 | 0.60 | **0.92** |
| W | **3.9** | 0.0010 | **5.8** | 1.3 | 0.83 | 2.8 | 1.3 | 1.5 | 1.1 | 0.0010 |
| Y | **3.9** | 0.0010 | **5.8** | 1.3 | 0.83 | 2.8 | 1.3 | 1.5 | 1.1 | 0.0010 |

[a]A panel of 120 10-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 342 nM.

TABLE 61

9-mer peptides

| Residue | Position (ARB)[a] | | | | | | | | |
|---|---|---|---|---|---|---|---|---|---|
| | 1 | 2 | 3 | 4 | 5 | 6 | 7 | 8 | 9 |
| **A** | 0.95 | **0.077** | **4.4** | 2.3 | 1.2 | 0.36 | **4.3** | 1.4 | **0.17** |
| **C** | 0.41 | 0.0010 | 0.83 | 1.4 | 0.91 | 0.86 | 1.8 | 1.7 | 0.0010 |
| **D** | 0.42 | 0.0010 | *0.059* | 0.73 | *0.28* | 0.36 | 0.56 | 0.64 | 0.0010 |
| **E** | 0.42 | 0.0010 | *0.059* | 0.73 | *0.28* | 0.36 | 0.56 | 0.64 | 0.0010 |
| **F** | 3.3 | 0.0010 | 0.71 | 0.55 | 1.5 | *0.28* | *0.075* | 1.3 | 0.0010 |
| **G** | 1.1 | 0.0010 | 1.8 | 1.5 | 0.86 | 1.3 | **3.2** | 1.2 | 0.0010 |
| **H** | 0.63 | 0.0010 | **4.2** | 0.91 | 1.9 | 0.71 | 0.95 | *0.30* | 0.0010 |
| **I** | 1.1 | **0.070** | 0.77 | 0.85 | 0.63 | 1.9 | 1.2 | 0.56 | **0.56** |
| **K** | 0.63 | 0.0010 | **4.2** | 0.91 | 1.9 | 0.71 | 0.95 | *0.30* | 0.0010 |
| **L** | 1.1 | **1.0** | 0.77 | 0.85 | 0.63 | 1.9 | 1.2 | 0.56 | **0.14** |
| **M** | 1.1 | **0.63** | 0.77 | 0.85 | 0.63 | 1.9 | 1.2 | 0.56 | **0.17** |
| **N** | 0.36 | 0.0010 | 1.3 | 0.59 | 2.1 | 1.3 | 0.97 | 1.3 | 0.0010 |
| **P** | *0.015* | 0.0010 | 1.0 | 0.55 | 1.2 | 1.8 | 1.0 | **4.4** | 0.0010 |
| **Q** | 0.36 | **0.51** | 1.3 | 0.59 | 2.1 | 1.3 | 0.97 | 1.3 | 0.0010 |
| **R** | 0.63 | 0.0010 | **4.2** | 0.91 | 1.9 | 0.71 | 0.95 | *0.30* | 0.0010 |
| **S** | 0.41 | 0.0010 | 0.83 | 1.4 | 0.91 | 0.86 | 1.8 | 1.7 | 0.0010 |
| **T** | 0.41 | **0.045** | 0.83 | 1.4 | 0.91 | 0.86 | 1.8 | 1.7 | **0.26** |
| **V** | 1.1 | **0.10** | 0.77 | 0.85 | 0.63 | 1.9 | 1.2 | 0.56 | **1.0** |
| **W** | **3.3** | 0.0010 | 0.71 | 0.55 | 1.5 | *0.28* | *0.075* | 1.3 | 0.0010 |
| **Y** | **3.3** | 0.0010 | 0.71 | 0.55 | 1.5 | *0.28* | *0.075* | 1.3 | 0.0010 |

[a]A panel of 272 9-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 85 nM.

TABLE 62

10-mer peptides

| Residue | Position (ARB)[a] 1 | 2 | 3 | 4 | 5 | 6 | 7 | 8 | 9 | 10 |
|---|---|---|---|---|---|---|---|---|---|---|
| **A** | 2.1 | **0.077** | 1.5 | 1.1 | 3.8 | 1.3 | 0.56 | 1.7 | 3.0 | **0.17** |
| **C** | 0.68 | 0.0010 | *0.33* | 1.0 | 0.82 | 0.69 | 0.69 | 2.2 | 1.1 | 0.0010 |
| **D** | *0.32* | 0.0010 | *0.074* | **3.7** | 1.1 | 2.4 | 0.60 | **16** | 2.8 | 0.0010 |
| **E** | *0.32* | 0.0010 | *0.074* | **3.7** | 1.1 | 2.4 | 0.60 | **16** | 2.8 | 0.0010 |
| **F** | **8.3** | 0.0010 | **6.4** | 0.66 | 1.0 | 1.3 | 1.7 | *0.23* | 1.3 | 0.0010 |
| **G** | 1.0 | 0.0010 | *0.32* | 0.59 | 0.63 | 1.0 | *0.33* | **3.8** | 2.6 | 0.0010 |
| **H** | 0.75 | 0.0010 | **3.9** | 1.4 | 0.62 | 0.55 | 0.77 | **4.7** | *0.085* | 0.0010 |
| **I** | *0.29* | **0.070** | 0.83 | 0.60 | 1.1 | 0.57 | **3.3** | 0.65 | 0.52 | **0.56** |
| **K** | 0.75 | 0.0010 | **3.9** | 1.4 | 0.62 | 0.55 | 0.77 | **4.7** | *0.085* | 0.0010 |
| **L** | *0.29* | **1.0** | 0.83 | 0.60 | 1.1 | 0.57 | **3.3** | 0.65 | 0.52 | **0.14** |
| **M** | *0.29* | **0.63** | 0.83 | 0.60 | 1.1 | 0.57 | **3.3** | 0.65 | 0.52 | **0.17** |
| **N** | **6.0** | 0.0010 | 0.43 | 2.8 | 0.75 | 1.3 | *0.17* | 0.89 | 0.91 | 0.0010 |
| **P** | *0.019* | 0.0010 | 0.90 | *0.091* | 1.1 | **4.9** | **3.6** | 1.4 | 2.5 | 0.0010 |
| **Q** | **6.0** | **0.51** | 0.43 | 2.8 | 0.75 | 1.3 | *0.17* | 0.89 | 0.91 | 0.0010 |
| **R** | 0.75 | 0.0010 | **3.9** | 1.4 | 0.62 | 0.55 | 0.77 | **4.7** | *0.085* | 0.0010 |
| **S** | 0.68 | 0.0010 | *0.33* | 1.0 | 0.82 | 0.69 | 0.69 | 2.2 | 1.1 | 0.0010 |
| **T** | 0.68 | **0.045** | *0.33* | 1.0 | 0.82 | 0.69 | 0.69 | 2.2 | 1.1 | **0.26** |
| **V** | *0.29* | **0.10** | 0.83 | 0.60 | 1.1 | 0.57 | **3.3** | 0.65 | 0.52 | **1.0** |
| **W** | **8.3** | 0.0010 | **6.4** | 0.66 | 1.0 | 1.3 | 1.7 | *0.23* | 1.3 | 0.0010 |
| **Y** | **8.3** | 0.0010 | **6.4** | 0.66 | 1.0 | 1.3 | 1.7 | *0.23* | 1.3 | 0.0010 |

[a]A panel of 122 10-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 95 nM.

TABLE 63

9-mer peptides

| Residue | Position (ARB)[a] 1 | 2 | 3 | 4 | 5 | 6 | 7 | 8 | 9 |
|---|---|---|---|---|---|---|---|---|---|
| **A** | 0.95 | **0.52** | 0.91 | 1.6 | 0.74 | *0.21* | 1.3 | 0.53 | **0.16** |
| **C** | 0.35 | 0.0010 | 0.47 | 1.1 | 1.4 | 0.75 | 0.72 | 1.6 | 0.0010 |
| **D** | 0.81 | 0.0010 | 0.51 | 1.4 | 2.2 | 1.2 | *0.21* | 0.64 | 0.0010 |
| **E** | 0.81 | 0.0010 | 0.51 | 1.4 | 2.2 | 1.2 | *0.21* | 0.64 | 0.0010 |
| **F** | 2.5 | 0.0010 | 1.4 | 0.85 | 1.9 | 1.6 | 2.0 | **3.3** | 0.0010 |
| **G** | 0.67 | 0.0010 | *0.33* | 2.4 | *0.24* | 0.34 | 0.81 | 0.82 | 0.0010 |
| **H** | 1.7 | 0.0010 | *0.13* | 0.47 | 0.62 | 0.61 | 0.85 | 0.83 | 0.0010 |
| **I** | 0.77 | **0.49** | **4.1** | 0.82 | 0.86 | 2.4 | 0.74 | 0.46 | **0.54** |
| **K** | 1.7 | 0.0010 | *0.13* | 0.47 | 0.62 | 0.61 | 0.85 | 0.83 | 0.0010 |
| **L** | 0.77 | **0.061** | **4.1** | 0.82 | 0.86 | 2.4 | 0.74 | 0.46 | **0.23** |
| **M** | 0.77 | **0.18** | **4.1** | 0.82 | 0.86 | 2.4 | 0.74 | 0.46 | **0.071** |
| **N** | 0.48 | 0.0010 | 0.39 | *0.29* | 2.0 | 0.94 | 1.3 | 1.0 | 0.0010 |
| **P** | *0.11* | 0.0010 | 0.47 | *0.32* | *0.27* | *0.19* | 2.1 | 1.4 | 0.0010 |
| **Q** | 0.48 | **1.0** | 0.39 | *0.29* | 2.0 | 0.94 | 1.3 | 1.0 | 0.0010 |
| **R** | 1.7 | 0.0010 | *0.13* | 0.47 | 0.62 | 0.61 | 0.85 | 0.83 | 0.0010 |
| **S** | 0.35 | 0.0010 | 0.47 | 1.1 | 1.4 | 0.75 | 0.72 | 1.6 | 0.0010 |
| **T** | 0.35 | **0.47** | 0.47 | 1.1 | 1.4 | 0.75 | 0.72 | 1.6 | **0.11** |
| **V** | 0.77 | **0.53** | **4.1** | 0.82 | 0.86 | 2.4 | 0.74 | 0.46 | **1.0** |
| **W** | 2.5 | 0.0010 | 1.4 | 0.85 | 1.9 | 1.6 | 2.0 | **3.3** | 0.0010 |
| **Y** | 2.5 | 0.0010 | 1.4 | 0.85 | 1.9 | 1.6 | 2.0 | **3.3** | 0.0010 |

[a]A panel of 268 9-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 387 nM.

TABLE 64

10-mer peptides

| | Position (ARB)[a] | | | | | | | | | |
|---|---|---|---|---|---|---|---|---|---|---|
| **Residue** | 1 | 2 | 3 | 4 | 5 | 6 | 7 | 8 | 9 | 10 |
| **A** | 2.4 | **0.52** | 0.62 | 1.2 | 2.1 | 0.55 | *0.17* | 0.53 | 5.3 | **0.16** |
| **C** | 0.61 | 0.0010 | *0.23* | 0.71 | 1.4 | 0.80 | 0.56 | 1.2 | 0.78 | 0.0010 |
| **D** | *0.068* | 0.0010 | *0.099* | 2.7 | **11** | **3.2** | 1.2 | 0.38 | **4.0** | 0.0010 |
| **E** | *0.068* | 0.0010 | *0.099* | 2.7 | **11** | **3.2** | 1.2 | 0.38 | **4.0** | 0.0010 |
| **F** | 3.0 | 0.0010 | **4.1** | 0.80 | 1.2 | 2.6 | 1.8 | 2.1 | 0.45 | 0.0010 |
| **G** | 0.71 | 0.0010 | *0.072* | 0.81 | 0.61 | 0.48 | 0.71 | 0.73 | 0.41 | 0.0010 |
| **H** | 1.4 | 0.0010 | *0.17* | 0.56 | 0.66 | 0.86 | 0.96 | **5.0** | *0.25* | 0.0010 |
| **I** | 0.42 | **0.49** | **3.8** | 0.67 | 0.76 | 0.90 | **4.9** | 0.79 | 1.0 | **0.54** |
| **K** | 1.4 | 0.0010 | *0.17* | 0.56 | 0.66 | 0.86 | 0.96 | **5.0** | *0.25* | 0.0010 |
| **L** | 0.42 | **0.061** | **3.8** | 0.67 | 0.76 | 0.90 | **4.9** | 0.79 | 1.0 | **0.23** |
| **M** | 0.42 | **0.18** | **3.8** | 0.67 | 0.76 | 0.90 | **4.9** | 0.79 | 1.0 | **0.071** |
| **N** | **6.1** | 0.0010 | *0.28* | 1.8 | 0.47 | 0.82 | *0.14* | *0.20* | 0.34 | 0.0010 |
| **P** | *0.17* | 0.0010 | 0.84 | 1.2 | 0.57 | 0.83 | *0.26* | 1.3 | **3.6** | 0.0010 |
| **Q** | **6.1** | **1.0** | *0.28* | 1.8 | 0.47 | 0.82 | *0.14* | *0.20* | 0.34 | 0.0010 |
| **R** | **1.4** | 0.0010 | *0.17* | 0.56 | 0.66 | 0.86 | 0.96 | **5.0** | *0.25* | 0.0010 |
| **S** | 0.61 | 0.0010 | *0.23* | 0.71 | 1.4 | 0.80 | 0.56 | 1.2 | 0.78 | 0.0010 |
| **T** | 0.61 | **0.47** | *0.23* | 0.71 | 1.4 | 0.80 | 0.56 | 1.2 | 0.78 | **0.11** |
| **V** | 0.42 | **0.53** | **3.8** | 0.67 | 0.76 | 0.90 | **4.9** | 0.79 | 1.0 | **1.0** |
| **W** | 3.0 | 0.0010 | **4.1** | 0.80 | 1.2 | 2.6 | 1.8 | 2.1 | 0.45 | 0.0010 |
| **Y** | 3.0 | 0.0010 | **4.1** | 0.80 | 1.2 | 2.6 | 1.8 | 2.1 | 0.45 | 0.0010 |

[a] A panel of 120 10-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 643 nM.

TABLE 65

9-mer peptides

| Residue | Position (ARB)[a] | | | | | | | | |
|---|---|---|---|---|---|---|---|---|---|
| | 1 | 2 | 3 | 4 | 5 | 6 | 7 | 8 | 9 |
| A | 0.36 | **0.13** | **6.8** | 0.98 | 0.71 | *0.14* | **3.4** | 0.71 | **0.15** |
| C | 1.0 | 0.0010 | 0.42 | 0.92 | 0.95 | 1.7 | 0.60 | 0.75 | 0.0010 |
| D | **352** | 0.0010 | *0.30* | 0.70 | *0.28* | 0.70 | 0.36 | 0.45 | 0.0010 |
| E | **352** | 0.0010 | *0.30* | 0.70 | *0.28* | 0.70 | 0.36 | 0.45 | 0.0010 |
| F | **7.6** | 0.0010 | 2.7 | 1.4 | 1.8 | 2.3 | 1.5 | 2.1 | 0.0010 |
| G | *0.054* | 0.0010 | *0.24* | 2.5 | 0.48 | 0.53 | 0.85 | 1.9 | 0.0010 |
| H | *0.16* | 0.0010 | *0.27* | 0.55 | 0.68 | **3.2** | **3.2** | 1.5 | 0.0010 |
| I | 2.2 | **0.052** | 0.88 | 1.3 | 1.1 | 0.80 | 0.65 | 0.57 | **0.80** |
| K | *0.16* | 0.0010 | *0.27* | 0.55 | 0.68 | **3.2** | **3.2** | 1.5 | 0.0010 |
| L | 2.2 | **0.0078** | 0.88 | 1.3 | 1.1 | 0.80 | 0.65 | 0.57 | **0.32** |
| M | 2.2 | **0.023** | 0.88 | 1.3 | 1.1 | 0.80 | 0.65 | 0.57 | **0.093** |
| N | 0.83 | 0.0010 | 1.6 | 0.45 | 0.36 | 0.71 | 0.46 | 1.8 | 0.0010 |
| P | 0.49 | 0.0010 | 2.8 | 0.43 | **24** | 2.3 | 0.71 | 1.7 | 0.0010 |
| Q | 0.83 | **0.0010** | 1.6 | 0.45 | 0.36 | 0.71 | 0.46 | 1.8 | 0.0010 |
| R | *0.16* | 0.0010 | *0.27* | 0.55 | 0.68 | **3.2** | **3.2** | 1.5 | 0.0010 |
| S | 1.0 | 0.0010 | 0.42 | 0.92 | 0.95 | 1.7 | 0.60 | 0.75 | 0.0010 |
| T | 1.0 | **0.45** | 0.42 | 0.92 | 0.95 | 1.7 | 0.60 | 0.75 | **0.062** |
| V | 2.2 | **1.0** | 0.88 | 1.3 | 1.1 | 0.80 | 0.65 | 0.57 | **1.0** |
| W | **7.6** | 0.0010 | 2.7 | 1.4 | 1.8 | 2.3 | 1.5 | 2.1 | 0.0010 |
| Y | **7.6** | 0.0010 | 2.7 | 1.4 | 1.8 | 2.3 | 1.5 | 2.1 | 0.0010 |

[a]A panel of 268 9-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 838 nM.

TABLE 66

10-mer peptides

| Residue | Position (ARB)[a] 1 | 2 | 3 | 4 | 5 | 6 | 7 | 8 | 9 | 10 |
|---|---|---|---|---|---|---|---|---|---|---|
| A | 0.50 | **0.13** | **5.6** | **3.5** | 2.7 | 0.69 | 0.71 | 1.3 | 1.4 | **0.15** |
| C | 2.1 | 0.0010 | 1.4 | 1.4 | *0.20* | 0.72 | *0.26* | 1.1 | 0.55 | 0.0010 |
| D | **3.2** | 0.0010 | *0.042* | **4.8** | **4.3** | 0.68 | *0.28* | *0.10* | 1.2 | 0.0010 |
| E | **3.2** | 0.0010 | *0.042* | **4.8** | **4.3** | 0.68 | *0.28* | *0.10* | 1.2 | 0.0010 |
| F | 1.1 | 0.0010 | 2.7 | 1.4 | 1.3 | 1.5 | **4.9** | 0.98 | 2.2 | 0.0010 |
| G | *0.086* | 0.0010 | *0.16* | 0.38 | 2.1 | 0.54 | 1.5 | 1.5 | 0.66 | 0.0010 |
| H | 0.73 | 0.0010 | *0.16* | *0.15* | 0.70 | *0.18* | **3.8** | **3.1** | 0.88 | 0.0010 |
| I | 1.2 | **0.052** | 1.2 | 1.2 | 2.8 | 1.8 | 1.7 | 0.96 | 0.74 | **0.80** |
| K | 0.73 | 0.0010 | *0.16* | *0.15* | 0.70 | *0.18* | **3.8** | **3.1** | 0.88 | 0.0010 |
| L | 1.2 | **0.0078** | 1.2 | 1.2 | 2.8 | 1.8 | 1.7 | 0.96 | 0.74 | **0.32** |
| M | 1.2 | **0.023** | 1.2 | 1.2 | 2.8 | 1.8 | 1.7 | 0.96 | 0.74 | **0.093** |
| N | **16** | 0.0010 | *0.22* | 1.5 | *0.20* | **8.4** | **3.2** | *0.31* | 1.6 | 0.0010 |
| P | **115** | 0.0010 | *0.17* | *0.045* | *0.090* | 0.60 | *0.12* | 0.96 | 1.8 | 0.0010 |
| Q | **16** | **0.0010** | *0.22* | 1.5 | *0.20* | **8.4** | **3.2** | *0.31* | 1.6 | 0.0010 |
| R | 0.73 | 0.0010 | *0.16* | *0.15* | 0.70 | *0.18* | **3.8** | **3.1** | 0.88 | 0.0010 |
| S | 2.1 | 0.0010 | 1.4 | 1.4 | *0.20* | 0.72 | *0.26* | 1.1 | 0.55 | 0.0010 |
| T | 2.1 | **0.45** | 1.4 | 1.4 | *0.20* | 0.72 | *0.26* | 1.1 | 0.55 | **0.062** |
| V | 1.2 | **1.0** | 1.2 | 1.2 | 2.8 | 1.8 | 1.7 | 0.96 | 0.74 | **1.0** |
| W | 1.1 | 0.0010 | 2.7 | 1.4 | 1.3 | 1.5 | **4.9** | 0.98 | 2.2 | 0.0010 |
| Y | 1.1 | 0.0010 | 2.7 | 1.4 | 1.3 | 1.5 | **4.9** | 0.98 | 2.2 | 0.0010 |

[a]A panel of 120 10-mer peptides based on naturally occurring sequences from various viral, bacterial, or pathogen origin was analyzed. All peptides had at least 1 preferred and 1 tolerated residue at the main anchor positions. ARB values shown were calculated as described in the materials and methods, and are based on the grouping of chemically similar residues (see, e.g., ref. 6). At secondary anchor positions values corresponding to a 3-fold or greater increase in binding capacity are indicated by increased font. Positive effects are further identified bolded font, and negative effects by underlined and italicized font. Main anchor positions are shaded and residues determined to be preferred or tolerated anchors are indicated by bold font. ARB values at the anchor positions were derived from the analyses described in FIGS. 3 and 4. To allow use of the values shown in this table as coefficients for predictive algorithms, the values for non-selected anchor residues have been set to 0.001, equivalent to a 1000-fold reduction in binding capacity to filter out non-motif peptides. The average geometric binding capacity of the panel was 1055 nM.

Lengthy table referenced here

US09340577-20160517-T00001

Please refer to the end of the specification for access instructions.

Lengthy table referenced here

US09340577-20160517-T00002

Please refer to the end of the specification for access instructions.

Lengthy table referenced here

US09340577-20160517-T00003

Please refer to the end of the specification for access instructions.

Lengthy table referenced here

US09340577-20160517-T00004

Please refer to the end of the specification for access instructions.

Lengthy table referenced here

US09340577-20160517-T00005

Please refer to the end of the specification for access instructions.

Lengthy table referenced here

US09340577-20160517-T00006

Please refer to the end of the specification for access instructions.

Lengthy table referenced here

US09340577-20160517-T00007

Please refer to the end of the specification for access instructions.

Lengthy table referenced here

US09340577-20160517-T00008

Please refer to the end of the specification for access instructions.

Lengthy table referenced here

US09340577-20160517-T00009

Please refer to the end of the specification for access instructions.

Lengthy table referenced here

US09340577-20160517-T00010

Please refer to the end of the specification for access instructions.

Lengthy table referenced here

US09340577-20160517-T00011

Please refer to the end of the specification for access instructions.

Lengthy table referenced here

US09340577-20160517-T00012

Please refer to the end of the specification for access instructions.

Lengthy table referenced here

US09340577-20160517-T00013

Please refer to the end of the specification for access instructions.

Lengthy table referenced here

US09340577-20160517-T00014

Please refer to the end of the specification for access instructions.

Lengthy table referenced here

US09340577-20160517-T00015

Please refer to the end of the specification for access instructions.

Lengthy table referenced here

US09340577-20160517-T00016

Please refer to the end of the specification for access instructions.

Lengthy table referenced here

US09340577-20160517-T00017

Please refer to the end of the specification for access instructions.

Lengthy table referenced here

US09340577-20160517-T00018

Please refer to the end of the specification for access instructions.

Lengthy table referenced here

US09340577-20160517-T00019

Please refer to the end of the specification for access instructions.

Lengthy table referenced here

US09340577-20160517-T00020

Please refer to the end of the specification for access instructions.

Lengthy table referenced here

US09340577-20160517-T00021

Please refer to the end of the specification for access instructions.

Lengthy table referenced here

US09340577-20160517-T00022

Please refer to the end of the specification for access instructions.

Lengthy table referenced here

US09340577-20160517-T00023

Please refer to the end of the specification for access instructions.

Lengthy table referenced here

US09340577-20160517-T00024

Please refer to the end of the specification for access instructions.

Lengthy table referenced here

US09340577-20160517-T00025

Please refer to the end of the specification for access instructions.

Lengthy table referenced here

US09340577-20160517-T00026

Please refer to the end of the specification for access instructions.

Lengthy table referenced here

US09340577-20160517-T00027

Please refer to the end of the specification for access instructions.

Lengthy table referenced here

US09340577-20160517-T00028

Please refer to the end of the specification for access instructions.

Lengthy table referenced here

US09340577-20160517-T00029

Please refer to the end of the specification for access instructions.

Lengthy table referenced here

US09340577-20160517-T00030

Please refer to the end of the specification for access instructions.

Lengthy table referenced here

US09340577-20160517-T00031

Please refer to the end of the specification for access instructions.

Lengthy table referenced here

US09340577-20160517-T00032

Please refer to the end of the specification for access instructions.

Lengthy table referenced here

US09340577-20160517-T00033

Please refer to the end of the specification for access instructions.

Lengthy table referenced here

US09340577-20160517-T00034

Please refer to the end of the specification for access instructions.

Lengthy table referenced here

US09340577-20160517-T00035

Please refer to the end of the specification for access instructions.

Lengthy table referenced here

US09340577-20160517-T00036

Please refer to the end of the specification for access instructions.

Lengthy table referenced here

US09340577-20160517-T00037

Please refer to the end of the specification for access instructions.

Lengthy table referenced here

US09340577-20160517-T00038

Please refer to the end of the specification for access instructions.

Lengthy table referenced here

US09340577-20160517-T00039

Please refer to the end of the specification for access instructions.

Lengthy table referenced here

US09340577-20160517-T00040

Please refer to the end of the specification for access instructions.

Lengthy table referenced here

US09340577-20160517-T00041

Please refer to the end of the specification for access instructions.

Lengthy table referenced here

US09340577-20160517-T00042

Please refer to the end of the specification for access instructions.

Lengthy table referenced here

US09340577-20160517-T00043

Please refer to the end of the specification for access instructions.

Lengthy table referenced here

US09340577-20160517-T00044

Please refer to the end of the specification for access instructions.

Lengthy table referenced here

US09340577-20160517-T00045

Please refer to the end of the specification for access instructions.

Lengthy table referenced here

US09340577-20160517-T00046

Please refer to the end of the specification for access instructions.

Lengthy table referenced here

US09340577-20160517-T00047

Please refer to the end of the specification for access instructions.

Lengthy table referenced here

US09340577-20160517-T00048

Please refer to the end of the specification for access instructions.

Lengthy table referenced here

US09340577-20160517-T00049

Please refer to the end of the specification for access instructions.

Lengthy table referenced here

US09340577-20160517-T00050

Please refer to the end of the specification for access instructions.

Lengthy table referenced here
US09340577-20160517-T00051
Please refer to the end of the specification for access instructions.

Lengthy table referenced here
US09340577-20160517-T00052
Please refer to the end of the specification for access instructions.

Lengthy table referenced here
US09340577-20160517-T00053
Please refer to the end of the specification for access instructions.

Lengthy table referenced here
US09340577-20160517-T00054
Please refer to the end of the specification for access instructions.

Lengthy table referenced here
US09340577-20160517-T00055
Please refer to the end of the specification for access instructions.

Lengthy table referenced here
US09340577-20160517-T00056
Please refer to the end of the specification for access instructions.

Lengthy table referenced here
US09340577-20160517-T00057
Please refer to the end of the specification for access instructions.

Lengthy table referenced here
US09340577-20160517-T00058
Please refer to the end of the specification for access instructions.

Lengthy table referenced here
US09340577-20160517-T00059
Please refer to the end of the specification for access instructions.

Lengthy table referenced here
US09340577-20160517-T00060
Please refer to the end of the specification for access instructions.

Lengthy table referenced here
US09340577-20160517-T00061
Please refer to the end of the specification for access instructions.

Lengthy table referenced here
US09340577-20160517-T00062
Please refer to the end of the specification for access instructions.

Lengthy table referenced here
US09340577-20160517-T00063
Please refer to the end of the specification for access instructions.

Lengthy table referenced here
US09340577-20160517-T00064
Please refer to the end of the specification for access instructions.

Lengthy table referenced here
US09340577-20160517-T00065
Please refer to the end of the specification for access instructions.

Lengthy table referenced here
US09340577-20160517-T00066
Please refer to the end of the specification for access instructions.

Lengthy table referenced here

US09340577-20160517-T00067

Please refer to the end of the specification for access instructions.

Lengthy table referenced here

US09340577-20160517-T00068

Please refer to the end of the specification for access instructions.

Lengthy table referenced here

US09340577-20160517-T00069

Please refer to the end of the specification for access instructions.

Lengthy table referenced here

US09340577-20160517-T00070

Please refer to the end of the specification for access instructions.

Lengthy table referenced here

US09340577-20160517-T00071

Please refer to the end of the specification for access instructions.

Lengthy table referenced here

US09340577-20160517-T00072

Please refer to the end of the specification for access instructions.

Lengthy table referenced here

US09340577-20160517-T00073

Please refer to the end of the specification for access instructions.

Lengthy table referenced here

US09340577-20160517-T00074

Please refer to the end of the specification for access instructions.

Lengthy table referenced here

US09340577-20160517-T00075

Please refer to the end of the specification for access instructions.

Lengthy table referenced here

US09340577-20160517-T00076

Please refer to the end of the specification for access instructions.

TABLE 142

Binding of A3-Like Restrictive Peptides

| | Sequence | | | Binding Capacity ($IC_{50}$ nM) | | | | |
|---|---|---|---|---|---|---|---|---|
| Peptide | 1234567891011 | SEQ ID NO | Restriction | A3 | A11 | A31 | A*3301 | A*6801 |
| HBVc 141-151[a] | STLPETTVVRR | 11236 | A31, Aw68 | 33 | 4 | 181 | 181 | 26 |
| HIV nef 73-82[b] | QVPLRPMTYK | 11237 | A3, A11 | 18 | 10 | 1837 | 2164 | 133 |
| MAGE 1 96-104 | SLFRAVITK | 11238 | A3, A11 | 3 | 2 | 2483 | 10943 | 113 |
| HIV env 43-52 | TVYYGVPVWK | 11239 | A3, A11 | 11 | 4 | 1636 | 10357 | 15 |
| HCV lorf 1858-1867 | GVAGALVAFK | 11240 | A3, A11 | 28 | 4 | 3303 | 27188 | 119 |
| HIV env 42-52 | VTVYYGVPVWK | 11241 | A3, A11 | 85 | 11 | 4615 | 38667 | 172 |
| HBV pol 152-161 | TLWKAGILYK | 11242 | A3, A11 | 2 | 17 | 2927 | 30526 | 533 |

[b]Good binding capacities were defined as <500 nM and are highlighted by shading.

TABLE 143

Allele-specific secondary anchor preferences determined by relative binding values. The values in the tables directly correlate with binding affinity. In view of this, analogs with increased binding affinity may be created by substituting a residue that gives a higher score. The shaded regions at positions 2 and 9 indicate that these peptide positions bore one of the designated primary anchor residues.

| | Position | | | | | | | | |
|---|---|---|---|---|---|---|---|---|---|
| Group | 1 | 2 | 3 | 4 | 5 | 6 | 7 | 8 | 9 |
| A. A3 | | | | | | | | | |
| A | 2.8 | | 1.8 | 0.73 | 4.5 | 1.2 | 0.54 | 0.75 | |
| G | 0.52 | | 0.53 | 2.4 | 0.59 | 1.2 | 1.4 | 0.64 | |
| D, E | 0.22 | | 0.16 | 0.36 | 0.29 | 0.28 | 0.35 | 0.51 | |
| R, H, K | 7.8 | | 0.45 | 6.2 | 0.95 | 0.42 | 0.59 | 2.3 | |
| L, I, V, M | 1.1 | | 1.0 | 0.43 | 1.4 | 1.7 | 1.6 | 0.41 | |
| Y, F, W | 0.45 | | 32 | 4.2 | 3.3 | 29 | 2.2 | 0.90 | |
| Q, N | 0.57 | | 0.64 | 0.36 | 0.66 | 0.90 | 0.67 | 0.96 | |
| S, T, C | 1.3 | | 0.82 | 0.50 | 1.1 | 2.0 | 1.1 | 3.2 | |
| P | 0.21 | | 0.55 | 14 | 3.6 | 0.49 | 0.91 | 6.6 | |
| B. A11 | | | | | | | | | |
| A | 7.9 | | 0.86 | 0.85 | 5.0 | 2.0 | 0.18 | 0.30 | |
| G | 1.5 | | 0.44 | 0.68 | 0.37 | 1.5 | 1.4 | 0.22 | |
| D, E | 0.12 | | 0.30 | 0.37 | 0.48 | 0.30 | 0.46 | 1.44 | |
| R, H, K | 1.3 | | 0.30 | 1.9 | 0.47 | 0.37 | 0.37 | 2.1 | |
| L, I, V, M | 1.3 | | 1.8 | 0.52 | 3.1 | 1.5 | 2.9 | 0.38 | |
| Y, F, W | 0.31 | | 6.2 | 5.1 | 3.6 | 13 | 14 | 3.9 | |
| Q, N | 0.65 | | 0.92 | 0.73 | 0.48 | 0.88 | 0.59 | 0.98 | |
| S, T, C | 3.8 | | 1.3 | 1. | 1.4 | 1.2 | 0.38 | 1.8 | |
| P | 0.17 | | 0.45 | 3.2 | 1.6 | 1.5 | 0.77 | 18 | |
| C. A31 | | | | | | | | | |
| A | 3.9 | | 1.3 | 0.28 | 0.11 | 0.38 | 1.1 | 7.1 | |
| G | 0.34 | | 0.34 | 0.99 | 0.85 | 1.2 | 0.44 | 1.9 | |
| D, E | 0.060 | | 0.10 | 0.50 | 0.24 | 0.24 | 0.16 | 0.22 | |
| R, H, K | 11 | | 3.3 | 1.5 | 2.0 | 2.0 | 1.7 | 0.79 | |
| L, I, V, M | 1.4 | | 1.2 | 0.71 | 3.3 | 1.1 | 0.45 | 0.60 | |
| Y, F, W | 0.59 | | 7.2 | 1.5 | 2.4 | 6.6 | 7.5 | 0.70 | |
| Q, N | 0.57 | | 0.49 | 1.7 | 0.44 | 1.4 | 0.82 | 1.6 | |
| S, T, C | 2.1 | | 1.1 | 0.67 | 1.5 | 1.1 | 2.7 | 2.2 | |
| P | 0.073 | | 0.40 | 21 | 0.55 | 0.72 | 0.80 | 5.8 | |
| D. A*3301 | | | | | | | | | |
| A | 0.48 | | 0.62 | 1.4 | 0.74 | 0.65 | 4.9 | 1.2 | |
| G | 0.22 | | 0.39 | 1.0 | 1.7 | 0.59 | 0.47 | 1.3 | |
| D, E | 1.5 | | 0.24 | 1.1 | 0.36 | 0.43 | 0.54 | 0.41 | |
| R, H, K | 0.64 | | 2.3 | 1.0 | 0.88 | 1.4 | 1.1 | 0.76 | |
| L, I, V, M | 1.3 | | 1.5 | 0.90 | 2.8 | 1.4 | 0.45 | 0.87 | |
| Y, F, W | 2.2 | | 4.0 | 1.1 | 2.5 | 3.6 | 4.0 | 1.6 | |
| Q, N | 1.3 | | 1.7 | 0.77 | 0.44 | 0.72 | 1.2 | 1.4 | |
| S, T, C | 1.9 | | 0.71 | 0.82 | 1.0 | 0.93 | 1.8 | 1.2 | |
| P | 0.21 | | 0.41 | 2.7 | 1.4 | 1.2 | 0.85 | 3.6 | |

TABLE 143-continued

Allele-specific secondary anchor preferences determined by relative binding values. The values in the tables directly correlate with binding affinity. In view of this, analogs with increased binding affinity may be created by substituting a residue that gives a higher score. The shaded regions at positions 2 and 9 indicate that these peptide positions bore one of the designated primary anchor residues.

| E. A*6801 | | | | | | | | | |
|---|---|---|---|---|---|---|---|---|---|
| A | 0.65 | | 3.1 | 0.97 | 2.6 | 1.3 | 3.3 | 0.23 | |
| G | 0.18 | | 0.19 | 2.5 | 1.5 | 0.70 | 1.4 | 0.70 | |
| D, E | 1.2 | | 0.097 | 0.51 | 0.33 | 0.26 | 0.69 | 0.86 | |
| R, H, K | 0.28 | | 0.84 | 0.69 | 0.22 | 0.64 | 0.42 | 1.2 | |
| L, I, V, M | 1.3 | | 2.3 | 0.54 | 5.3 | 0.82 | 0.88 | 0.64 | |
| Y, F, W | 6.6 | | 2.5 | 3.1 | 6.0 | 1.5 | 4.5 | 2.8 | |
| Q, N | 1.8 | | 1.1 | 0.87 | 0.60 | 1.8 | 0.86 | 1.2 | |
| S, T, C | 5.5 | | 1.4 | 1.8 | 1.6 | 2.8 | 1.2 | 1.2 | |
| P | 0.034 | | 0.43 | 1.3 | 1.3 | 3.3 | 1.0 | 5.2 | |

TABLE 144

Discreet Substitutions Improve the B7-Like Supertype Binding Capacity and Degeneracy of Peptide Ligands

| Source | 123456789 | SEQ ID NO | Binding ($IC_{50}$ nM) B*0701 | B*3501 | B*5101 | B*5301 | B*5401 | x-rxn |
|---|---|---|---|---|---|---|---|---|
| HIV nef 84 | FPVRPQVPL | 11243 | 16 | 43 | 12 | 481 | 71 | 5 |
| | FPVRPQ**F**PL | 11244 | 9.5 | 23 | 207 | 319 | 241 | 5 |
| | FPVRPQVP**I** | 11245 | 22 | 120.0 | 15 | 31 | 1.6 | 5 |
| | | 11246 | | | | | | |
| HBV ENV 313 | IPIPSSWAF | 11247 | 42 | 2.6 | 2.3 | 12 | 2970 | 4 |
| | **F**PIPSSWAF | 11248 | 24 | 1.2 | 305 | 1.7 | 105 | 5 |
| | IPIP**M**SWAF | 11249 | 229 | 2.2 | 580 | 930 | 5.9 | 3 |
| | IP**F**PSSWAF | 11250 | 186 | 1.7 | 16 | 3.8 | 826 | 4 |
| | IPIPSSWA**I** | 11251 | 31 | 54 | 15 | 24 | 7.7 | 5 |
| | | 11252 | | | | | | |
| HBV POL 541 | FPHCLAFSY | 11253 | — | 14 | 83 | 17 | 503 | 3 |
| | FPHCLAF**AL** | 11254 | 25 | 2.7 | 28 | 5.0 | 24 | 5 |
| | FPHCLAFS**L** | 11255 | 74 | 2.4 | 4.5 | 15 | 7.7 | 5 |
| | FP**F**CLAFSY | 11256 | — | 6.5 | 27 | 4.8 | 5.1 | 4 |
| | FPHCLAFS**I** | 11257 | 675 | 29 | 6.3 | 3.8 | 1.0 | 4 |
| | FPHCLAFS**A** | 11258 | 3667 | 6.5 | 250 | 137 | 0.6 | 4 |
| | | 11259 | | | | | | |
| HCV Core 168 | LPGCSFSIF | 11260 | 28 | 90 | 100 | 114 | 6897 | 4 |
| | **F**PGCSFSIF | 11261 | 19 | 1.6 | 132 | 3.2 | 67 | 5 |
| | LP**V**CSFSIF | 11262 | 8.7 | 2.5 | 13 | 2.7 | 5128 | 4 |
| | LPGC**M**FSIF | 11263 | 24 | 28 | 53 | 39 | 2778 | 4 |
| | | 11264 | | | | | | |
| MAGE2 170 | VPISHLYIL | 11265 | 22 | 171 | 96 | 238 | 3175 | 4 |
| | **F**PISHLYIL | 11266 | 16 | 7.3 | 6.4 | 7.0 | 28 | 5 |
| | VPIS**M**LYIL | 11267 | 164 | 273 | 73 | 1075 | 1493 | 3 |
| | VPISHLYI**I** | 11268 | 108 | 5333 | 8.3 | 326 | 91 | |
| | | 11269 | | | | | | |
| MAGE3 196 | MPKAGLLII | 11270 | 940 | 5039 | 393 | 90 | 248 | 3 |
| | **F**PKAGLLII | 11271 | 162 | 1303 | 5.8 | 60 | 150 | 4 |
| | MP**V**AGLLII | 11272 | 86 | 66 | 1.0 | 2.3 | 112 | 5 |
| | MPKA**M**LLII | 11273 | 1528 | — | 5.8 | 186 | 24 | 3 |
| | MP**F**AGLLII | 11274 | 229 | 1.0 | 0.9 | 2.3 | 0.27 | 5 |

TABLE 145

| Peptide | Sequence 1 | 2 | 3 | 4 | 5 | 6 | 7 | 8 | 9 | 10 | 11 | SEQ ID NO | Restriction | Binding Capacity ($IC_{50}$ nM) A3 | A11 | A31 | A*3301 | A*6801 |
|---|---|---|---|---|---|---|---|---|---|---|---|---|---|---|---|---|---|---|
| HBVc 141-151[a] | S | T | L | P | E | T | T | V | V | R | R | 11275 | A31 Aw68 | 33 | 4 | 181 | 181 | 26 |
| HIV nef 73-82[b] | Q | V | P | L | R | P | M | T | Y | K | | 11276 | A3, A11 | 18 | 10 | 1837 | 2164 | 133 |
| MAGE 1 96-104 | S | L | F | R | A | V | I | T | K | | | 11277 | A3, A11 | 3 | 2 | 2483 | 10943 | 113 |
| HIV env 43-52 | T | V | Y | Y | G | V | P | V | W | K | | 11278 | A3, A11 | 11 | 4 | 1636 | 10357 | 15 |
| HCV lorf 1858-1867 | G | V | A | G | A | L | V | A | F | K | | 11279 | A3, A11 | 28 | 4 | 3303 | 27188 | 119 |
| HIV env 42-52 | V | T | V | Y | Y | G | V | P | V | W | K | 11280 | A3, A11 | 85 | 11 | 4615 | 38667 | 172 |
| HBV pol 152-161 | T | L | W | K | A | G | I | L | Y | K | | 11281 | A3, A11 | 2 | 17 | 2927 | 30526 | 533 |

[b]Good binding capacities were defined as <500 nM and are highlighted by shading.

TABLE 146

Discrete substitutions improve the B7 supertype binding capacity and cross-reactivity of peptide ligands. Substitutions relative to the native sequence are shaded.

| Source | 1 | 2 | 3 | 4 | 5 | 6 | 7 | 8 | 9 | SEQ ID NO | Binding ($IC_{50}$ nM) B*0701 | B*3501 | B*5101 | B*5301 | B*5401 | x-rxn |
|---|---|---|---|---|---|---|---|---|---|---|---|---|---|---|---|---|
| HBV ENV 313 | I | P | I | P | S | S | W | A | F | 11282 | 42 | 2.6 | 2.3 | 12 | 2970 | 4 |
| | F | P | I | P | S | S | W | A | F | 11283 | 24 | 1.2 | 305 | 1.7 | 105 | 5 |
| | I | P | I | P | S | S | W | A | I | 11284 | 31 | 54 | 15 | 24 | 7.7 | 5 |
| HBV POL 541 | F | P | H | C | L | A | F | S | Y | 11285 | — | 14 | 83 | 17 | 503 | 3 |
| | F | P | H | C | L | A | F | A | L | 11286 | 25 | 2.7 | 28 | 5.0 | 24 | 5 |
| | F | P | H | C | L | A | F | S | L | 11287 | 74 | 2.4 | 4.5 | 15 | 7.7 | 5 |
| | F | P | F | C | L | A | F | S | Y | 11288 | — | 6.5 | 27 | 4.8 | 5.1 | 4 |
| | F | P | H | C | L | A | F | S | I | 11289 | 675 | 29 | 6.3 | 3.8 | 1.0 | 4 |
| | F | P | H | C | L | A | F | S | A | 11290 | 3667 | 6.5 | 250 | 137 | 0.6 | 4 |
| HCV Core 168 | L | P | G | C | S | F | S | I | F | 11291 | 28 | 90 | 100 | 114 | 6897 | 4 |
| | F | P | G | C | S | F | S | I | F | 11292 | 19 | 1.6 | 132 | 3.2 | 67 | 5 |
| MAGE2 170 | V | P | I | S | H | L | Y | I | L | 11293 | 22 | 171 | 96 | 238 | 3175 | 4 |
| | F | P | I | S | H | L | Y | I | L | 11294 | 16 | 7.3 | 6.4 | 7.0 | 28 | 5 |
| MAGE3 196 | M | P | K | A | G | L | L | I | I | 11295 | 940 | 5039 | 393 | 90 | 248 | 3 |
| | F | P | K | A | G | L | L | I | I | 11296 | 162 | 1303 | 5.8 | 60 | 150 | 4 |
| | M | P | F | A | G | L | L | I | I | 11297 | 229 | 1.0 | 0.9 | 2.3 | 0.27 | 5 |

TABLE 147

Binding activities of analogs of A2.1 motif-bearing peptides. The "(a)" indicates an analogued peptide. Relative binding to A2.1 HLA molecules is shown in the last column. Binding is expressed as a ratio of binding of the test peptide relative to a standard peptide. A higher value for the analog relative to the native sequence indicates an increase in binding affinity of the analog relative to the native sequence. The standard A2.1 peptide (FLPSDYFPSV) binds to A2.1 molecules with an $IC_{50}$ of 5.0. The ratio is converted to $IC_{50}$ by dividing the $IC_{50}$ of the standard peptide, i.e. 5.0, by the ratio shown in the Table.

| SEQUENCE | SEQ ID NO | NO. OF AA | VIRUS | TARGET PROTEIN | POSITION | A2.1 |
|---|---|---|---|---|---|---|
| RVTGGVFLV | 11298 | 9 | HBV | POL | 942 | 0.0041 |
| RLTGGVFLV(a) | 11299 | | | | | 0.14 |

TABLE 147-continued

Binding activities of analogs of A2.1 motif-bearing peptides. The "(a)" indicates an analogued peptide. Relative binding to A2.1 HLA molecules is shown in the last column. Binding is expressed as a ratio of binding of the test peptide relative to a standard peptide. A higher value for the analog relative to the native sequence indicates an increase in binding affinity of the analog relative to the native sequence. The standard A2.1 peptide (FLPSDYFPSV) binds to A2.1 molecules with an $IC_{50}$ of 5.0. The ratio is converted to $IC_{50}$ by dividing the $IC_{50}$ of the standard peptide, i.e. 5.0, by the ratio shown in the Table.

| SEQUENCE | SEQ ID NO | NO. OF AA | VIRUS | TARGET PROTEIN | POSITION | A2.1 |
|---|---|---|---|---|---|---|
| SLDSWWTSL | 11300 | 9 | HBV | ENV | 194 | 0.0023 |
| SLDSWWTSV(a) | 11301 | | | | | 0.10 |
| WILRGTSFV | 11302 | 9 | HBV | POL | 1344 | 0.018 |
| WLLRGTSFV(a) | 11303 | | | | | 0.10 |
| WGLLGFAA | 11304 | 9 | HBV | POL | 1228 | 0.0009 |
| ILGLLGFAV(a) | 11305 | | | | | 0.060 |
| RILTIPQSL | 11306 | 9 | HBV | ENV | 187 | 0.0009 |
| RMLTIPQSV(a) | 11307 | | | | | 0.058 |
| GLCQVFADA | 11308 | 9 | HBV | POL | 1285 | 0.018 |
| GLCAVFADV(a) | 11309 | | | | | 0.030 |
| RVSWPKFAV | 11310 | 9 | HBV | POL | 993 | 0.0028 |
| RLSWPKFAV(a) | 11311 | | | | | 0.0072 |
| SILSPFLPLL | 11312 | 10 | HBV | ENV | 370 | 0.0025 |
| SMLSPFLPLV(a) | 11313 | | | | | 0.97 |
| LVLQAGFFLL | 11314 | 10 | HBV | ENV | 176 | 0.013 |
| LMLQAGFFLV(a) | 11315 | | | | | 0.63 |
| FILLLCLIFL | 11316 | 10 | HBV | ENV | 248 | 0.028 |
| FMLLLCLIFL(a) | 11317 | | | | | 0.045 |
| FVGLSPTVWL | 11318 | 10 | HBV | ENV | 346 | 0.0008 |
| FLGLSPTVWV(a) | 11319 | | | | | 0.030 |
| LVLLDYQGML | 11320 | 10 | HBV | ENV | 258 | 0 |
| LMLLDYQGMV(a) | 11321 | | | | | 0.0087 |
| LVPFVQWFV | 11322 | 9 | HBV adw | ENV | 339 | 0.020 |
| LVPFVQWFA | 11323 | 9 | HBV adr | | | 0.0031 |
| LLPFVQWFV(a) | 11324 | | | | | 0.63 |
| LMPFVQWFV(a) | 11325 | | | | | 0.83 |
| RVTGGVFLV | 11326 | 9 | HBV | POL | 942 | 0.0041 |
| RLTGGVFLV(a) | 11327 | | | | | 0.16 |
| RMTGGVFLV(a) | 11328 | | | | | 0.15 |
| YLHTLWKAGI | 11329 | 10 | HBV | POL | 721 | 0.028 |
| YLHTLWKAGV(a) | 11330 | | | | | 0.15 |
| YMLDLQPET | 11331 | 9 | HPV | E7 | 11 | 1.4 |
| YMLDLQPEV(a) | 11332 | | | | | 1.9 |
| YLLDLQEPV(a) | 11333 | | | | | 0.22 |
| YEFLWGPRA | 11334 | 9 | | MAGE1 | 262 | 0 |
| YMFLWGPRV(a) | 11335 | | | | | 0.22 |
| LVLGTLEEV | 11336 | 9 | | MAGE1 | 38 | 0.032 |
| LMLGTLEEV(a) | 11337 | | | | | 0.13 |
| LLGDNQIMP | 11338 | 9 | | MAGE1 | 182 | 0.0001 |
| LLGDNQIMV(a) | 11339 | | | | | 0.043 |
| WEELSVMEV | 11340 | 9 | | MAGE1 | 215 | 0 |
| WMELSVMEV(a) | 11341 | | | | | 0.041 |
| SLHCKPEEA | 11342 | 9 | | MAGE1 | 7 | 0.013 |
| SMHCKPEEV(a) | 11343 | | | | | 0.018 |
| ALGLVCVQA | 11344 | 9 | | MAGE1 | 22 | 0.015 |
| AMGLVCVQV(a) | 11345 | | | | | 0.012 |
| GLSYDGLLG | 11346 | 9 | | MAGE1 | 176 | 0 |
| GLSYDGLLV(a) | 11347 | | | | | 0.0047 |
| GVWIRTPPA | 11348 | 9 | HBV | CORE | 542 | 0.0030 |
| GLWIRTPPV(a) | 11349 | | | | | 0.36 |
| YVPSALNPA | 11350 | 9 | HBV | POL | 1371 | 0.0039 |
| YLPSALNPV(a) | 11351 | | | | | 0.32 |

TABLE 148

A2.1: POOL SEQUENCING FREQUENCY

| | pos. 1 | pos. 2 | pos. 3 | pos. 4 | pos. 5 | pos. 6 | pos. 7 | pos. 8 | pos. 9 | pos. 10 |
|---|---|---|---|---|---|---|---|---|---|---|
| A | — | 0.65 | 1.25 | 0.85 | 0.95 | 0.77 | 1.21 | 1.16 | 1.15 | 1.25 |
| G | — | 0.84 | 0.96 | 1.29 | 1.22 | 0.89 | 0.78 | 1.05 | 0.98 | 1.48 |
| D | — | 0.84 | 1.11 | 1.70 | 1.03 | 0.83 | 0.82 | 0.84 | 0.82 | 1.19 |
| E | — | 0.38 | 0.59 | 1.73 | 1.10 | 0.82 | 1.05 | 1.45 | 0.87 | 0.88 |
| R | — | — | — | — | — | — | — | — | — | — |
| H | — | — | — | — | — | — | — | — | — | — |
| K | — | 0.63 | 0.65 | 0.89 | 1.66 | 1.09 | 0.89 | 1.35 | 0.82 | 0.87 |
| L | — | 2.66* | 1.11 | 0.45 | 0.57 | 1.00 | 0.69 | 0.59 | 0.92 | 0.77 |
| V | — | 0.78 | 0.69 | 0.60 | 0.79 | 1.38 | 1.24 | 0.84 | 1.69 | 1.27 |
| I | — | 1.06 | 1.20 | 0.53 | 0.93 | 1.49 | 1.15 | 0.76 | 0.88 | 0.54 |
| M | — | 1.93 | 1.91 | 0.62 | 0.71 | 0.68 | 0.88 | 0.54 | 0.73 | 0.22 |
| Y | — | 0.28 | 1.41 | 0.65 | 1.32 | 0.78 | 1.34 | 1.21 | 1.00 | 0.79 |
| F | — | 0.76 | 1.46 | 0.69 | 1.16 | 1.0 | 1.07 | 1.09 | 0.78 | 0.73 |
| W | — | — | — | — | — | — | — | — | — | — |
| Q | — | 0.60 | 0.84 | 0.92 | 0.95 | 0.90 | 1.16 | 1.63 | 1.00 | 1.00 |
| N | — | 0.39 | 0.76 | 1.17 | 1.28 | 1.08 | 1.07 | 1.28 | 0.96 | 0.42 |
| S | — | 1.13 | 1.50 | 1.33 | 0.87 | 0.77 | 0.71 | 0.92 | 0.77 | 0.58 |
| T | — | 0.62 | 0.90 | 0.94 | 0.95 | 1.21 | 1.07 | 1.60 | 0.71 | 0.57 |
| C | — | — | — | — | — | — | — | — | — | — |
| P | — | 0.54 | 0.78 | 1.44 | 1.15 | 1.09 | 1.30 | 0.87 | 0.81 | 1.01 |

*

TABLE 149

| SEQ ID NO | AA | Sequence | Source |
|---|---|---|---|
| 11352 | 9 | FLYNRPLSV | TSA-1 641 |
| 11353 | 9 | VLLPSLFLL | TSA-1 818 |
| 11354 | 9 | LLPSLFLLL | TSA-1 819 |
| 11355 | 9 | FVDYNFTIV | TSA-1 514 |
| 11356 | 9 | KLFPEVIDL | TSA-1 89 |
| 11357 | 10 | FLLLGLWGFA | TSA-1 824 |
| 11358 | 10 | VLLPSLFLLL | TSA-1 818 |
| 11359 | 10 | LLYSDDALHL | TSA-1 398 |
| 11360 | 9 | AIYHPQQFV | MT 32k 178 |
| 11361 | 9 | AMKADIQHV | MT 85c 317 |
| 11362 | 9 | AMLQDMAIL | MT 65k 285 |
| 11363 | 9 | DMWEHAFYL | MT superoxide dismutase 160 |
| 11364 | 9 | GLFLTTEAV | MT 65k 509 |
| 11365 | 9 | ILFTFLHLA | MT alanine dehydrogenase 92 |
| 11366 | 9 | KLAGGVAVI | MT 65k 369 |
| 11367 | 9 | LMIGTAAAV | MT 85B 15 |
| 11368 | 9 | MLQDMAILT | MT 65k 286 |
| 11369 | 9 | RLMIGTAAA | MT 85B 14 |
| 11370 | 9 | RLVSGLVGA | MT 32k 25 |
| 11371 | 9 | RMPAVTDLV | MT 70k 318 |
| 11372 | 9 | SLLEIGEGV | MT 70k 179 |
| 11373 | 9 | VLLLDVTPL | MT 70k 363 |
| 11374 | 9 | YTYKWETFL | MT 85c 137 |
| 11375 | 9 | ALINDQLIM | Lassa gp 343 |
| 11376 | 9 | AMLQLDPNA | Lassa Josiah(NP) 376 |
| 11377 | 9 | FVFSTSFYL | Lassa gp 434 |
| 11378 | 9 | GLTSAVIDA | Lassa Josiah(NP) 444 |
| 11379 | 9 | GLVGLVTFL | Lassa Josiah(GP) |
| 11380 | 9 | IISTFHLSI | Lassa gp 136 |
| 11381 | 9 | ILAADLEKL | Lassa np 101 |
| 11382 | 9 | IMTSYQYLI | Lassa gp 213 |
| 11383 | 9 | LIALSVLAV | Lassa Josiah(GP) 23 |
| 11384 | 9 | LISIFLHLV | Lassa gp 442 |

TABLE 149-continued

| SEQ ID NO | AA | Sequence | Source |
|---|---|---|---|
| 11385 | 9 | LLGTFTWTL | Lassa gp 258 |
| 11386 | 9 | LMDCIMFDA | Lassa np 531 |
| 11387 | 9 | LTYSQLMTL | Lassa np 365 |
| 11388 | 9 | MAWGGSYIA | Lassa gp 194 |
| 11389 | 9 | NISGYNFSL | Lassa np 240 |
| 11390 | 9 | RLFDFNKQA | Lassa gp 314 |
| 11391 | 9 | RLLGTFTWT | Lassa gp 257 |
| 11392 | 9 | RLRDLNQAV | Lassa np 66 |
| 11393 | 9 | RMAWGGSYI | Lassa gp 193 |
| 11394 | 9 | STSFYLISI | Lassa gp 437 |
| 11395 | 9 | VLIALSVLA | Lassa Josiah(GP) 22 |
| 11396 | 9 | YLISIFLHL | Lassa gp 441 |
| 11397 | 10 | ALYLLDGLRA | MT 32k 77 |
| 11398 | 10 | AVHDTLFYCV | MT alanine dehydrogenase 291 |
| 11399 | 10 | GLFLTTEAVV | MT 65k 509 |
| 11400 | 10 | LLAAGVADPV | MT 65k 485 |
| 11401 | 10 | LLGSFELTGI | MT 70k 427 |
| 11402 | 10 | LLLDVTPLSL | MT 70k 364 |
| 11403 | 10 | LMIGTAAAVV | MT 85B 15 |
| 11404 | 10 | RIANGMGATV | MT alanine dehydrogenase 187 |
| 11405 | 10 | SLLEIGEGVV | MT 70k 179 |
| 11406 | 10 | ALMDCIMFDA | Lassa np 530 |
| 11407 | 10 | GLVGLVTFLL | Lassa Josiah(GP) 42 |
| 11408 | 10 | GLYKQPGVPV | Lassa gp 478 |
| 11409 | 10 | GLYNFATCGL | Lassa Josiah(GP) 34 |
| 11410 | 10 | LLHGLDFSEV | Lassa np 38 |
| 11411 | 10 | LMSIISTFHL | Lassa gp 133 |
| 11412 | 10 | NLYDHALMSI | Lassa Josiah(GP) 127 |
| 11413 | 10 | RLLGTFTWTL | Lassa gp 257 |
| 11414 | 10 | VLIALSVLAV | Lassa Josiah(GP) 22 |
| 11415 | 10 | YLISIFLHLV | Lassa gp 441 |
| 11416 | 9 | LLDEGKQSL | MT Esat6 28 |
| 11417 | 9 | LMTFWNPPV | CEA 24 (a) |

TABLE 149-continued

| SEQ ID NO | AA | Sequence | Source |
|---|---|---|---|
| 11418 | 9 | VLYGPDTPV | CEA 589 (a) |
| 11419 | 9 | LLTFWNPPV | CEA 24 (a) |
| 11420 | 10 | VLYGPDAPTV | CEA 233 (a) |
| 11421 | 9 | KLSEYLQLV | MAGE 2 |
| 11422 | 11 | LLPENNVLSPL | p53 25□35 |
| 11423 | 9 | RMPEAAPPV | p53 65□73 |
| 11424 | 11 | GLAPPQHLIRV | p53 187□197 |
| 11425 | 10 | NLLGRNSFEV | p53 263□272 |
| 11426 | 9 | LLGRNSFEV | p53 264□272 |
| 11427 | 9 | SLYKGVYEL | Lassa Josiah (gp) 60 |

TABLE 151-continued

| Sequence | Source | SEQ ID NO |
|---|---|---|
| LVGPTPVNI | POL.156 | 11441 |
| AIIRILQQL | VPR.59 | 11442 |
| KMIGGIGGFI | POL.125 | 11443 |
| MTNNPPIPV | GAG.282 | 11444 |
| TLNFPISPI | POL.176 | 11445 |
| KAACWWAGI | POL.869 | 11446 |
| RAMASDFNL | POL.762 | 11447 |
| RILQQLLFI | VPR.62 | 11448 |

TABLE 150

A2.1: BINDING OF ANALOGS OF A MOTIF-CONTAINING POLY A PEPTIDE

| | pos. 1 A | pos. 2 L | pos. 3 A | pos. 4 K | pos. 5 A | pos. 6 A | pos. 7 A | pos. 8 A | pos. 9 V |
|---|---|---|---|---|---|---|---|---|---|
| A | 1.00 | 0.013 | 1.00 | | 1.00 | 1.00 | 1.00 | 1.00 | 0.070 |
| G | 0.46 | —* | | | 0.63 | 0.12 | | 0.57 | |
| D | — | — | 0.93 | 0.74 | 0.51 | 0.10 | | | |
| E | 0.012 | | 0.68 | 1.53 | 0.62 | 0.15 | 0.28 | 0.26 | |
| R | | | | | | 0.080 | | | |
| H | | | | | | | | 0.24 | |
| K | 0.54 | — | 0.062 | 1.00 | 0.39 | | 0.50 | 0.11 | |
| L | | 1.00 | 0.46 | | 0.99 | | 0.76 | 0.90 | 0.11 |
| V | 0.47 | 0.051 | 0.15 | 1.12 | | 0.44 | 0.49 | 0.30 | 1.00 |
| I | 0.41 | 0.063 | | | | 1.12 | | | 0.18 |
| M | | 0.43 | 0.66 | | | | | | 0.024 |
| Y | 0.75 | | 0.62 | | 0.94 | 0.41 | 1.40 | 0.43 | — |
| F | 1.10 | — | 0.95 | | | 1.76 | | 0.49 | |
| W | | | | | | | | | |
| Q | | | | | 0.32 | | 0.19 | 0.41 | |
| N | | — | 0.34 | | 1.24 | | 0.97 | 0.31 | — |
| S | 0.44 | — | 0.37 | 0.97 | | | | | |
| T | 0.26 | 0.011 | | 0.98 | | | 0.28 | 0.37 | — |
| C | | — | | 1.53 | | 0.84 | | | |
| P | — | — | 0.25 | 1.07 | | 0.84 | 0.63 | 0.55 | |

[shaded box] Ratio ≤0.1

* Ratio ≤0.01

TABLE 151

| Sequence | Source | SEQ ID NO |
|---|---|---|
| HBV | | |
| YMDDVVLGV | POL.538 | 11428 |
| HCV | | |
| LLFLLLADA | NS1/E2.726 | 11429 |
| VLVGGVLAA | NS4.1666 | 11430 |
| HMWNFISGI | NS4.1769 | 11431 |
| WMNRLIAFA | NS4.1920 | 11432 |
| HIV1 | | |
| YTAFTIPSI | POL.306 | 11433 |
| LTFGWCFKLV | NEF.158 | 11434 |
| MASDFNLPPV | POL.764 | 11435 |
| CTLNFPISPI | POL.175 | 11436 |
| KLVGKLNWA | POL.438 | 11437 |
| LLQLTVWGI | ENV.731 | 11438 |
| LTFGWCFKL | NEF.158 | 11439 |
| ALVEICTEM | POL.212 | 11440 |

TABLE 151-continued

| Sequence | Source | SEQ ID NO |
|---|---|---|
| Her2/neu | | |
| SIISAVVGI | Her2/neu.653 | 11449 |
| QLFEDNYALA | Her2/neu.106 | 11450 |
| CEA | | |
| YLWWVNNQSL | CEA.354 | 11451 |
| IMIGVLVGV | CEA.691 | 11452 |
| GIMIGVLVGV | CEA.690 | 11453 |
| YLWWVNGQSL | CEA.532 | 11454 |
| VLYGPDAPTI | CEA.233 | 11455 |
| IMIGVLVGVA | CEA.691 | 11456 |
| YLSGANLNL | CEA.605 | 11457 |

TABLE 152

| Peptide | AA | Sequence | SEQ ID NO | Antigen | Protein or Molecule | 1st Position | A*0201 |
|---|---|---|---|---|---|---|---|
| 1317.02 | 8 | ALPPVAPV | 11458 | p53 | | 69 | 0.0230 |
| 1317.11 | 11 | LLPENNVLSPV | 11459 | p53 | | 25 | 0.1300 |
| F136.02 | 9 | SLYNTITVL | 11460 | HIV | gag | 77 | 0.0330 |
| F136.03 | 9 | SLYNTISVL | 11461 | HIV | gag | 77 | 0.0190 |
| F136.04 | 9 | SLYNTVSTL | 11462 | HIV | gag | 77 | 0.0320 |
| 32.0005 | 9 | AIYGRPVSA | 11463 | KSHV | | 508 | 0.0560 |
| 32.0006 | 9 | ALIGTMCGI | 11464 | KSHV | | 237 | 0.1500 |
| 32.0008 | 9 | ATLGTVILL | 11465 | KSHV | | 8 | 0.0280 |
| 32.0016 | 9 | FIALNLSFI | 11466 | KSHV | | 624 | 0.0640 |
| 32.0017 | 9 | FIQNIDFKA | 11467 | KSHV | | 631 | 0.1400 |
| 32.0019 | 9 | FLNSSNLFT | 11468 | KSHV | | 560 | 0.0780 |
| 32.0021 | 9 | FLYVVCSLA | 11469 | KSHV | | 2 | 1.1000 |
| 32.0022 | 9 | FVAVHVPDV | 11470 | KSHV | | 8 | 0.2600 |
| 32.0027 | 9 | GILGTIIFA | 11471 | KSHV | | 244 | 0.0270 |
| 32.0033 | 9 | HLDFWHHEV | 11472 | KSHV | | 168 | 0.2400 |
| 32.0042 | 9 | ITATFTAPL | 11473 | KSHV | | 342 | 0.1300 |
| 32.005 | 9 | LLGTWMFSV | 11474 | KSHV | | 53 | 1.5000 |
| 32.0053 | 9 | LMWYELSKI | 11475 | KSHV | | 492 | 0.0670 |
| 32.006 | 9 | MIIIVIAII | 11476 | KSHV | | 738 | 0.0150 |
| 32.0066 | 9 | NLLDRLLLI | 11477 | KSHV | | 77 | 0.0290 |
| 32.0073 | 9 | RIFYNILEI | 11478 | KSHV | | 20 | 0.0800 |
| 32.0074 | 9 | RLASSVFDL | 11479 | KSHV | | 649 | 0.0670 |
| 32.0076 | 9 | RLGAIPPLV | 11480 | KSHV | | 24 | 0.0150 |
| 32.0078 | 9 | RLYQASAVM | 11481 | KSHV | | 4 | 0.0180 |
| 32.0081 | 9 | SILGCDVSV | 11482 | KSHV | | 226 | 0.0430 |
| 32.0087 | 9 | SVDFYQFRV | 11483 | KSHV | | 59 | 0.0160 |
| 32.0088 | 9 | SVSDFDLRI | 11484 | KSHV | | 245 | 0.0120 |
| 32.009 | 9 | TLGTVILLV | 11485 | KSHV | | 9 | 0.0830 |
| 32.0099 | 9 | YLVWQPMSA | 11486 | KSHV | | 398 | 0.0130 |
| 32.0114 | 10 | AAVEQILTSV | 11487 | KSHV | | 237 | 0.0210 |
| 32.0118 | 10 | ALIGTMCGIL | 11488 | KSHV | | 237 | 0.0120 |
| 32.012 | 10 | ATLGTVILLV | 11489 | KSHV | | 8 | 0.0690 |
| 32.0124 | 10 | FLYVVCSLAV | 11490 | KSHV | | 2 | 0.2400 |
| 32.0127 | 10 | GALPICSFVV | 11491 | KSHV | | 27 | 0.0160 |
| 32.0137 | 10 | KLLGTVVMFSV | 11492 | KSHV | | 52 | 1.6000 |
| 32.0148 | 10 | QLASILGCDV | 11493 | KSHV | | 223 | 0.0160 |
| 32.015 | 10 | RLSNRICFWA | 11494 | KSHV | | 164 | 0.0130 |
| 32.0154 | 10 | SLVTGFINFI | 11495 | KSHV | | 720 | 0.0210 |
| 32.0159 | 10 | VLATDVTSFL | 11496 | KSHV | | 149 | 0.0190 |
| 32.016 | 10 | VLLNGWRWRL | 11497 | KSHV | | 16 | 0.2800 |
| 32.0164 | 10 | YLVWQPMSAI | 11498 | KSHV | | 398 | 0.0230 |
| 34.0006 | 8 | QLAKTCPV | 11499 | p53 | | 136 | 0.0110 |
| 34.0132 | 9 | ALBRWGLLV | 11500 | HER2/neu | | 5 | 0.0960 |
| 34.0133 | 9 | ALCRWGLLV | 11501 | HER2/neu | | 5 | 0.0360 |
| 34.0134 | 9 | AMCRWGLLV | 11502 | HER2/neu | | 5 | 0.0280 |
| 34.0135 | 9 | KLFGSLAFL | 11503 | HER2/neu | | 369 | 0.1200 |
| 34.0136 | 9 | KLFGSLAFV | 11504 | HER2/neu | | 369 | 0.0900 |
| 34.0137 | 9 | KMFGSLAFL | 11505 | HER2/neu | | 369 | 0.2000 |
| 34.0138 | 9 | KMFGSLAFV | 11506 | HER2/neu | | 369 | 0.1200 |
| 34.014 | 9 | KMFBQLAKV | 11507 | p53 | | 132 | 0.0980 |
| 34.0141 | 9 | KMFCQLAKV | 11508 | p53 | | 132 | 0.0400 |
| 34.0199 | 10 | RMPEAAPPVV | 11509 | p53 | | 65 | 0.0340 |

TABLE 152-continued

| Peptide | AA | Sequence | SEQ ID NO | Antigen | Protein or Molecule | 1st Position | A*0201 |
|---|---|---|---|---|---|---|---|
| 34.0201 | 10 | ALNKMFCQLV | 11510 | p53 | | 129 | 0.0240 |
| 35.0031 | 9 | VLLVSLGAI | 11511 | Flu | HEMA | 542 | 0.0170 |
| 35.0034 | 9 | LLTEVETPI | 11512 | Flu | VMT2 | 3 | 0.2100 |
| 35.0036 | 9 | RLIQNSLTI | 11513 | Flu | VNUC | 55 | 0.0300 |
| 35.004 | 9 | KMNIQFTAV | 11514 | Flu | HEMA | 402 | 0.0330 |
| 35.0046 | 10 | GLFGAIAGFI | 11515 | Flu | HEMA | 345 | 0.0451 |
| 35.0047 | 10 | KLESMGIYQI | 11516 | Flu | HEMA | 521 | 0.0120 |
| 35.0048 | 10 | SLPFQNIHPV | 11517 | Flu | HEMA | 306 | 0.0520 |
| 37.0013 | 8 | ALPPVAPV | 11518 | p53 | | 69 | 0.0500 |
| 37.0015 | 9 | ALNKMFCQV | 11519 | p53 | | 129 | 0.0770 |
| 37.0017 | 9 | KLFCQLAKV | 11520 | p53 | | 132 | 0.0640 |
| 37.0018 | 9 | KLCPVQLWV | 11521 | p53 | | 139 | 0.0440 |
| 37.0019 | 9 | CLTIHYNYV | 11522 | p53 | | 229 | 0.0110 |
| 37.0032 | 10 | ALNKMFCQLV | 11523 | p53 | | 129 | 0.0150 |
| 37.0033 | 10 | VLVPYEPPEV | 11524 | p53 | | 216 | 0.1100 |
| 37.0034 | 10 | RLPEAAPPW | 11525 | p53 | | 65 | 0.0350 |
| 37.0035 | 10 | LLPPQHLIRV | 11526 | p53 | | 188 | 0.0120 |
| 37.0069 | 11 | ILLEDSSGNLV | 11527 | p53 | | 255 | 0.0590 |
| F124.03 | 10 | KLVALGINAV | 11528 | HCV | NS3 | 1406 | 0.0110 |
| F124.04 | 9 | SLMAFTAAV | 11529 | HCV | NS4 | 1789 | 0.1900 |
| F124.06 | 9 | CINGVCWTV | 11530 | HCV | NS3 | 1073 | 0.0910 |
| F124.08 | 9 | TISGVLWQV | 11531 | HCV | NS3 | 1073 | 0.1400 |
| F124.09 | 9 | SISGVLWQV | 11532 | HCV | NS3 | 1073 | 0.1400 |
| F124.10 | 9 | SLMAFTASV | 11533 | HCV | NS4 | 1789 | 0.1200 |
| F124.11 | 9 | GLRDCTMLV | 11534 | HCV | NS5 | 2727 | 0.0120 |
| F124.12 | 10 | KLVALGVNAV | 11535 | HCV | NS3 | 1406 | 0.0200 |
| F124.14 | 10 | KLSGLGLNAV | 11536 | HCV | NS3 | 1406 | 0.0170 |
| F124.23 | 10 | KLVSLGVNAV | 11537 | HCV | NS3 | 1406 | 0.0150 |
| F127.03 | 10 | LLALLSCLTV | 11538 | HCV | Core | 178 | 0.0240 |
| F127.06 | 9 | LLCPAGHAV | 11539 | HCV | NS3 | 1169 | 0.0140 |
| F127.07 | 10 | KLVALGINAV | 11540 | HCV | NS3 | 1406 | 0.0700 |
| F127.08 | 9 | SLMAFTAAV | 11541 | HCV | NS4 | 1789 | 6.5000 |
| F127.09 | 9 | LLFNILGWV | 11542 | HCV | NS4 | 1807 | 1.7000 |

TABLE 153

| Summary A2.1 Poly-A | | | |
|---|---|---|---|
| AA position | (+) | (+/−) | (−) |
| 1 | FAYKVGSIT | | EDP |
| 2 | LM | VITA | SNDFCKGP |
| 3 | AFDEMYLSNPV | K | |
| 4 | CEVPATSD | | |
| 5 | NALYGEDKQ | | |
| 6 | FIAPCVYEG | DR | |
| 7 | YANLPVETQ | | |
| 8 | ALGPFYQTNVEHK | | |
| 9 | VIL | AM | TCNFY |

Ratio > 0.1
Ratio 0.01-0.1
Ratio < 0.01

TABLE 154

| A2.1 9-mer PEPTIDES | | |
|---|---|---|
| NUMBER OF PEPTIDES | 161 | |
| GOOD BINDERS | 19 | 11.8% |
| INTERMEDIATE BINDERS | 36 | 22.4% |
| WEAK BINDERS | 58 | 36.0% |
| NON-BINDERS | 48 | 29.8% |

TABLE 154-continued

A2.1 9-mer PEPTIDES

| | 1+ | 1− | 2+ | 2− | 3+ | 3− | 4+ | 4− | 5+ |
|---|---|---|---|---|---|---|---|---|---|
| A | 5.5 | 2.1 | 0.0 | 0.0 | 3.6 | 4.2 | 5.6 | 8.3 | 5.5 |
| G | 7.3 | 2.1 | 0.0 | 0.0 | 3.6 | 8.3 | 9.1 | 8.3 | 9.1 |
| D,E | 3.6 | 35.4 | 0.0 | 0.0 | 3.6 | 8.3 | 9.1 | 8.3 | 9.1 |
| R, H, K | 12.7 | 4.2 | 0.0 | 0.0 | 3.6 | 16.7 | 16.4 | 16.7 | 9.1 |
| L, V, I, M | 38.2 | 12.5 | 100.0 | 100.0 | 34.5 | 18.8 | 9.1 | 16.7 | 25.5 |
| Y, F, W | 14.5 | 2.1 | 0.0 | 0.0 | 21.8 | 4.2 | 7.3 | 8.3 | 18.2 |
| Q, N | 7.3 | 14.8 | 0.0 | 0.0 | 5.5 | 14.6 | 12.7 | 10.4 | 9.1 |
| S, T, C | 9.1 | 12.5 | 0.0 | 0.0 | 20.5 | 10.4 | 20.0 | 4.2 | 14.5 |
| P | 1.8 | 14.6 | 0.0 | 0.0 | 7.3 | 10.4 | 9.1 | 12.5 | 5.5 |
| | 100.0 | 100.0 | 100.0 | 100.0 | 100.0 | 100.0 | 100.0 | 100.0 | 100.0 |

| A | 5− | 6+ | 6− | 7+ | 7− | 8+ | 8− | 9+ | 9− |
|---|---|---|---|---|---|---|---|---|---|
| G | 8.3 | 5.5 | 6.3 | 9.1 | 2.1 | 3.6 | 12.5 | 0.0 | 0.0 |
| D,E | 8.3 | 10.9 | 8.3 | 5.5 | 12.5 | 3.6 | 8.3 | 0.0 | 0.0 |
| R, H, K | 8.3 | 10.9 | 8.3 | 5.5 | 12.5 | 3.6 | 8.3 | 0.0 | 0.0 |
| L, V, I, | 10.4 | 1.8 | 20.8 | 0.0 | 10.4 | 16.4 | 12.5 | 0.0 | 0.0 |
| M | 29.2 | 30.9 | 22.9 | 30.9 | 25.0 | 32.7 | 18.8 | 100.0 | 100.0 |
| Y, F, W | | | | | | | | | |
| Q, N | 2.1 | 16.4 | 8.3 | 14.5 | 8.3 | 5.5 | 8.3 | 0.0 | 0.0 |
| S, T, C | 10.4 | 10.9 | 10.4 | 5.5 | 8.3 | 5.5 | 16.7 | 0.0 | 0.0 |
| P | 16.7 | 14.5 | 12.5 | 14.5 | 12.5 | 20.0 | 18.8 | 0.0 | 0.0 |
| | 2.1 | 3.6 | 2.1 | 18.2 | 6.3 | 3.6 | 0.0 | 0.0 | 0.0 |
| | 100.0 | 100.0 | 100.0 | 100.0 | 100.0 | 100.0 | 100.0 | 100.0 | 100.0 |

TABLE 155

| A2.1 9-mer PEPTIDES | | |
|---|---|---|
| NUMBER OF PEPTIDES | 161 | |
| GOOD BINDERS | 19 | 11.8% |
| INTERMEDIATE BINDERS | 36 | 22.4% |
| WEAK BINDERS | 58 | 36.0% |
| NON-BINDERS | 48 | 29.8% |

| | pos. 1 ratio | pos. 2 ratio | pos. 3 ratio | pos. 4 ratio | pos. 5 ratio | pos. 6 ratio | pos. 7 ratio | pos. 8 ratio | pos. 9 ratio |
|---|---|---|---|---|---|---|---|---|---|
| A | 2.6 | NA | 0.9 | 0.9 | 0.7 | 0.9 | 4.4 | 0.3 | NA |
| G | 3.5 | NA | 0.4 | 1.1 | 1.1 | 1.3 | 0.4 | 0.4 | NA |
| D, E | 0.1 | NA | 0.0 | 0.7 | 0.3 | 0.7 | 0.1 | 0.9 | NA |
| R, H, K | 3.1 | NA | 0.2 | 1.0 | 0.9 | 0.1 | 0.0 | 1.3 | NA |
| L, V, I, M | 3.1 | 1.0 | 1.8 | 0.5 | 0.9 | 1.3 | 1.2 | 1.7 | 1.0 |
| Y, F, W | 7.0 | NA | 5.2 | 0.9 | 8.7 | 2.0 | 2.3 | 2.6 | NA |
| Q, N | 0.5 | NA | 0.4 | 1.2 | 0.9 | 1.0 | 0.7 | 0.3 | NA |
| S, T, C | 0.7 | NA | 1.9 | 4.8 | 0.9 | 1.2 | 1.2 | 1.1 | NA |
| P | 0.1 | NA | 0.7 | 0.7 | 2.6 | 1.7 | 2.9 | +++ | NA |

TABLE 156

Summary of A2.1 Motif-Library, 9-mers

| AA POSITION | (+) | (−) |
|---|---|---|
| 1 | (YFW) | P, (DE) |
| 2 | Anchor | |
| 3 | (YFW) | (DE), (RKH) |
| 4 | (STC) | |
| 5 | (YFW) | |
| 6 | | (RKH) |
| 7 | A | (RKH), (DE) |
| 8 | | |
| 9 | Anchor | |

(+) = Ratio ≥ 4-fold (−) = Ratio ≤ 0.25

TABLE 157

A2.1 MOTIF FOR 9-MER PEPTIDES

| AA position | (+) | (-) |
|---|---|---|
| 1 | | acidic amino-acids and P |
| 2 | Anchor: L, M, (I, V, A, T) | |
| 3 | | acidic and basic amino-acids |
| 4 | | |
| 5 | | |
| 6 | | basic amino-acids |
| 7 | | acidic and basic amino-acids |
| 8 | | |
| 9 | Anchor: V, I, L (A, M) | |

TABLE 158

| A2.1 naturally processed peptides | | | | | | | | | | |
|---|---|---|---|---|---|---|---|---|---|---|
| 1 | 2 | 3 | 4 | 5 | 6 | 7 | 8 | 9 | SEQ ID NO | A2.1 Binding |
| A | L | X | G | G | X | V | N | V | 11543 | ND |
| L | L | D | V | P | T | A | A | V | 11544 | ND |
| G | X | V | P | F | X | V | S | V | 11545 | 0.41 |
| S | L | L | P | A | I | V | E | L | 11546 | 0.19 |
| S | X | X | V | R | A | X | E | V | 11547 | ND |
| Y | M | N | G | T | M | S | Q | V | 11548 | ND |
| K | X | N | E | P | V | X | X | X | 11549 | ND |
| Y | L | L | P | A | I | V | H | I | 11550 | 0.26 |
| A | X | W | G | F | F | P | V | X | 11551 | ND |
| T | L | W | V | D | P | Y | E | V | 11552 | 0.23 |
| G | X | V | P | F | X | V | S | V | 11553 | 0.41 |

TABLE 159

| A2.1 10-mer PEPTIDES | | |
|---|---|---|
| NUMBER OF PEPTIDES | 170 | |
| GOOD BINDERS | 10 | 5.9% |
| INTERMEDIATE BINDERS | 29 | 17.1% |
| WEAK BINDERS | 70 | 41.2% |
| NON-BINDERS | 61 | 35.9% |

| | 1+ | 1− | 2+ | 2− | 3+ | 3− | 4+ | 4− | 5+ | 5− |
|---|---|---|---|---|---|---|---|---|---|---|
| A | 2.6 | 0.0 | 0.0 | 0.0 | 10.3 | 3.3 | 2.6 | 11.5 | 5.1 | 3.3 |
| G | 7.7 | 9.8 | 0.0 | 0.0 | 7.7 | 16.4 | 15.4 | 3.3 | 5.1 | 6.6 |
| D,E | 0.0 | 23.0 | 0.0 | 0.0 | 2.6 | 16.4 | 7.7 | 13.1 | 2.6 | 9.8 |
| R, H, K | 7.7 | 6.6 | 0.0 | 0.0 | 5.1 | 16.4 | 2.8 | 16.0 | 10.3 | 14.8 |
| L, V, I, M | 48.7 | 16.4 | 100.0 | 100.0 | 33.3 | 3.3 | 23.1 | 23.0 | 30.8 | 24.6 |
| Y, F, W | 12.8 | 0.0 | 0.0 | 0.0 | 12.6 | 4.9 | 15.4 | 4.9 | 17.9 | 4.9 |
| Q, N | 10.3 | 9.6 | 0.0 | 0.0 | 7.7 | 8.2 | 7.7 | 9.8 | 7.7 | 9.8 |
| S, T, C | 10.3 | 11.5 | 0.0 | 0.0 | 15.4 | 18.0 | 12.6 | 11.5 | 20.5 | 19.7 |
| P | 0.0 | 23.0 | 0.0 | 0.0 | 5.1 | 13.1 | 12.6 | 4.9 | 0.0 | 6.6 |
| | 100.0 | 100.0 | 100.0 | 100.0 | 100.0 | 100.0 | 100.0 | 100.0 | 100.0 | 100.0 |

| | 6+ | 6− | 7+ | 7− | 8+ | 8− | 9+ | 9− | 10+ | 10− |
|---|---|---|---|---|---|---|---|---|---|---|
| A | 7.7 | 13.1 | 10.3 | 8.2 | 7.7 | 4.9 | 2.6 | 4.9 | 0.0 | 0.0 |
| G | 10.3 | 1.6 | 17.9 | 6.6 | 7.7 | 11,5 | .7 | 9.8 | 0.0 | 0.0 |
| D,E | 10.3 | 9.6 | 5.1 | 15.4 | 0.0 | 16.4 | 5.1 | 13.1 | 0.0 | 0.0 |
| R, H, K | 7.7 | 19.7 | 2.6 | 14.8 | 0.0 | 29.5 | 2.6 | 16.4 | 0.0 | 0.0 |
| L, V, I, M | 30.8 | 14.5 | 25.5 | 18.0 | 23.1 | 4.9 | 12.8 | 16.4 | 100.0 | 100.0 |
| Y, F, W | 7.7 | 13.1 | 12.8 | 6.2 | 23.1 | 1.6 | 20.5 | 9.6 | 0.0 | 0.0 |
| Q, N | 2.6 | 3.3 | 5.1 | 8.2 | 2.6 | 6.6 | 7.7 | 11.5 | 0.0 | 0.0 |
| S, T, C | 17.9 | 19.7 | 17.9 | 13.1 | 20.5 | 16.4 | 33.3 | 11.5 | 0.0 | 0.0 |
| P | 5.1 | 4.9 | 2.6 | 5.6 | 15.4 | 8.2 | 7.7 | 6.6 | 0.0 | 0.0 |
| | 100.0 | 100.0 | 100.0 | 100.0 | 100.0 | 100.0 | 100.0 | 100.0 | 100.0 | 100.0 |

TABLE 160

| A2.1 10-mer PEPTIDES | | |
|---|---|---|
| NUMBER OF PEPTIDES | 170 | |
| GOOD BINDERS | 10 | 5.9% |
| INTERMEDIATE BINDERS29 | 17.1% | |
| WEAK BINDERS | 70 | 41.2% |
| NON-BINDERS | 61 | 35.9% |

| | pos. 1 ratio | pos. 2 ratio | pos. 3 ratio | pos. 4 ratio | pos. 5 ratio | pos. 6 ratio | pos.7 ratio | pos. 8 ratio | pos. 9 ratio | pos. 10 ratio |
|---|---|---|---|---|---|---|---|---|---|---|
| A | +++ | NA | 3.1 | 0.2 | 1.8 | 0.6 | 1.3 | 1.6 | 0.5 | NA |
| G | 0.8 | NA | 0.5 | 4.7 | 0.8 | 6.3 | 2.7 | 0.7 | 0.8 | NA |
| D, E | 0.0 | NA | 0.2 | 0.6 | 0.3 | 1.0 | 0.3 | 0.0 | 0.4 | NA |
| R, H, K | 1.2 | NA | 0.3 | 0.1 | 0.7 | 0.4 | 0.2 | 0.0 | 0.2 | NA |
| L, V, I, M | 3.0 | 1.0 | 10.2 | 1.0 | 1.3 | 2.1 | 1.4 | 4.7 | 0.8 | 1.0 |
| Y, F, W | +++ | NA | 2.6 | 3.1 | 3.6 | 0.6 | 1.6 | 14.1 | 2.1 | NA |
| Q, N | 1.0 | NA | 0.9 | 0.8 | 0.8 | 0.8 | 0.6 | 0.4 | 0.7 | NA |
| S, T, C | 0.9 | NA | 0.9 | 1.1 | 1.0 | 0.9 | 1.4 | 1.3 | 2.9 | NA |
| P | 0.0 | NA | 0.4 | 2.6 | 0.0 | 1.0 | 0.4 | 1.9 | 1.2 | NA |

TABLE 161

| Summary of A2.1 Motif-Library 10-mers | | |
|---|---|---|
| AA position | (+) | (−) |
| 1 | (Y, F, W), A | (D, E), P |
| 2 | Anchor | |
| 3 | (L, V, I, M) | (D, E) |
| 4 | G | A, (R, K, H) |
| 5 | | P |
| 6 | G | |
| 7 | | (R, K, H) |
| 8 | (Y,F, M), (L, V, I, M) | (D, E), (R, K, H) |
| 9 | | (R, K, H) |
| 10 | Anchor | |

(+) = Ratio ≥ 4-fold
(−) =Ratio ≤ 0.25

TABLE 162

| A2.1 MOTIF FOR 10-MER PEPTIDES | | |
|---|---|---|
| AA position | (+) | (-) |
| 1 | | acidic amino-acids and P |
| 2 | Anchor: L, M, (I, V, A, T) | |
| 3 | | acidic amino-acids |
| 4 | | basic amino-acids and A |
| 5 | | P |
| 6 | | |
| 7 | | basic amino-acids |
| 8 | | acidic and basic amino-acids |
| 9 | | basic amino-acids |
| 10 | Anchor: V, I, L (A, M) | |

TABLE 163

| COMPARISON OF A2.1 BINDING OF 9-MERS AND 10-MERS | | |
|---|---|---|
| AA position | 9-mers (-) | 10-mers (+) |
| 1 | (YFW) | (YFW) |
| 2 | Anchor | Anchor |
| 3 | (YFW) | (LVIM) |
| 4 | (STC) | G |
| 5 | (YFW) | |
| 6 | | G |
| 7 | A | |
| 8 | | (YFW), (LVIM) |
| 9 | Anchor | |
| 10 | — | Anchor |
| AA position | 9-mers (-) | 10-mers (-) |
| 1 | P, (DE) | P, (DE) |
| 2 | Anchor | Anchor |
| 3 | (DE), (RKH) | (DE) |
| 4 | | A, (RKH) |
| 5 | | P |
| 6 | (RKH) | |
| 7 | (DE), (RKH) | (RKH) |
| 8 | | (DE), (RKH) |
| 9 | Anchor | (RKH) |
| 10 | — | Anchor |

TABLE 164

| Sequence | SEQ ID NO | AA | MAGE Strain | Mol. | Pos. | Motif |
|---|---|---|---|---|---|---|
| ALEAQQEAL | 11554 | 9 | 1 | | 15 | 2.1 |
| ILESLFRAV | 11555 | 9 | 1 | | 93 | 2.1 |
| VITKKVADL | 11556 | 9 | 1 | | 101 | 2.1 |
| CLGLSYDGL | 11557 | 9 | 1/3 | | 174 | 2.1 |
| QIMPKTGFL | 11558 | 9 | 1 | | 187 | 2.1 |
| SLHCKPEEAL | 11559 | 10 | 1 | | 7 | 2.1 |
| PLVLGTLEEV | 11560 | 10 | 1 | | 37 | 2.1 |
| CILESLFRAV | 11561 | 10 | 1 | | 92 | 2.1 |
| AVITKKVADL | 11562 | 10 | 1 | | 100 | 2.1 |
| VITKKVADLV | 11563 | 10 | 1 | | 101 | 2.1 |
| LLKYRAREPV | 11564 | 10 | 1/3 | | 114 | 2.1 |
| EIFGKASESL | 11565 | 10 | 1 | | 142 | 2.1 |
| CLGLSYDGLL | 11566 | 10 | 1/3 | | 174 | 2.1 |
| AISRKMVEL | 11567 | 9 | 2 | | 101 | 2.1 |
| KMVELVHFL | 11568 | 9 | 2 | | 105 | 2.1 |
| MVELVHFLL | 11569 | 9 | 2 | | 106 | 2.1 |
| DLQQSLRVL | 11570 | 9 | 2 | | 143 | 2.1 |
| SLRVLAAGL | 11571 | 9 | 2 | | 147 | 2.1 |
| ALSRKVAEL | 11572 | 9 | 3 | | 101 | 2.1 |
| HLYIFATCL | 11573 | 9 | 3 | | 167 | 2.1 |

TABLE 164-continued

| | | | | | |
|---|---|---|---|---|---|
| YIFATCLGL | 11574 | 9 | 3 | 169 | 2.1 |
| QIMPKAGLL | 11575 | 9 | 3 | 187 | 2.1 |
| AISRKMVELV | 11576 | 10 | 2 | 101 | 2.1 |
| MVELVHFLLL | 11577 | 10 | 2 | 106 | 2.1 |
| KLPGLLSRDL | 11578 | 10 | 2 | 135 | 2.1 |
| LLSRDLQQSL | 11579 | 10 | 2 | 139 | 2.1 |
| SLPTTMNYPL | 11580 | 10 | 3 | 63 | 2.1 |
| DLESEFQAAL | 11581 | 10 | 3 | 93 | 2.1 |
| ALSRKVAELV | 11582 | 10 | 3 | 101 | 2.1 |
| KVAELVHFLL | 11583 | 10 | 3 | 105 | 2.1 |
| VIFSKASSSL | 11584 | 10 | 3 | 142 | 2.1 |
| SLQLVFGIEL | 11585 | 10 | 3 | 150 | 2.1 |
| LMEVDPIGHL | 11586 | 10 | 3 | 159 | 2.1 |
| FLIIVLVMI | 11587 | 9 | 1 | 194 | 2.1 |
| GLLGDNQIM | 11588 | 9 | 1 | 181 | 2.1 |
| SLHCKPEEA | 11589 | 9 | 1 | 7 | 2.1 |
| ALGLVCVQA | 11590 | 9 | 1 | 22 | 2.1 |
| CKPEEALEA | 11591 | 9 | 1 | 10 | Random |
| QQEALGLVC | 11592 | 9 | 1 | 19 | Random |
| VQAATSSSS | 11593 | 9 | 1 | 28 | Random |
| PLVLGTLEE | 11594 | 9 | 1 | 37 | Random |
| VPTAGSTDP | 11595 | 9 | 1 | 46 | Random |
| PQSPQGASA | 11596 | 9 | 1 | 55 | Random |
| FPTTINFTR | 11597 | 9 | 1 | 64 | Random |
| QRQPSEGSS | 11598 | 9 | 1 | 73 | Random |
| SREEEGPST | 11599 | 9 | 1 | 82 | Random |
| AVITKKVAD | 11600 | 9 | 1 | 100 | Random |
| EMLESVIKN | 11601 | 9 | 1 | 127 | Random |
| YKHCFPEIF | 11602 | 9 | 1 | 136 | Random |
| GKASESLQL | 11603 | 9 | 1 | 145 | Random |
| VFGIDVKEA | 11604 | 9 | 1 | 154 | Random |
| DPTGHSYVL | 11605 | 9 | 1 | 163 | Random |
| VTCLGLSYD | 11606 | 9 | 1 | 172 | Random |
| PKTGFLIIV | 11607 | 9 | 1 | 190 | Random |
| LVMIAMEGG | 11608 | 9 | 1 | 199 | Random |
| HAPEEEIWE | 11609 | 9 | 1 | 208 | Random |
| ELSVMEVYD | 11610 | 9 | 1 | 217 | Random |
| GREHSAYGE | 11611 | 9 | 1 | 226 | Random |
| PRKLLTQDL | 11612 | 9 | 1 | 235 | Random |
| VQEKYLEYG | 11613 | 9 | 1 | 244 | Random |
| RCRTVIPHA | 11614 | 9 | 1 | 253 | Random |
| MSSCGVQGP | 11615 | 9 | 1 | 262 | Random |
| ILESLFRAVI | 11616 | 10 | 1 | 93 | 2.1 |
| FLIIVLVMIA | 11617 | 10 | 1 | 194 | 2.1 |
| LVFGIDVKEA | 11618 | 10 | 1 | 153 | 2.1 |
| EVYDGREHSA | 11619 | 10 | 1 | 222 | 2.1 |
| GVQGPSLKPA | 11620 | 10 | 1 | 266 | 2.1 |
| QLVFGIDV | 11621 | 8 | 1 | 152 | 2.1 |
| KLLTQDLV | 11622 | 8 | 1 | 237 | 2.1 |
| GLLGDNQI | 11623 | 8 | 1 | 181 | 2.1 |
| DLVGFLLL | 11624 | 8 | 1 | 108 | 2.1 |
| GLSYDGLL | 11625 | 8 | 1 | 176 | 2.1 |
| DLVQEKYL | 11626 | 8 | 1 | 242 | 2.1 |
| LLGDNQIM | 11627 | 8 | 1 | 182 | 2.1 |
| FLIIVLVM | 11628 | 8 | 1 | 194 | 2.1 |
| ALEAQQEA | 11629 | 8 | 1 | 15 | 2.1 |
| TLEEVPTA | 11630 | 8 | 1 | 42 | 2.1 |
| IMPKTGFL | 11631 | 8 | 1 | 188 | 2.1 |
| PVTKAEML | 11632 | 8 | 1 | 122 | 2.1 |
| IVLVMIAM | 11633 | 8 | 1 | 197 | 2.1 |
| AVITKKVA | 11634 | 8 | 1 | 100 | 2.1 |
| EIWEELSV | 11635 | 8 | 1 | 213 | 2.1 |
| LIIVLVMI | 11636 | 8 | 1 | 195 | 2.1 |
| IIVLVMIA | 11637 | 8 | 1 | 196 | 2.1 |
| SLFRAVITKKV | 11638 | 11 | 1 | 96 | 2.1 |
| LLLKYRAREPV | 11639 | 11 | 1 | 113 | 2.1 |
| YLEYGRCRTVI | 11640 | 11 | 1 | 248 | 2.1 |
| ALEAQQEALGL | 11641 | 11 | 1 | 15 | 2.1 |
| FLIIVLVMIAM | 11642 | 11 | 1 | 194 | 2.1 |
| VLGTLEEVPTA | 11643 | 11 | 1 | 39 | 2.1 |
| QLVFGIDVKEA | 11644 | 11 | 1 | 152 | 2.1 |
| AVITKKVADLV | 11645 | 11 | 1 | 100 | 2.1 |
| PVTKAEMLESV | 11646 | 11 | 1 | 122 | 2.1 |
| KVADLVGFLLL | 11647 | 11 | 1 | 105 | 2.1 |
| GVQGPSLKPAM | 11648 | 11 | 1 | 266 | 2.1 |
| LVGFLLLKYRA | 11649 | 11 | 1 | 109 | 2.1 |
| LVMIAMEGGHA | 11650 | 11 | 1 | 199 | 2.1 |
| CILESLFRAVI | 11651 | 11 | 1 | 92 | 2.1 |
| EALEAQQEA | 11652 | 9 | 1 | 14 | 2.1 |
| EAQQEALGL | 11653 | 9 | 1 | 17 | 2.1 |

TABLE 164-continued

| | | | | | | |
|---|---|---|---|---|---|---|
| AATSSSSPL | 11654 | 9 | 1 | | 30 | 2.1 |
| ATSSSSPLV | 11655 | 9 | 1 | | 31 | 2.1 |
| GTLEEVPTA | 11656 | 9 | 1 | | 41 | 2.1 |
| GASAFPTTI | 11657 | 9 | 1 | | 60 | 2.1 |
| STSCILESL | 11658 | 9 | 1 | | 89 | 2.1 |
| RAVITKKVA | 11659 | 9 | 1 | | 99 | 2.1 |
| ITKKVADLV | 11660 | 9 | 1 | | 102 | 2.1 |
| RAREPVTKA | 11661 | 9 | 1 | | 118 | 2.1 |
| KAEMLESVI | 11662 | 9 | 1 | | 125 | 2.1 |
| KASESLQLV | 11663 | 9 | 1 | | 146 | 2.1 |
| PTGHSYVLV | 11664 | 9 | 1 | | 164 | 2.1 |
| KTGFLIIVL | 11665 | 9 | 1 | | 191 | 2.1 |
| LIIVLVMIA | 11666 | 9 | 1 | | 195 | 2.1 |
| IIVLVMIAM | 11667 | 9 | 1 | | 196 | 2.1 |
| MIAMEGGHA | 11668 | 9 | 1 | | 201 | 2.1 |
| EIWEELSVM | 11669 | 9 | 1 | | 213 | 2.1 |
| SAYGEPRKL | 11670 | 9 | 1 | | 230 | 2.1 |
| YLEYGRCRT | 11671 | 9 | 1 | | 248 | 2.1 |
| EALGLVCVQA | 11672 | 10 | 1 | | 21 | 2.1 |
| QAATSSSSPL | 11673 | 10 | 1 | | 29 | 2.1 |
| VTKAEMLESV | 11674 | 10 | 1 | | 123 | 2.1 |
| EADPTGHSYV | 11675 | 10 | 1 | | 161 | 2.1 |
| VLGTLEEVPT | 11676 | 10 | 1 | | 39 | 2.1 |
| SAFPTTINFT | 11677 | 10 | 1 | | 62 | 2.1 |
| GIDVKEADPT | 11678 | 10 | 1 | | 156 | 2.1 |
| PTGHSYVLVT | 11679 | 10 | 1 | | 164 | 2.1 |
| FLWGPRALA | 11680 | 9 | 1 | new | 265 | 2.1 |
| LAETSYVKV | 11681 | 9 | 1 | new | 272 | 2.1 |
| YVKVLEYVI | 11682 | 9 | 1 | new | 277 | 2.1 |
| RVRFFFPSL | 11683 | 9 | 1 | new | 290 | 2.1 |
| LAETSYVKVL | 11684 | 10 | 1 | new | 272 | 2.1 |
| VLEYVIKVSA | 11685 | 10 | 1 | new | 280 | 2.1 |
| AALREEEEGV | 11686 | 10 | 1 | new | 301 | 2.1 |
| SMHCKPEEV | 11687 | 9 | 1 | new (a) | 7 | 2.1 |
| AMGLVCVQV | 11688 | 9 | 1 | new (a) | 22 | 2.1 |
| LMLGTLEEV | 11689 | 9 | 1 | new (a) | 38 | 2.1 |
| LQLVFGIDV | 11690 | 9 | 1 | new | 151 | 2.1 |
| GLSYDGLLG | 11691 | 9 | 1 | new | 176 | 2.1 |
| GLSYDGLLV | 11692 | 9 | 1 | new (a) | 176 | 2.1 |
| LLGDNQIMP | 11693 | 9 | 1 | new | 182 | 2.1 |
| LLGDNQIMV | 11694 | 9 | 1 | new | 182 | 2.1 |
| WEELSVMEV | 11695 | 9 | 1 | new | 215 | 2.1 |
| WMELSVMEV | 11696 | 9 | 1 | new (a) | 215 | 2.1 |
| RKLLTQDLV | 11697 | 9 | 1 | new | 236 | 2.1 |
| YEFLWGPRA | 11698 | 9 | 1 | new | 262 | 2.1 |
| YMFLWGPRV | 11699 | 9 | 1 | new (a) | 262 | 2.1 |
| AATSSSSPLV | 11700 | 10 | 1 | new | 30 | 2.1 |
| ATSSSSPLVL | 11701 | 10 | 1 | new | 31 | 2.1 |
| KMADLVGFLV | 11702 | 10 | 1 | new (a) | 105 | 2.1 |
| VADLVGFLLL | 11703 | 10 | 1 | new | 106 | 2.1 |
| SESLQLVFGI | 11704 | 10 | 1 | new | 148 | 2.1 |
| VMVTCLGLSV | 11705 | 10 | 1 | new (a) | 170 | 2.1 |
| QIMPKTGFLI | 11706 | 10 | 1 | new | 187 | 2.1 |
| QMMPKTGFLV | 11707 | 10 | 1 | new (a) | 187 | 2.1 |
| KTGFLIIVLV | 11708 | 10 | 1 | new | 191 | 2.1 |
| LIIVLVMIAM | 11709 | 10 | 1 | new | 195 | 2.1 |
| VMIAMEGGHV | 11710 | 10 | 1 | new (a) | 200 | 2.1 |
| SAYGEPRKLL | 11711 | 10 | 1 | new | 230 | 2.1 |
| ALAETSYVKVL | 11712 | 11 | 1 N | | 270 | 2.1 |
| KMVELVHFLLL | 11713 | 11 | 2 | | 52 | 2.1 |
| ELMEVDPIGHL | 11714 | 11 | 3 | | 105 | 2.1 |
| HLYIFATCLGL | 11715 | 11 | 3 | | 114 | 2.1 |
| LLLKYRAREPV | 11716 | 11 | 3 | | 60 | 2.1 |
| QLVFGIELMEV | 11717 | 11 | 3 | | 99 | 2.1 |
| IMPKAGLLIIV | 11718 | 11 | 3 | | 135 | 2.1 |
| VLVTCLGLSYDGL | 11719 | 13 | 1 n | E6 | 170 | 2.1 |
| KLLTQDLVQEKYL | 11720 | 13 | 1 n | E6 | 237 | 2.1 |
| DLVQEKYLEYRQV | 11721 | 13 | 1 n | E6 | 242 | 2.1 |
| SLFRAVITKKVADLV | 11722 | 15 | 1 n | POL | 96 | 2.1 |
| DLESEFQAAISRKMV | 11723 | 15 | 2 | POL | 40 | 2.1 |
| MLGSVVGNWQYFFPV | 11724 | 15 | 3 | POL | 75 | 2.1 |
| GASSFSTTI | 11725 | 9 | 2 | | 60 | 2.1 |
| DLESEFQAA | 11726 | 9 | 2, 3 | | 93 | 2.1 |
| QAAISRKMV | 11727 | 9 | 2 | | 99 | 2.1 |
| KAEMLESVL | 11728 | 9 | 2 | | 125 | 2.1 |
| KASEYLQLV | 11729 | 9 | 2 | | 146 | 2.1 |
| QLVFGIEVV | 11730 | 9 | 2 | | 152 | 2.1 |
| VVPISHLYI | 11731 | 9 | 2 | | 162 | 2.1 |
| PISHLYILV | 11732 | 9 | 2 | | 164 | 2.1 |
| HLYILVTCL | 11733 | 9 | 2 | | 167 | 2.1 |

TABLE 164-continued

| | | | | | | |
|---|---|---|---|---|---|---|
| YILVTCLGL | 11734 | 9 | 2 | | 169 | 2.1 |
| GLLGDNQVM | 11735 | 9 | 2 | | 181 | 2.1 |
| QVMPKTGLL | 11736 | 9 | 2 | | 187 | 2.1 |
| VMPKTGLLI | 11737 | 9 | 2 | | 188 | 2.1 |
| KTGLLIIVL | 11738 | 9 | 2 | | 191 | 2.1 |
| GLLIIVLAI | 11739 | 9 | 2, 3 | | 193 | 2.1 |
| LLIIVLAII | 11740 | 9 | 2, 3 | | 194 | 2.1 |
| LIIVLAIIA | 11741 | 9 | 2, 3 | | 195 | 2.1 |
| IIVLAIIAI | 11742 | 9 | 2 | | 196 | 2.1 |
| IIAIEGDCA | 11743 | 9 | 2 | | 201 | 2.1 |
| GASSLPTTM | 11744 | 9 | 3 | | 60 | 2.1 |
| QAALSRKVA | 11745 | 9 | 3 | | 99 | 2.1 |
| VAELVHFLL | 11746 | 9 | 3 | | 106 | 2.1 |
| KAEMLGSVV | 11747 | 9 | 3 | | 125 | 2.1 |
| KASSSLQLV | 11748 | 9 | 3 | | 146 | 2.1 |
| QLVFGIELM | 11749 | 9 | 3 | | 152 | 2.1 |
| PIGHLYIFA | 11750 | 9 | 3 | | 164 | 2.1 |
| IMPKAGLLI | 11751 | 9 | 3 | | 188 | 2.1 |
| KAGLLIIVL | 11752 | 9 | 3 | | 191 | 2.1 |
| IIAREGDCA | 11753 | 9 | 3 | | 201 | 2.1 |
| EALEAQQEAL | 11754 | 10 | 1 | new | 14 | 2.1 |
| EAQQEALGLV | 11755 | 10 | 1 | new | 17 | 2.1 |
| DLESEFQAAI | 11756 | 10 | 2 | | 93 | 2.1 |
| AAISRKMVEL | 11757 | 10 | 2 | | 100 | 2.1 |
| VIFSKASEYL | 11758 | 10 | 2 | | 142 | 2.1 |
| YLQLVFGIEV | 11759 | 10 | 2 | | 150 | 2.1 |
| LVFGIEVVEV | 11760 | 10 | 2 | | 153 | 2.1 |
| GIEVVEVVPI | 11761 | 10 | 2 | | 156 | 2.1 |
| VVEVVPISHL | 11762 | 10 | 2 | | 159 | 2.1 |
| EVVPISHLYI | 11763 | 10 | 2 | | 161 | 2.1 |
| VVPISHLYIL | 11764 | 10 | 2 | | 162 | 2.1 |
| PISHLYILVT | 11765 | 10 | 2 | | 164 | 2.1 |
| QVMPKTGLLI | 11766 | 10 | 2 | | 187 | 2.1 |
| VMPKTGLLII | 11767 | 10 | 2 | | 188 | 2.1 |
| KTGLLIIVLA | 11768 | 10 | 2 | | 191 | 2.1 |
| GLLIIVLAII | 11769 | 10 | 2,3 | | 193 | 2.1 |
| LLIIVLAIIA | 11770 | 10 | 2,3 | | 194 | 2.1 |
| LIIVLAIIAI | 11771 | 10 | 2 | | 195 | 2.1 |
| AIIAREGDCA | 11772 | 10 | 2 | | 200 | 2.1 |
| AALSRKVAEL | 11773 | 10 | 3 | | 100 | 2.1 |
| VAELVHFLLL | 11774 | 10 | 3 | | 106 | 2.1 |
| VTKAEMLGSV | 11775 | 10 | 3 | | 123 | 2.1 |
| GIELMEVDPI | 11776 | 10 | 3 | | 159 | 2.1 |
| EVDPIGHLYI | 11777 | 10 | 3 | | 161 | 2.1 |
| PIGHLYIFAT | 11778 | 10 | 3 | | 164 | 2.1 |
| QIMPKAGLLI | 11779 | 10 | 3 | | 187 | 2.1 |
| IMPKAGLLII | 11780 | 10 | 3 | | 188 | 2.1 |
| KAGLLIIVLA | 11781 | 10 | 3 | | 191 | 2.1 |
| AIIAREGDCA | 11782 | 10 | 3 | | 200 | 2.1 |
| FLWGPRALI | 11783 | 9 | 2 | | 271 | A02 |
| GLEARGEAL | 11784 | 9 | 3 | | 15 | A02 |
| EARGEALGL | 11785 | 9 | 3 | | 17 | A02 |
| ALGLVGAQA | 11786 | 9 | 3 | | 22 | A02/A03 |
| GLVGAQAPA | 11787 | 9 | 3 | | 24 | A02/A03 |
| LVGAQAPAT | 11788 | 9 | 3 | | 25 | A02 |
| PATEEQEAA | 11789 | 9 | 3 | | 31 | A02/A03 |
| EAASSSSTL | 11790 | 9 | 3 | | 37 | A02 |
| AASSSSTLV | 11791 | 9 | 3 | | 38 | A02 |
| LVEVTLGEV | 11792 | 9 | 3 | | 45 | A02 |
| EVTLGEVPA | 11793 | 9 | 3 | | 47 | A02/A03 |
| VTLEVPAA | 11794 | 9 | 3 | | 48 | A02/A02 |
| KIWEELSVL | 11795 | 9 | 3 | | 220 | A02 |
| SILGDPKKL | 11796 | 9 | 3 | | 237 | A02 |
| ILGDPKKLL | 11797 | 9 | 3 | | 238 | A02 |
| FLWGPRALV | 11798 | 9 | 3 | | 271 | A02 |
| RALVETSYV | 11799 | 9 | 3 | | 276 | A02 |
| LVETSYVKV | 11800 | 9 | 3 | | 278 | A02 |
| YVKVLHHMV | 11801 | 9 | 3 | | 283 | A02 |
| KVLHHMVKI | 11802 | 9 | 3 | | 285 | A02 |
| EARGEALGLV | 11803 | 10 | 3 | | 17 | A02 |
| EALGLVGAQA | 11804 | 10 | 3 | | 21 | A02/S03 |
| GLVGAQAPAT | 11805 | 10 | 3 | | 24 | A02 |
| QAPATEEQEA | 11806 | 10 | 3 | | 29 | A02/A03 |
| EAASSSSTLV | 11807 | 10 | 3 | | 37 | A02 |
| TLVEVTLGEV | 11808 | 10 | 3 | | 44 | A02 |
| EVTLGEVPAA | 11809 | 10 | 3 | | 47 | A02/A03 |
| EVFEGREDSI | 11810 | 10 | 3 | | 229 | A02 |
| SILGDPKKLL | 11811 | 10 | 3 | | 237 | A02 |
| ILGDPKKLLT | 11812 | 10 | 3 | | 238 | A02 |
| ALVETSYVKV | 11813 | 10 | 3 | | 277 | A02 |

TABLE 164-continued

| | | | | | | |
|---|---|---|---|---|---|---|
| LVETSYVKVL | 11814 | 10 | 3 | | 278 | A02 |
| MVKISGGPHI | 11815 | 10 | 3 | | 290 | A02 |
| LVLGTLEEV | 11816 | 9 | 1 | | 38 | 2.1 |
| KVADLVGFLL | 11817 | 10 | 1 | | 105 | |
| LVFGIELMEV | 11818 | 10 | 3 | | 153 | 2.1 |
| ILLWQPIPV | 11819 | 9 | 3 | | | |
| EVDPIGHLY | 11820 | 9 | 3 | | | |
| KMVELVHFL | 11821 | 9 | 2 | | | |
| KMVELVHFLL | 11822 | 10 | 2 | | 105 | |
| LVFGIELMEV | 11823 | 10 | 3 | | | |
| KVAELVHFL | 11824 | 9 | 3 | | 105 | 2.1 |
| CILESLFRA | 11825 | 9 | 1 | | 92 | 2.1 |
| VMIAMEGGHA | 11826 | 10 | 1 | | 200 | 2.1 |
| MLESVIKNYK | 11827 | 10 | 1 | | | |
| ETSYVKVLEY | 11828 | 10 | 1 | | | |
| KVLEYVIKV | 11829 | 9 | 1 | new | 279 | 2.1 |
| FLWGPRALA | 11830 | 9 | 1 | | | |
| ALREEEEGV | 11831 | 9 | 1 | | 320 | 2.1 |
| ALAETSYVKV | 11832 | 10 | 1 | | 271 | |
| YVIKVSARV | 11833 | 9 | 1 | | 283 | 2.1 |
| RALAETSYV | 11834 | 9 | 1 | | 270 | 2.1 |
| ALAETSYVK | 11835 | 9 | 1 | | | |
| VLGTLEEV | 11836 | 8 | 1 | | 39 | 2.1 |
| SLQLVFGI | 11837 | 8 | 1 | | 150 | 2.1 |
| ILESLFRA | 11838 | 8 | 1 | | 93 | 2.1 |
| FLLLKYRA | 11839 | 8 | 1 | | 112 | 2.1 |
| GLVCVQAA | 11840 | 8 | 1 | | 24 | 2.1 |
| VLVTCLGL | 11841 | 8 | 1 | | 170 | 2.1 |
| KVADLVGFL | 11842 | 9 | 1 | | 105 | 2.1 |
| YVLVTCLGL | 11843 | 9 | 1 | | 169 | 2.1 |
| IMPKTGFLI | 11844 | 9 | 1 | | 188 | 2.1 |
| GLLGDNQIM | 11845 | 9 | 1 | | | A2.1 |
| GLVCVQAAT | 11846 | 9 | 1 | | 24 | 2.1 |
| VADLVGFLL | 11847 | 9 | 1 | | 106 | 2.1 |
| YLEYGRCRTV | 11848 | 10 | 1 | | 248 | 2.1 |
| SLQLVFGIDV | 11849 | 10 | 1 | | 150 | 2.1 |
| IMPKTGFLII | 11850 | 10 | 1 | | 188 | 2.1 |
| ALGLVCVQAA | 11851 | 10 | 1 | | 22 | A2.1 |
| EIWEELSVMEV | 11852 | 11 | 1 | | 213 | A2.1 |
| FLIIVLVMIAM | 11853 | 11 | 1 | | | A2.1 |
| VIPHAMSSCGV | 11854 | 11 | 1 | | 257 | 2.1 |
| CILESCFRAVI | 11855 | 11 | 1 | | | A2.1 |
| QIMPKTGFLII | 11856 | 11 | 1 | | 187 | 2.1 |
| GFLLLKYRA | 11857 | 9 | 1 | | | |
| CFPEIFGKA | 11858 | 9 | 1 | | | |
| FFFPSLREA | 11859 | 9 | 1 | | | |
| FFPSLREAA | 11860 | 9 | 1 | | | |
| RSLHCKPEEA | 11861 | 10 | 1 | | | |
| EFLWGPRALA | 11862 | 10 | 1 | | | |
| RFFFPSLREA | 11863 | 10 | 1 | | | |
| FFFPSLREAA | 11864 | 10 | 1 | | | |

| Sequence | SEQ ID NO | A1 | A2.1 | A3.2 | A11 | A24 |
|---|---|---|---|---|---|---|
| ALEAQQEAL | 11554 | | <0.0003 | | | |
| ILESLFRAV | 11555 | | 0.0004 | | | |
| VITKKVADL | 11556 | | <0.0003 | | | |
| CLGLSYDGL | 11557 | | 0.0004 | | | |
| QIMPKTGFL | 11558 | | 0.0007 | | | |
| SLHCKPEEAL | 11559 | | 0.0002 | | | |
| PLVLGTLEEV | 11560 | | 0.0008 | | | |
| CILESLFRAV | 11561 | | 0.0003 | | | |
| AVITKKVADL | 11562 | | 0 | | | |
| VITKKVADLV | 11563 | | 0 | | | |
| LLKYRAREPV | 11564 | | 0 | | | |
| EIFGKASESL | 11565 | | 0 | | | |
| CLGLSYDGLL | 11566 | | 0 | | | |
| AISRKMVEL | 11567 | | 0.0003 | | | |
| KMVELVHFL | 11568 | | 0.16 | | | |
| MVELVHFLL | 11569 | | 0.0031 | | | |
| DLQQSLRVL | 11570 | | 0 | | | |
| SLRVLAAGL | 11571 | | 0.0001 | | | |
| ALSRKVAEL | 11572 | | 0.0050 | | | |
| HLYIFATCL | 11573 | | 0.0003 | | | |
| YIFATCLGL | 11574 | | 0.018 | | | |
| QIMPKAGLL | 11575 | | 0 | | | |
| AISRKMVELV | 11576 | | 0 | | | |
| MVELVHFLLL | 11577 | | 0.0017 | | | |
| KLPGLLSRDL | 11578 | | 0 | | | |

TABLE 164-continued

| | | | | | |
|---|---|---|---|---|---|
| LLSRDLQQSL | 11579 | 0.0007 | | | |
| SLPTTMNYPL | 11580 | 0.0035 | | | |
| DLESEFQAAL | 11581 | 0.0001 | | | |
| ALSRKVAELV | 11582 | 0.0001 | | | |
| KVAELVHFLL | 11583 | 0.012 | | | |
| VIFSKASSSL | 11584 | 0 | | | |
| SLQLVFGIEL | 11585 | 0.0049 | | | |
| LMEVDPIGHL | 11586 | 0.0005 | | | |
| FLIIVLVMI | 11587 | 0.0005 | | | |
| GLLGDNQIM | 11588 | 0.0051 | | | |
| SLHCKPEEA | 11589 | 0.013 | <0.0002 | 0 | |
| ALGLVCVQA | 11590 | 0.015 | <0.0002 | <0.0002 | |
| CKPEEALEA | 11591 | <0.0002 | | | |
| QQEALGLVC | 11592 | <0.0002 | | | |
| VQAATSSSS | 11593 | <0.0002 | | | |
| PLVLGTLEE | 11594 | <0.0002 | | | |
| VPTAGSTDP | 11595 | <0.0002 | | | |
| PQSPQGASA | 11596 | <0.0002 | | | |
| FPTTINFTR | 11597 | <0.0002 | | | |
| QRQPSEGSS | 11598 | <0.0002 | | | |
| SREEEGPST | 11599 | <0.0002 | | | |
| AVITKKVAD | 11600 | <0.0002 | | | |
| EMLESVIKN | 11601 | <0.0002 | | | 0 |
| YKHCFPEIF | 11602 | <0.0002 | | | |
| GKASESLQL | 11603 | <0.0002 | | | |
| VFGIDVKEA | 11604 | <0.0002 | <0.0002 | 0 | |
| DPTGHSYVL | 11605 | <0.0002 | | | |
| VTCLGLSYD | 11606 | <0.0002 | | | |
| PKTGFLIIV | 11607 | <0.0002 | | | |
| LVMIAMEGG | 11608 | <0.0002 | | | |
| HAPEEEIWE | 11609 | <0.0002 | | | |
| ELSVMEVYD | 11610 | <0.0002 | | | |
| GREHSAYGE | 11611 | <0.0002 | | | |
| PRKLLTQDL | 11612 | <0.0002 | | | |
| VQEKYLEYG | 11613 | <0.0002 | | | |
| RCRTVIPHA | 11614 | <0.0002 | | | |
| MSSCGVQGP | 11615 | <0.0002 | | | |
| ILESLFRAVI | 11616 | 0.0002 | | | |
| FLIIVLVMIA | 11617 | 0.0003 | 0.0093 | 0.0030 | |
| LVFGIDVKEA | 11618 | 0.0002 | <0.0002 | 0 | |
| EVYDGREHSA | 11619 | 0 | <0.0002 | 0 | |
| GVQGPSLKPA | 11620 | 0.0001 | | | |
| QLVFGIDV | 11621 | 0 | | | |
| KLLTQDLV | 11622 | 0.0004 | | | |
| GLLGDNQI | 11623 | 0 | | | |
| DLVGFLLL | 11624 | 0 | | | |
| GLSYDGLL | 11625 | 0.0001 | | | |
| DLVQEKYL | 11626 | 0 | | | |
| LLGDNQIM | 11627 | 0 | | | |
| FLIIVLVM | 11628 | 0 | | | |
| ALEAQQEA | 11629 | 0 | | | |
| TLEEVPTA | 11630 | 0 | | | |
| IMPKTGFL | 11631 | 0.0001 | | | |
| PVTKAEML | 11632 | 0 | | | |
| IVLVMIAM | 11633 | 0.0001 | | | |
| AVITKKVA | 11634 | 0 | | | |
| EIWEELSV | 11635 | 0 | | | |
| LIIVLVMI | 11636 | 0.0001 | | | |
| IIVLVMIA | 11637 | 0.0002 | | | |
| SLFRAVITKKV | 11638 | 0.0001 | | | |
| LLLKYRAREPV | 11639 | 0.0001 | | | |
| YLEYGRCRTVI | 11640 | 0.0006 | | | |
| ALEAQQEALGL | 11641 | 0.0001 | | | |
| FLIIVLVMIAM | 11642 | 0.0041 | | | |
| VLGTLEEVPTA | 11643 | 0.0002 | | | |
| QLVFGIDVKEA | 11644 | 0.0001 | | | |
| AVITKKVADLV | 11645 | 0 | | | |
| PVTKAEMLESV | 11646 | 0 | | | |
| KVADLVGFLLL | 11647 | 0.020 | | | |
| GVQGPSLKPAM | 11648 | 0 | | | |
| LVGFLLLKYRA | 11649 | 0.0004 | | | |
| LVMIAMEGGHA | 11650 | 0.0005 | | | |
| CILESLFRAVI | 11651 | 0.0030 | | | |
| EALEAQQEA | 11652 | 0 | <0.0002 | 0 | |
| EAQQEALGL | 11653 | 0 | | | <0.0002 |
| AATSSSSPL | 11654 | 0 | | | <0.0002 |
| ATSSSSPLV | 11655 | 0.0007 | | | |
| GTLEEVPTA | 11656 | 0.013 | <0.0002 | 0 | |
| GASAFPTTI | 11657 | 0 | | | <0.0002 |
| STSCILESL | 11658 | 0.0002 | | | |

TABLE 164-continued

| | | | | | |
|---|---|---|---|---|---|
| RAVITKKVA | 11659 | 0 | <0.0002 | 0 | |
| ITKKVADLV | 11660 | 0 | | | |
| RAREPVTKA | 11661 | 0 | | | |
| KAEMLESVI | 11662 | 0 | | | <0.0002 |
| KASESLQLV | 11663 | 0.0009 | | | |
| PTGHSYVLV | 11664 | 0 | | | |
| KTGFLIIVL | 11665 | 0.0006 | | | |
| LIIVLVMIA | 11666 | 0 | 0.0022 | 0.0006 | |
| IIVLVMIAM | 11667 | 0.0007 | | | |
| MIAMEGGHA | 11668 | 0.0005 | <0.0002 | 0.0002 | |
| EIWEELSVM | 11669 | 0 | | | |
| SAYGEPRKL | 11670 | 0.0002 | | | <0.0002 |
| YLEYGRCRT | 11671 | 0 | | | |
| EALGLVCVQA | 11672 | 0.0005 | <0.0002 | 0 | |
| QAATSSSSPL | 11673 | 0 | | | <0.0002 |
| VTKAEMLESV | 11674 | 0 | | | |
| EADPTGHSYV | 11675 | 0 | | | |
| VLGTLEEVPT | 11676 | 0.0004 | | | |
| SAFPTTINFT | 11677 | 0 | | | |
| GIDVKEADPT | 11678 | 0 | | | |
| PTGHSYVLVT | 11679 | 0 | | | |
| FLWGPRALA | 11680 | 0.042 | 0.0017 | 0 | |
| LAETSYVKV | 11681 | 0 | | | |
| YVKVLEYVI | 11682 | 0.0002 | | | |
| RVRFFFPSL | 11683 | 0.0001 | | | |
| LAETSYVKVL | 11684 | 0 | | | <0.0002 |
| VLEYVIKVSA | 11685 | 0.0002 | 0.0002 | 0 | |
| AALREEEEGV | 11686 | 0 | | | |
| SMHCKPEEV | 11687 | 0.018 | | | |
| AMGLVCVQV | 11688 | 0.012 | | | |
| LMLGTLEEV | 11689 | 0.13 | | | |
| LQLVFGIDV | 11690 | 0.0004 | | | |
| GLSYDGLLG | 11691 | 0 | | | |
| GLSYDGLLV | 11692 | 0.0047 | | | |
| LLGDNQIMP | 11693 | 0.0001 | | | |
| LLGDNQIMV | 11694 | 0.043 | | | |
| WEELSVMEV | 11695 | 0 | | | |
| WMELSVMEV | 11696 | 0.041 | | | |
| RKLLTQDLV | 11697 | 0 | | | |
| YEFLWGPRA | 11698 | 0 | | | |
| YMFLWGPRV | 11699 | 0.22 | | | |
| AATSSSSPLV | 11700 | 0 | | | |
| ATSSSSPLVL | 11701 | 0 | | | |
| KMADLVGFLV | 11702 | 1.5 | | | |
| VADLVGFLLL | 11703 | 0.0008 | | | 0.0003 |
| SESLQLVFGI | 11704 | 0 | | | |
| VMVTCLGLSV | 11705 | 0.30 | | | |
| QIMPKTGFLI | 11706 | 0.0009 | | | |
| QMMPKTGFLV | 11707 | 0.050 | | | |
| KTGFLIIVLV | 11708 | 0.0012 | | | |
| LIIVLVMIAM | 11709 | 0.0003 | | | |
| VMIAMEGGHV | 11710 | 0.053 | | | |
| SAYGEPRKLL | 11711 | 0 | | | 0.0008 |
| ALAETSYVKVL | 11712 | 0.012 | | | |
| KMVELVHFLLL | 11713 | 0.67 | | | |
| ELMEVDPIGHL | 11714 | 0.026 | | | |
| HLYIFATCLGL | 11715 | 0.041 | | | |
| LLLKYRAREPV | 11716 | 0.0001 | | | |
| QLVFGIELMEV | 11717 | 0.34 | | | |
| IMPKAGLLIIV | 11718 | 0.013 | | | |
| VLVTCLGLSYDGL | 11719 | 0.0017 | | | |
| KLLTQDLVQEKYL | 11720 | 0.0060 | | | |
| DLVQEKYLEYRQV | 11721 | 0 | | | |
| SLFRAVITKKVADLV | 11722 | 0.0004 | | | |
| DLESEFQAAISRKMV | 11723 | 0 | | | |
| MLGSVVGNWQYFFPV | 11724 | 0.012 | | | |
| GASSFSTTI | 11725 | 0 | | | 0.0002 |
| DLESEFQAA | 11726 | 0 | | | |
| QAAISRKMV | 11727 | 0 | | | |
| KAEMLESVL | 11728 | 0 | | | 0 |
| KASEYLQLV | 11729 | 0.011 | | | |
| QLVFGIEVV | 11730 | 0.0038 | | | |
| VVPISHLYI | 11731 | 0.0002 | | | |
| PISHLYILV | 11732 | 0.0005 | | | |
| HLYILVTCL | 11733 | 0.0034 | | | |
| YILVTCLGL | 11734 | 0.0014 | | | |
| GLLGDNQVM | 11735 | 0.0038 | | | |
| QVMPKTGLL | 11736 | 0 | | | |
| VMPKTGLLI | 11737 | 0.0010 | | | 0.230 |
| KTGLLIIVL | 11738 | 0.0002 | | | |

TABLE 164-continued

| | | | | | | |
|---|---|---|---|---|---|---|
| GLLIIVLAI | 11739 | | 0.0002 | | | |
| LLIIVLAII | 11740 | | 0.0001 | | | |
| LIIVLAIIA | 11741 | | 0.0008 | | | |
| IIVLAIIAI | 11742 | | 0.0009 | | | |
| IIAIEGDCA | 11743 | | 0 | | | |
| GASSLPTTM | 11744 | | 0 | | | 0.0010 |
| QAALSRKVA | 11745 | | 0 | | | |
| VAELVHFLL | 11746 | | 0 | | | 0.039 |
| KAEMLGSVV | 11747 | | 0 | | | |
| KASSSLQLV | 11748 | | 0.0005 | | | |
| QLVFGIELM | 11749 | | 0.0010 | | | |
| PIGHLYIFA | 11750 | | 0 | | | |
| IMPKAGLLI | 11751 | | 0.0064 | | | |
| KAGLLIIVL | 11752 | | 0.0002 | | | 0 |
| IIAREGDCA | 11753 | | 0 | | | |
| EALEAQQEAL | 11754 | | 0 | | | 0 |
| EAQQEALGLV | 11755 | | 0 | | | |
| DLESEFQAAI | 11756 | | 0 | | | |
| AAISRKMVEL | 11757 | | 0 | | | 0 |
| VIFSKASEYL | 11758 | | 0.0014 | | | |
| YLQLVFGIEV | 11759 | | 0.37 | | | |
| LVFGIEVVEV | 11760 | | 0.012 | | | |
| GIEVVEVVPI | 11761 | | <0.0002 | | | |
| VVEVVPISHL | 11762 | | <0.0002 | | | |
| EVVPISHLYI | 11763 | | <0.0002 | | | |
| VVPISHLYIL | 11764 | | 0.0002 | | | |
| PISHLYILVT | 11765 | | 0.0003 | | | |
| QVMPKTGLLI | 11766 | | 0.0002 | | | |
| VMPKTGLLII | 11767 | | 0.0009 | | | 0.058 |
| KTGLLIIVLA | 11768 | | <0.0002 | | | |
| GLLIIVLAII | 11769 | | 0.0005 | | | |
| LLIIVLAIIA | 11770 | | <0.0002 | | | |
| LIIVLAIIAI | 11771 | | 0.0013 | | | |
| AIIAREGDCA | 11772 | | 0.0023 | | | |
| AALSRKVAEL | 11773 | | 0.0007 | | | 0 |
| VAELVHFLLL | 11774 | | 0.0009 | | | 0.0018 |
| VTKAEMLGSV | 11775 | | <0.0002 | | | |
| GIELMEVDPI | 11776 | | <0.0002 | | | |
| EVDPIGHLYI | 11777 | | <0.0002 | | | |
| PIGHLYIFAT | 11778 | | 0.0003 | | | |
| QIMPKAGLLI | 11779 | | 0.0006 | | | |
| IMPKAGLLII | 11780 | | 0.0015 | | | |
| KAGLLIIVLA | 11781 | | <0.0002 | | | |
| AIIAREGDCA | 11782 | | <0.0002 | | | |
| FLWGPRALI | 11783 | | | | | |
| GLEARGEAL | 11784 | | | | | |
| EARGEALGL | 11785 | | | | | |
| ALGLVGAQA | 11786 | | | | | |
| GLVGAQAPA | 11787 | | | | | |
| LVGAQAPAT | 11788 | | | | | |
| PATEEQEAA | 11789 | | | | | |
| EAASSSSTL | 11790 | | | | | |
| AASSSSTLV | 11791 | | | | | |
| LVEVTLGEV | 11792 | | | | | |
| EVTLGEVPA | 11793 | | | | | |
| VTLEVPAA | 11794 | | | | | |
| KIWEELSVL | 11795 | | | | | |
| SILGDPKKL | 11796 | | | | | |
| ILGDPKKLL | 11797 | | | | | |
| FLWGPRALV | 11798 | | | | | |
| RALVETSYV | 11799 | | | | | |
| LVETSYVKV | 11800 | | | | | |
| YVKVLHHMV | 11801 | | | | | |
| KVLHHMVKI | 11802 | | | | | |
| EARGEALGLV | 11803 | | | | | |
| EALGLVGAQA | 11804 | | | | | |
| GLVGAQAPAT | 11805 | | | | | |
| QAPATEEQEA | 11806 | | | | | |
| EAASSSSTLV | 11807 | | | | | |
| TLVEVTLGEV | 11808 | | | | | |
| EVTLGEVPAA | 11809 | | | | | |
| EVFEGREDSI | 11810 | | | | | |
| SILGDPKKLL | 11811 | | | | | |
| ILGDPKKLLT | 11812 | | | | | |
| ALVETSYVKV | 11813 | | | | | |
| LVETSYVKVL | 11814 | | | | | |
| MVKISGGPHI | 11815 | | | | | |
| LVLGTLEEV | 11816 | <0.0006 | 0.032 | 0 | 0 | 0.0003 |
| KVADLVGFLL | 11817 | 0.0005 | 0.041 | 0.0039 | 0.0030 | 0.0070 |
| LVFGIELMEV | 11818 | | 0.17 | | | |

TABLE 164-continued

| | | | | | | |
|---|---|---|---|---|---|---|
| ILLWQPIPV | 11819 | <0.0007 | 1.4 | 0.0048 | 0.0048 | 0 |
| EVDPIGHLY | 11820 | 3.7 | | | 0.0022 | |
| KMVELVHFL | 11821 | <0.0007 | 0.13 | 0.0007 | 0 | 0.0043 |
| KMVELVHFLL | 11822 | <0.0008 | 0.071 | 0.0004 | 0.0001 | 0.0008 |
| LVFGIELMEV | 11823 | 0.0030 | 0.065 | 0.0007 | 0 | 0 |
| KVAELVHFL | 11824 | 0 | 0.073 | 0.011 | 0.0047 | 0.0005 |
| CILESLFRA | 11825 | 0.0001 | 0.073 | 0 | 0.0002 | 0 |
| VMIAMEGGHA | 11826 | <0.00008 | 0.0023 | 0 | 0 | 0 |
| MLESVIKNYK | 11827 | 0 | 0 | 0.034 | 0.0045 | 0 |
| ETSYVKVLEY | 11828 | 0.075 | 0 | 0.0009 | 0.0004 | 0 |
| KVLEYVIKV | 11829 | <0.0005 | 0.095 | 0.022 | 0.015 | 0 |
| FLWGPRALA | 11830 | <0.0006 | 0.027 | 0.0015 | 0 | 0 |
| ALREEEEGV | 11831 | <0.0006 | 0.0056 | 0 | 0 | 0 |
| ALAETSYVKV | 11832 | <0.0007 | 0.017 | 0.0011 | 0.0029 | 0 |
| YVIKVSARV | 11833 | 0.0005 | 0.018 | 0 | 0 | 0 |
| RALAETSYV | 11834 | <0.0006 | 0.014 | 0.0003 | 0.0005 | 0 |
| ALAETSYVK | 11835 | <0.0006 | 0.0002 | 0.17 | 0.39 | 0 |
| VLGTLEEV | 11836 | <0.0007 | 0.0088 | 0 | 0 | 0 |
| SLQLVFGI | 11837 | <0.0007 | 0.0094 | 0 | 0.0001 | 0 |
| ILESLFRA | 11838 | <0.0004 | 0.0017 | 0.0003 | 0 | 0.0011 |
| FLLLKYRA | 11839 | 0.0036 | 0.0007 | 0.0003 | 0.0001 | 0 |
| GLVCVQAA | 11840 | 0.0016 | 0.0008 | 0.0008 | 0 | 0 |
| VLVTCLGL | 11841 | <0.0007 | 0.0010 | 0.0001 | 0 | 0 |
| KVADLVGFL | 11842 | <0.0008 | 0.0091 | 0.0013 | 0.0005 | 0 |
| YVLVTCLGL | 11843 | | | | | |
| IMPKTGFLI | 11844 | <0.0008 | 0.0035 | 0 | 0 | 3.2 |
| GLLGDNQIM | 11845 | <0.0008 | 0.0054 | 0 | 0 | 0.0002 |
| GLVCVQAAT | 11846 | 0.0030 | 0.0007 | 0.0026 | 0 | 0.0001 |
| VADLVGFLL | 11847 | 0.032 | 0.0011 | 0.0054 | 0.0008 | 0.0007 |
| YLEYGRCRTV | 11848 | 0.0008 | 0.0097 | 0.0001 | 0 | 0 |
| SLQLVFGIDV | 11849 | 0.0028 | 0.0047 | 0.0013 | 0.0001 | 0.0001 |
| IMPKTGFLII | 11850 | <0.0008 | 0.0007 | 0 | 0 | 0.050 |
| ALGLVCVQAA | 11851 | 0.0011 | 0.0002 | 0.0003 | 0 | 0 |
| EIWEELSVMEV | 11852 | 0.0007 | 0.013 | 0.0001 | 0.0001 | 0 |
| FLIIVLVMIAM | 11853 | 0.023 | 0.0031 | 0.016 | 0.0014 | 0.0011 |
| VIPHAMSSCGV | 11854 | <0.0009 | 1.4 | 0 | 0 | 0 |
| CILESCFRAVI | 11855 | 0.079 | 0.0017 | 0.058 | 0.0005 | 0.0008 |
| QIMPKTGFLII | 11856 | <0.0009 | 0.0003 | 0 | 0 | 0.0030 |
| GFLLLKYRA | 11857 | | | 0.0004 | 0.0002 | |
| CFPEIFGKA | 11858 | | | 0 | 0 | |
| FFFPSLREA | 11859 | | | 0 | 0 | |
| FFPSLREAA | 11860 | | | 0 | 0 | |
| RSLHCKPEEA | 11861 | | | 0.0001 | 0.0008 | |
| EFLWGPRALA | 11862 | | | 0 | 0 | |
| RFFFPSLREA | 11863 | | | 0.0004 | 0 | |
| FFFPSLREAA | 11864 | | | 0 | 0 | |

TABLE 165

| | 1 | 2 | 3 | 4 | 5 | 6 | 7 | 8 | 9 |
|---|---|---|---|---|---|---|---|---|---|
| A | 2.6 | 0.03 | 0.87 | 0.87 | 0.65 | 0.87 | 4.4 | 0.29 | 0.16 |
| C | 0.73 | 0.01 | 1.9 | 4.8 | 0.87 | 1.2 | 1.2 | 1.1 | 0.01 |
| D | 0.10 | 0.01 | 0.10 | 0.65 | 0.29 | 0.65 | 0.11 | 0.87 | 0.01 |
| E | 0.10 | 0.01 | 0.10 | 0.65 | 0.29 | 0.65 | 0.11 | 0.87 | 0.01 |
| F | 7.0 | 0.01 | 5.2 | 0.87 | 8.7 | 2.0 | 2.3 | 2.6 | 0.01 |
| G | 3.5 | 0.01 | 0.44 | 1.1 | 1.1 | 1.3 | 0.44 | 0.44 | 0.01 |
| H | 3.1 | 0.01 | 0.22 | 1.0 | 0.87 | 0.09 | 0.1 | 01.3 | 0.01 |
| I | 3.1 | 0.14 | 1.8 | 0.55 | 0.87 | 1.4 | 1.2 | 1.8 | 0.40 |
| K | 3.1 | 0.01 | 0.22 | 1.0 | 0.87 | 0.09 | 0.10 | 1.3 | 0.01 |
| L | 3.1 | 1.00 | 1.8 | 0.55 | 0.87 | 1.4 | 1.2 | 1.8 | 0.09 |
| M | 3.1 | 2.00 | 1.8 | 0.55 | 0.87 | 1.4 | 1.2 | 1.8 | 0.06 |
| N | 0.50 | 0.01 | 0.37 | 1.2 | 0.87 | 1.1 | 0.65 | 0.33 | 0.01 |
| P | 0.12 | 0.01 | 0.70 | 0.73 | 2.6 | 1.8 | 2.9 | 0.10 | 0.01 |
| Q | 0.50 | 0.01 | 0.37 | 1.2 | 0.87 | 1.1 | 0.65 | 0.33 | 0.01 |
| R | 3.1 | 0.01 | 0.22 | 1.0 | 0.87 | 0.09 | 0.10 | 1.3 | 0.01 |
| S | 0.73 | 0.01 | 1.9 | 4.8 | 0.87 | 1.2 | 1.2 | 1.1 | 0.01 |
| T | 0.73 | 0.01 | 1.9 | 4.8 | 0.87 | 1.2 | 1.2 | 1.1 | 0.01 |
| V | 3.1 | 0.08 | 1.8 | 0.55 | 0.87 | 1.4 | 1.2 | 1.8 | 1.00 |
| W | 7.0 | 0.01 | 5.2 | 0.87 | 8.7 | 2.0 | 2.3 | 2.6 | 0.01 |
| Y | 7.0 | 0.01 | 5.2 | 0.87 | 8.7 | 2.0 | 2.3 | 2.6 | 0.01 |

TABLE 166

| Sequence | SEQ ID NO | Antigen | Strain | Molecule | Position | Motif | A1 | A2 | A3 | A11 | A24 | Max. |
|---|---|---|---|---|---|---|---|---|---|---|---|---|
| ALFLGFLGAA | 11865 | HIV | MN | gp160 | 518 | A02 | 0.4950 | | | | | 0.4950 |
| MLQLTVWGI | 11866 | HIV | MN | gp160 | 566 | A02 | 0.2450 | | | | | 0.2450 |
| RVIEVLQRA | 11867 | HIV | MN | gp160 | 829 | A02 | 0.1963 | | | | | 0.1963 |
| KLTPLCVTL | 11868 | HIV | MN | gp160 | 120 | A02 | 0.1600 | | | | | 0.1600 |
| LLIAARIVEL | 11869 | HIV | MN | gp160 | 776 | A02 | 0.1550 | | | | | 0.1550 |
| SLLNATDIAV | 11870 | HIV | MN | gp160 | 814 | A02 | 0.1050 | | | | | 0.1050 |
| ALFLGFLGA | 11871 | HIV | MN | gp160 | 518 | A02 | 0.0945 | | | | | 0.0945 |
| HMLQLTVWGI | 11872 | HIV | MN | gp160 | 565 | A02 | 0.0677 | | | | | 0.0677 |
| LLNATDIAV | 11873 | HIV | MN | gp160 | 815 | A02 | 0.0607 | | | | | 0.0607 |

TABLE 166-continued

| Sequence | SEQ ID NO | Antigen | Strain | Molecule | Position | Motif | A1 | A2 | A3 | A11 | A24 | Max. |
|---|---|---|---|---|---|---|---|---|---|---|---|---|
| ALLYKLDIV | 11874 | HIV | MN | gp160 | 179 | A02 | 0.0362 | | | | | 0.0362 |
| WLWYIKIFI | 11875 | HIV | MN | gp160 | 679 | A02 | 0.0355 | | | | | 0.0355 |
| TIIVHLNESV | 11876 | HIV | MN | gp160 | 288 | A02 | 0.0350 | | | | | 0.0350 |
| LLQYWSQEL | 11877 | HIV | MN | gp160 | 800 | A02 | 0.0265 | | | | | 0.0265 |
| IMIVGGLVGL | 11878 | HIV | MN | gp160 | 687 | A02 | 0.0252 | | | | | 0.0252 |
| LLYKLDIVSI | 11879 | HIV | MN | gp160 | 180 | A02 | 0.0245 | | | | | 0.0245 |
| FLAIIWVDL | 11880 | HIV | MN | gp160 | 753 | A02 | 0.0233 | | | | | 0.0233 |
| TLQCKIKQII | 11881 | HIV | MN | gp160 | 415 | A02 | 0.0200 | | | | | 0.0200 |
| GLVGLRIVFA | 11882 | HIV | MN | gp160 | 692 | A02 | 0.0195 | | | | | 0.0195 |
| FLGAAGSTM | 11883 | HIV | MN | gp160 | 523 | A02 | 0.0190 | | | | | 0.0190 |
| IISLWDQSL | 11884 | HIV | MN | gp160 | 107 | A02 | 0.0179 | | | | | 0.0179 |
| TVWGIKQLQA | 11885 | HIV | MN | gp160 | 570 | A02 | 0.0150 | | | | | 0.0150 |
| LLGRRGWEV | 11886 | HIV | MN | gp160 | 785 | A02 | 0.0142 | | | | | 0.0142 |
| AVLSIVNRV | 11887 | HIV | MN | gp160 | 701 | A02 | 0.0132 | | | | | 0.0132 |
| FIMIVGGLV | 11888 | HIV | MN | gp160 | 686 | A02 | 0.0131 | | | | | 0.0131 |
| LLNATDIAVA | 11889 | HIV | MN | gp160 | 815 | A02 | 0.0117 | | | | | 0.0117 |
| FLYGALLLA | 11890 | PLP | Human | | 80 | A02 | 1.9000 | | | | | 1.9000 |
| SLLTFMIAA | 11891 | PLP | Human | | 253 | A02 | 0.5300 | | | | | 0.5300 |
| FMIAATYNFAV | 11892 | PLP | Human | | 257 | A02 | 0.4950 | | | | | 0.4950 |
| RMYGVLPWI | 11893 | PLP | Human | | 205 | A02 | 0.1650 | | | | | 0.1650 |
| IAATYNFAV | 11894 | PLP | Human | | 259 | A02 | 0.0540 | | | | | 0.0540 |
| GLLECCARCLV | 11895 | PLP | Human | | 2 | A02 | 0.0515 | | | | | 0.0515 |
| WALTVVWLL | 11896 | PLP | Human | | 157 | A02 | 0.0415 | | | | | 0.0415 |
| ALTVVWLLV | 11897 | PLP | Human | | 158 | A02 | 0.0390 | | | | | 0.0390 |
| FLYGALLL | 11898 | PLP | Human | | 80 | A02 | 0.0345 | | | | | 0.0345 |
| SLCADARMYGV | 11899 | PLP | Human | | 199 | A02 | 0.0140 | | | | | 0.0140 |
| LLVFACSAV | 11900 | PLP | Human | | 164 | A02 | 0.0107 | | | | | 0.0107 |

TABLE 167

| Criteria | Cut-off | Good Binders | Intermediate Binders | Weak Binders | Negative Binders | Totals |
|---|---|---|---|---|---|---|
| 2.9 motif | | 19 (12%) | 36 (22%) | 58 (36%) | 48 (30%) | 161 (100%) |
| Grouped Ratio | 1.5 | 5 (83%) | 1 (17%) | 0 (0%) | 0 (0%) | 6 (100%) |
| Algorithm | 1.25 | 8 (67%) | 4 (33%) | 0 (0%) | 0 (0%) | 12 (100%) |
| | | 10 (50%) | 9 (45%) | 1 (5%) | 0 (0%) | 20 (100%) |
| | 0.5 | 12 (32%) | 17 (46%) | 7 (19%) | 1 (3%) | 37 (100%) |
| | 0 | 12 (23%) | 26 (49%) | 12 (23%) | 3 (6%) | 53 (100%) |
| | −1 | 17 (18%) | 35 (37%) | 33 (35%) | 10 (11%) | 95 (100%) |
| | −2 | 19 (15%) | 36 (29%) | 50 (40%) | 21 (17%) | 126 (100%) |
| | −3 | 19 (13%) | 36 (24%) | 56 (38%) | 38 (26%) | 149 (100%) |
| | no cut | 19 (12%) | 36 (22%) | 58 (36%) | 48 (30%) | 161 (100%) |
| Log of Binding | −19 | 5 (100%) | 0 (0%) | 0 (0%) | 0 (0%) | 5 (100%) |
| Algorithm | −20 | 8 (73%) | 3 (27%) | 0 (0%) | 0 (0%) | 11 (100%) |
| | −21 | 15 (43%) | 15 (43%) | 5 (14%) | 0 (0%) | 35 (100%) |
| | −22 | 17 (26%) | 27 (41%) | 21 (32%) | 1 (2%) | 68 (100%) |
| | −23 | 18 (19%) | 35 (37%) | 34 (36%) | 7 (7%) | 94 (100%) |
| | −24 | 18 (16%) | 36 (30%) | 47 (39%) | 17 (14%) | 119 (100%) |
| | −25 | 19 (14%) | 36 (26%) | 55 (39%) | 30 (21%) | 140 (100%) |
| | no cut | 19 (12%) | 36 (22%) | 58 (36%) | 48 (30%) | 161 (100%) |

TABLE 168

| | 1 | 2 | 3 | 4 | 5 | 6 | 7 | 8 | 9 |
|---|---|---|---|---|---|---|---|---|---|
| A | −2.38 | −3.22 | −2.80 | −2.68 | −2.89 | −2.70 | −2.35 | −3.07 | −2.49 |
| C | −2.94 | −4.00 | −2.58 | −1.96 | −3.29 | −2.22 | −2.97 | −2.37 | −4.00 |
| D | −3.69 | −4.00 | −3.46 | −2.71 | −2.26 | −2.63 | −3.61 | −3.03 | −4.00 |
| E | −3.64 | −4.00 | −3.51 | −2.65 | −3.39 | −3.41 | −3.21 | −2.63 | −4.00 |
| F | −1.89 | −4.00 | −2.35 | −2.50 | −1.34 | −2.43 | −2.18 | −1.71 | −4.00 |
| G | −2.32 | −4.00 | −3.04 | −2.63 | −2.56 | −2.30 | −3.13 | −2.96 | −4.00 |
| H | −2.67 | −4.00 | −2.58 | −2.58 | −2.05 | −3.32 | −3.13 | −2.16 | −4.00 |
| I | −1.65 | −2.55 | −2.80 | −3.44 | −2.74 | −2.79 | −2.20 | −2.69 | −2.10 |
| K | −2.51 | −4.00 | −3.65 | −2.93 | −3.34 | −3.77 | −3.13 | −3.27 | −4.00 |
| L | −2.32 | −1.70 | −2.02 | −2.49 | −2.71 | −2.63 | −2.62 | −2.01 | −2.74 |
| M | −0.39 | −1.39 | −1.79 | −3.07 | −3.43 | −1.38 | −1.33 | −0.97 | −2.96 |
| N | −3.12 | −4.00 | −3.52 | −2.22 | −2.36 | −2.30 | −3.14 | −3.31 | −4.00 |
| P | −3.61 | −4.00 | −2.97 | −2.64 | −2.42 | −2.31 | −1.83 | −2.42 | −4.00 |
| Q | −2.76 | −4.00 | −2.81 | −2.63 | −3.06 | −2.84 | −2.12 | −3.05 | −4.00 |
| R | −1.92 | −4.00 | −3.41 | −2.61 | −3.05 | −3.76 | −3.43 | −3.02 | −4.00 |
| S | −2.39 | −3.52 | −2.04 | −2.12 | −2.83 | −3.04 | −2.73 | −2.02 | −4.00 |
| T | −2.92 | −4.00 | −2.60 | −2.48 | −2.17 | −2.58 | −2.67 | −3.14 | −3.70 |
| V | −2.44 | −2.64 | −2.68 | −3.29 | −2.49 | −2.24 | −2.68 | −2.83 | −1.70 |
| W | −0.14 | −4.00 | −1.01 | −2.94 | −1.63 | −2.77 | −2.85 | −2.13 | −4.00 |
| X | −1.99 | −2.13 | −2.41 | −2.97 | −2.72 | −2.70 | −2.41 | −2.35 | −2.42 |
| Y | −1.46 | −4.00 | −1.67 | −2.70 | −1.92 | −2.39 | −1.35 | −3.37 | −4.00 |

TABLE 169

| | 1 | 2 | 3 | 4 | 5 | 6 | 7 | 8 | 9 | 10 |
|---|---|---|---|---|---|---|---|---|---|---|
| A | 3.00 | 0.01 | 3.10 | 0.20 | 1.60 | 0.60 | 1.30 | 1.60 | 0.50 | 0.01 |
| C | 0.90 | 0.01 | 0.90 | 1.10 | 1.00 | 0.90 | 1.40 | 1.30 | 2.90 | 0.01 |

TABLE 169-continued

| | 1 | 2 | 3 | 4 | 5 | 6 | 7 | 8 | 9 | 10 |
|---|---|---|---|---|---|---|---|---|---|---|
| D | 0.01 | 0.01 | 0.20 | 0.60 | 0.30 | 1.00 | 0.30 | 0.01 | 0.40 | 0.01 |
| E | 0.01 | 0.01 | 0.20 | 0.60 | 0.30 | 1.00 | 0.30 | 0.01 | 0.40 | 0.01 |
| F | 3.00 | 0.01 | 2.60 | 3.10 | 3.60 | 0.60 | 1.60 | 14.1 | 2.10 | 0.01 |
| G | 0.80 | 0.01 | 0.50 | 4.70 | 0.80 | 6.30 | 2.70 | 0.70 | 0.80 | 0.01 |
| H | 1.20 | 0.01 | 0.30 | 0.10 | 0.70 | 0.40 | 0.20 | 0.01 | 0.20 | 0.01 |
| I | 3.00 | 0.50 | 10.2 | 1.00 | 1.30 | 2.10 | 1.40 | 4.70 | 0.80 | 1.00 |
| K | 1.20 | 0.01 | 0.30 | 0.10 | 0.70 | 0.40 | 0.20 | 0.01 | 0.20 | 0.01 |
| L | 3.00 | 1.10 | 10.2 | 1.00 | 1.30 | 2.10 | 1.40 | 4.70 | 0.80 | 0.50 |
| M | 3.00 | 0.60 | 10.2 | 1.00 | 1.30 | 2.10 | 1.40 | 4.70 | 0.80 | 0.01 |
| N | 1.00 | 0.01 | 0.90 | 0.80 | 0.80 | 0.80 | 0.60 | 0.40 | 0.70 | 0.01 |
| P | 0.00 | 0.01 | 0.40 | 2.60 | 0.01 | 1.00 | 0.40 | 1.90 | 1.20 | 0.01 |
| Q | 1.00 | 0.01 | 0.90 | 0.80 | 0.80 | 0.80 | 0.60 | 0.40 | 0.70 | 0.01 |
| R | 1.20 | 0.01 | 0.30 | 0.10 | 0.70 | 0.40 | 0.20 | 0.01 | 0.20 | 0.01 |
| S | 0.90 | 0.01 | 0.90 | 1.10 | 1.00 | 0.90 | 1.40 | 1.30 | 2.90 | 0.01 |
| T | 0.90 | 0.01 | 0.90 | 1.10 | 1.00 | 0.90 | 1.40 | 1.30 | 2.90 | 0.01 |
| V | 3.00 | 0.10 | 10.2 | 1.00 | 1.30 | 2.10 | 1.40 | 4.70 | 0.80 | 2.30 |
| W | 3.00 | 0.01 | 2.60 | 3.10 | 3.60 | 0.60 | 1.60 | 14.1 | 2.10 | 0.01 |
| Y | 3.00 | 0.01 | 2.60 | 3.10 | 3.60 | 0.60 | 1.60 | 14.1 | 2.10 | 0.01 |

TABLE 170

| | 1 | 2 | 3 | 4 | 5 |
|---|---|---|---|---|---|
| A | −2.40 | −4.00 | −2.54 | −3.42 | −3.07 |
| C | −3.64 | −4.00 | −2.47 | −2.48 | −1.78 |
| D | −3.65 | −4.00 | −2.76 | −3.26 | −2.76 |
| E | −3.92 | −4.00 | −3.63 | −3.34 | −3.73 |
| F | −1.52 | −4.00 | −1.96 | −3.03 | −2.01 |
| G | −2.91 | −4.00 | −3.40 | −2.63 | −2.98 |
| H | −3.61 | −4.00 | −3.10 | −3.03 | −2.33 |
| I | −2.26 | −4.00 | −2.82 | −3.05 | −2.38 |
| K | −2.53 | −4.00 | −3.65 | −3.42 | −3.14 |
| L | −2.00 | −2.93 | −2.21 | −2.48 | −2.88 |
| M | −2.41 | −3.11 | −2.00 | −3.33 | −3.70 |
| N | −3.21 | −4.00 | −3.09 | −2.61 | −2.93 |
| P | −3.90 | −4.00 | −3.21 | −2.27 | −3.72 |
| Q | −2.92 | −4.00 | −2.97 | −4.00 | −2.98 |
| R | −3.01 | −4.00 | −3.44 | −3.50 | −3.23 |
| S | −2.47 | −4.00 | −3.17 | −3.11 | −3.23 |
| T | −3.59 | −4.00 | −3.07 | −2.88 | −2.89 |
| V | −2.97 | −4.00 | −2.46 | −3.14 | −3.27 |
| W | −2.10 | −4.00 | −2.72 | −1.79 | −2.65 |
| Y | −2.37 | −4.00 | −2.42 | −2.85 | −3.03 |

TABLE 170-continued

| | 6 | 7 | 8 | 9 | 10 |
|---|---|---|---|---|---|
| A | −3.30 | −2.98 | −2.69 | −3.29 | −4.00 |
| C | −3.94 | −1.28 | −3.10 | −2.43 | −4.00 |
| D | −3.03 | −3.43 | −3.68 | −3.63 | −4.00 |
| E | −2.82 | −3.54 | −3.71 | −2.95 | −4.00 |
| F | −3.11 | −2.67 | −1.61 | −2.43 | −4.00 |
| G | −2.45 | −2.52 | −3.18 | −3.03 | −4.00 |
| H | −2.99 | −3.70 | −3.55 | −4.00 | −4.00 |
| I | −2.61 | −2.38 | −3.34 | −3.18 | −1.47 |
| K | −3.58 | −3.50 | −3.53 | −4.00 | −4.00 |
| L | −2.53 | −2.57 | −1.83 | −3.23 | −3.20 |
| M | −2.56 | −3.27 | −2.25 | −3.00 | −4.00 |
| N | −2.89 | −3.52 | −3.01 | −2.88 | −4.00 |
| P | −3.06 | −3.35 | −2.58 | −2.94 | −4.00 |
| Q | −3.46 | −2.20 | −3.23 | −3.45 | −4.00 |
| R | −3.32 | −3.72 | −3.59 | −2.97 | −4.00 |
| S | −2.64 | −3.19 | −2.79 | −2.26 | −4.00 |
| T | −3.16 | −2.43 | −3.11 | −2.58 | −4.00 |
| V | −2.53 | −3.14 | −3.02 | −2.90 | −2.61 |
| W | −1.92 | −1.80 | −2.24 | −2.11 | −4.00 |
| Y | −3.76 | −2.82 | −2.34 | −2.74 | −4.00 |

TABLE 171

| Criteria | Cut-off | Good Binders | Intermediate Binders | Weak Binders | Negative Binders | Totals |
|---|---|---|---|---|---|---|
| 2,10 motif | | 10 (6%) | 29 (17%) | 70 (41%) | 61 (36%) | 170 (100%) |
| Grouped Ratio | 4 | 1 (100%) | 0 (0%) | 0 (0%) | 0 (0%) | 1 (100%) |
| Algorithm | 3 | 1 (25%) | 2 (50%) | 1 (25%) | 0 (0%) | 4 (100%) |
| | 2 | 6 (24%) | 13 (52%) | 6 (24%) | 0 (0%) | 25 (100%) |
| | 1 | 10 (21%) | 21 (45%) | 16 (34%) | 0 (0%) | 47 (100%) |
| | 0 | 10 (15%) | 28 (42%) | 26 (39%) | 2 (3%) | 66 (100%) |
| | −1 | 10 (11%) | 29 (32%) | 42 (46%) | 11 (12%) | 92 (100%) |
| | −2 | 10 (9%) | 29 (25%) | 54 (47%) | 23 (20%) | 116 (100%) |
| | −3 | 10 (7%) | 29 (22%) | 63 (47%) | 32 (24%) | 134 (100%) |
| | no cut | 10 (6%) | 29 (17%) | 70 (41%) | 61 (36%) | 170 (100%) |
| Log of Binding | −24 | 2 (50%) | 2 (50%) | 0 (0%) | 0 (0%) | 4 (100%) |
| Algorithm | −25 | 5 (56%) | 3 (33%) | 1 (11%) | 0 (0%) | 9 (100%) |
| | −26 | 7 (47%) | 5 (33%) | 3 (20%) | 0 (0%) | 15 (100%) |
| | −27 | 10 (32%) | 9 (29%) | 12 (39%) | 0 (0%) | 31 (100%) |
| | −28 | 10 (17%) | 18 (33%) | 29 (50%) | 0 (0%) | 58 (100%) |
| | −29 | 10 (12%) | 25 (30%) | 48 (58%) | 0 (0%) | 83 (100%) |
| | −30 | 10 (10%) | 29 (28%) | 59 (57%) | 5 (5%) | 103 (100%) |
| | −31 | 10 (8%) | 28 (22%) | 66 (51%) | 24 (19%) | 128 (100%) |
| | −32 | 10 (7%) | 29 (19%) | 70 (47%) | 40 (27%) | 148 (100%) |
| | no cut | 10 (6%) | 29 (17%) | 70 (41%) | 61 (36%) | 170 (100%) |

TABLE 172

| SEQUENCE | SEQ ID NO. | SOURCE | A2.1 Binding | Algorithm Score |
|---|---|---|---|---|
| MMWFVVLTV | 11901 | CMV | 0.76 | 346 |
| YLLLYFSPV | 11902 | CMV | 0.75 | 312 |
| YLYRLNFCL | 11903 | CMV | 0.72 | 169 |
| FMQTYLVTL | 11904 | CMV | 0.68 | 336 |
| LLWWITILL | 11905 | CMV | 0.49 | 356 |
| GLWCVLFFV | 11906 | CMV | 0.47 | 1989 |
| LMIRGVLEV | 11907 | CMV | 0.45 | 296 |
| LLLCRLPFL | 11908 | CMV | 0.42 | 1356 |
| RLLLTSLFFL | 11909 | HSV | 0.34 | 859 |
| LLLYYDYSL | 11910 | HSV | 0.28 | 390 |
| AMSRNLFRV | 11911 | CMV | 0.15 | 1746 |
| AMLTACVEV | 11912 | CMV | 0.089 | 411 |
| RLQPNVPLV | 11913 | CMV | 0.048 | 392 |
| VLARTFTPV | 11914 | CMV | 0.044 | 1969 |
| RLLRGURL | 11915 | CMV | 0.037 | 494 |
| WMWFPSVLL | 11916 | CMV | 0.036 | 362 |
| YLCCGITLL | 11917 | CMV | 0.021 | 1043 |
| DMLGRVFFV | 11918 | HSV | 0.011 | 1422 |
| ALBRYQQLV | 11919 | CMV | 0.0089 | 184 |
| LMPPPVAEL | 11920 | CMV | 0.0066 | 416 |

TABLE 172-continued

| SEQUENCE | SEQ ID NO. | SOURCE | A2.1 Binding | Algorithm Score |
|---|---|---|---|---|
| LMCRYTPRL | 11921 | CMV | 0.0055 | 414 |
| RLTWRLTWL | 11922 | CMV | 0.0052 | 250 |
| AMPRRVLHA | 11923 | CMV | 0.0014 | 628 |
| ALLLVLALL | 11924 | CMV | 0.0014 | 535 |
| AMSFTFTTL | 11925 | CMV | 0.0005 | 602 |
| MLNVMKEAV | 11926 | CMV | 0.0039 | 0.00031 |
| TMELMIRTV | 11927 | CMV | 0.0029 | 0.0013 |
| TLAA MHYSKL | 11928 | HSV | 0.0008 | 0.0019 |
| TLNIVRDHV | 11929 | CMV | 0.0005 | 0.00021 |
| ELSIFRERL | 11930 | HSV | 0.0002 | 0.0020 |
| FLRVQQKAL | 11931 | HSV | 0.0002 | 0.00099 |
| ELQMMQDWV | 11932 | CMV | 0.0001 | 0.0020 |
| QLNAMKPDL | 11933 | MT | 0.0001 | 0.0017 |
| GLRQLKGAL | 11934 | CMV | 0.0001 | 0.0010 |
| TLRMSSKAV | 11935 | HSV | 0.0001 | 0.00085 |
| SLRIKRELL | 11936 | CMV | 0 | 0.00041 |
| DLKQMERVV | 11937 | CMV | 0 | 0.00026 |
| PLRVTPSDL | 11938 | CMV | 0 | 0.0019 |
| QLDYEKQVL | 11939 | CMV | 0 | 0.0012 |
| WLKLLRDAL | 11940 | CMV | 0 | 0.0012 |

TABLE 172-continued

| SEQUENCE | SEQ ID NO. | SOURCE | A2.1 Binding | Algorithm Score |
|---|---|---|---|---|
| PMEAVRHPL | 11941 | CMV | 0 | 0.0011 |
| ELKQTRVNL | 11942 | CMV | 0 | 0.00053 |
| NLEVIHDAL | 11943 | CMV | 0 | 0.00050 |
| ELKKVSVL | 11944 | HSV | 0 | 0.00033 |
| PLAYERDKL | 11945 | CMV | 0 | 0.00017 |

TABLE 173

| Set | Good Binders | Intermediate Binders | Weak Binders | Negative Binders | Totals |
|---|---|---|---|---|---|
| HI Scorers | 11 (52.4%) | 5 (23.8%) | 5 (23.8%) | 0 (0.0%) | 21 (100%) |
| Low Scorers | 0 (0.0%) | 0 (0.0%) | 10 (50.0%) | 10 (50.0%) | 20 (100%) |
| Totals | 11 (26.6%) | 5 (12.2%) | 15 (36.6%) | 10 (24.4%) | 41 (100%) |

TABLE 174

Binding and Immunogenicity
HBV Polymerase (ayw)

| Peptide | | | | | | | | | CTL Binding** | Activity | Algorithm | Seq ID NO. |
|---|---|---|---|---|---|---|---|---|---|---|---|---|
| 1 | 2 | 3 | 4 | 5 | 6 | 7 | 8 | 9 | | | | |
| F | L | L | S | L | G | I | H | L | 0.52 | 63 | −20.8 | 11946 |
| G | L | Y | S | S | T | V | P | V | 0.15 | 10 | −21.9 | 11947 |
| H | Y | L | S | H | P | I | I | L | 0.13 | 10 | −21.1 | 11948 |
| W | I | L | R | G | T | S | F | V | 0.018 | −+ | −20.9 | 11949 |
| N | L | S | W | L | S | L | D | V | 0.013 | 6 | −24.7 | 11950 |
| L | L | S | S | N | L | S | W | L | 0.005 | — | −21.7 | 11951 |
| N | L | Q | S | L | T | N | L | L | 0.003 | — | −23.9 | 11952 |
| H | L | L | V | G | S | S | G | L | 0.002 | — | −24.7 | 11953 |
| L | L | D | D | E | A | G | P | L | 0.0002 | — | −25.5 | 11954 |
| P | L | E | E | E | L | P | R | L | 0.0001 | — | −26.1 | 11955 |
| D | L | N | L | G | N | L | N | V | — | — | −25.7 | 11956 |
| N | L | Y | V | S | L | L | L | L | — | — | −23.6 | 11957 |
| P | L | P | I | H | T | A | E | L | — | — | −25.04 | 11958 |

*− = <0.0001
**Relative binding capacity compared to std with IC50 = 52 mM
xxx Lytic units/106 cells; 1 lytic unit = the number of effector cells required to give 30% Cr51 release.
−,−+ no measurable cytotoxic activity.

TABLE 175

Binding and Immunogenicity
HBV Polymerase (ayw)

| Peptide | | | | | | | | | SEQ ID NO | Binding** | CTL Activity | Algorithm |
|---|---|---|---|---|---|---|---|---|---|---|---|---|
| 1 | 2 | 3 | 4 | 5 | 6 | 7 | 8 | 9 | | | | |
| F | L | L | S | L | G | I | H | L | 11959 | 0.52 | 63 | −20.8 |
| G | L | Y | S | S | T | V | P | V | 11960 | 0.15 | 10 | −21.9 |
| H | L | Y | S | H | P | I | I | L | 11961 | 0.13 | 10 | −21.1 |
| W | I | L | R | G | T | S | F | V | 11962 | 0.018 | −+ | −20.9 |
| N | L | S | W | L | S | L | D | V | 11963 | 0.013 | 6 | −24.7 |
| L | L | S | S | N | L | S | W | L | 11964 | 0.005 | — | −21.7 |
| N | L | Q | S | L | T | N | L | L | 11965 | 0.003 | — | −23.9 |
| H | L | L | V | G | S | S | G | L | 11966 | 0.002 | — | −24.7 |
| L | L | D | D | E | A | G | P | L | 11967 | 0.0002 | — | −25.5 |
| P | L | E | E | E | L | P | R | L | 11968 | 0.0001 | — | −26.1 |
| D | L | N | L | G | N | L | N | V | 11969 | −* | — | −25.7 |

TABLE 175-continued

| Binding and Immunogenicity HBV Polymerase (ayw) | | | | | | | | | | | | |
|---|---|---|---|---|---|---|---|---|---|---|---|---|
| Peptide | | | | | | | | | SEQ ID NO | Binding** | CTL Activity | Algorithm |
| N | L | Y | V | S | L | L | L | L | 11970 | — | — | −23.6 |
| P | L | P | I | H | T | A | E | L | 11971 | — | — | −25.04 |

*− = <0.0001
** Relative binding capacity compared to std with $IC_{50}$ = 52 mM xxx Lytic units/$10^6$ cells;
1 lytic unit = the number of effector cells required to give 30% $Cr^{51}$ release.
−,−+ no measurable cytotoxic activity.

TABLE 176

| Sequence | SEQ ID NO | Antigen | Molecule | A2 Bind. |
|---|---|---|---|---|
| KIFGSLAFL | 11972 | c-ERB2 | | 0.1500 |
| RILHNGAYSL | 11973 | c-ERB2 | | 0.0180 |
| IISAVVGILL | 11974 | c-ERB2 | | 0.0120 |
| MMWFVVLTV | 11975 | CMV | | 0.7600 |
| YLLLYFSPV | 11976 | CMV | | 0.7500 |
| YLYRLNFCL | 11977 | CMV | | 0.7200 |
| FMWTYLVTL | 11978 | CMV | | 0.6800 |
| LLWWITILL | 11979 | CMV | | 0.4900 |
| GLWCVLFFV | 11980 | CMV | | 0.4700 |
| LMIRGVLEV | 11981 | CMV | | 0.4500 |
| LLLCRLPFL | 11982 | CMV | | 0.4200 |
| AMSRNLFRV | 11983 | CMV | | 0.1500 |
| AMLTACVEV | 11984 | CMV | | 0.1000 |
| RLQPNVPLV | 11985 | CMV | | 0.0480 |
| VLARTFTPV | 11986 | CMV | | 0.0440 |
| RLLRGLIRL | 11987 | CMV | | 0.0370 |
| WMWFPSVLL | 11988 | CMV | | 0.0360 |
| YLCCGITLL | 11989 | CMV | | 0.0210 |
| SLLTEVETYV | 11990 | FLU-A | M1 | 0.0650 |
| LLTEVETYV | 11991 | FLU-A | M1 | 0.2000 |
| LLTEVETYVL | 11992 | FLU-A | M1 | 0.0130 |
| GILGFVFTL | 11993 | FLU-A | M1 | 0.1900 |
| GILGFVFTLT | 11994 | FLU-A | M1 | 0.0150 |
| ILGFVFTLT | 11995 | FLU-A | M1 | 0.2600 |
| ILGFVFTLTV | 11996 | FLU-A | M1 | 0.0550 |
| ALASCMGLI | 11997 | FLU-A | M1 | 0.0110 |
| RMGAVTTEV | 11998 | FLU-A | M1 | 0.0200 |
| VTTEVAFGL | 11999 | FLU-A | M1 | 0.0360 |
| MVTTTNPLI | 12000 | FLU-A | M1 | 0.0150 |
| FTFSPTYKA | 12001 | HBV | POL | 0.0190 |
| YLHTLWKAGI | 12002 | HBV | POL | 0.0280 |
| LMLQAGFFLV | 12003 | HBV(a) | ENV(a) | 0.6300 |
| RMLTIPQSV | 12004 | HBV(a) | ENV(a) | 0.0580 |
| SLDSWWTSV | 12005 | HBV(a) | ENV(a) | 0.1000 |
| FMLLLCLIFL | 12006 | HBV(a) | ENV(a) | 0.0450 |
| LLPFVQWFV | 12007 | HBV(a) | ENV(a) | 0.6500 |
| LMPFVQWFV | 12008 | HBV(a) | ENV(a) | 0.8300 |
| FLGLSPTVWV | 12009 | HBV(a) | ENV(a) | 0.0300 |
| SMLSPFLPLV | 12010 | HBV(a) | ENV(a) | 0.9700 |
| GLWIRTPPV | 12011 | HBV(a) | ENV(a) | 0.3600 |
| NLGNLNVSV | 12012 | HBV(a) | ENV(a) | 0.0160 |
| YLHTLWKAGV | 12013 | HBV(a) | POL(a) | 0.1500 |
| RLTGGVFLV | 12014 | HBV(a) | POL(a) | 0.1600 |
| RMTGGVFLV | 12015 | HBV(a) | POL(a) | 0.1500 |
| RLTGGVFLV | 12016 | HBV(a) | ENV(a) | 0.1600 |
| ILGLLGFAV | 12017 | HBV(a) | ENV(a) | 0.0600 |
| GLCQVFADV | 12018 | HBV(a) | ENV(a) | 0.0300 |
| WLLRGTSFV | 12019 | HBV(a) | ENV(a) | 0.1000 |
| YLPSALNPV | 12020 | HBV(a) | ENV(a) | 0.3200 |
| LLVPFVQWFA | 12021 | HBV adr | | 0.2600 |
| FLPSDFFPSI | 12022 | HBV adr | | 0.2100 |
| VVSYVNVNM | 12023 | HBV adr | | 0.0100 |
| HLPDRVHFA | 12024 | HBV adr | | 0.0160 |
| SLAFSAVPA | 12025 | HBV adr | | 0.0340 |
| FLLTRILTI | 12026 | HBV adw | | 0.6300 |
| SLYNILSPFM | 12027 | HBV adw | | 0.0440 |
| CLFHIVNLI | 12028 | HBV adw | | 0.2100 |
| RLPDRVHFA | 12029 | HBV adw | | 0.0940 |
| ALPPASPSA | 12030 | HBV adw | | 0.0710 |

TABLE 176-continued

| Sequence | SEQ ID NO | Antigen | Molecule | A2 Bind. |
|---|---|---|---|---|
| GLLGWSPQA | 12031 | HBV ayw | | 0.8650 |
| FLGPLLVLQA | 12032 | HBV ayw | | 0.0190 |
| FLLTRILTI | 12033 | HBV ayw | | 0.9300 |
| GMLPVCPLI | 12034 | HBV ayw | | 0.0520 |
| QLFHLCLII | 12035 | HBV ayw | | 0.0390 |
| KLCLGWLWGM | 12036 | HBV ayw | | 0.0210 |
| LLWFHISCLI | 12037 | HBV ayw | | 0.0130 |
| YLVSFGVWI | 12038 | HBV ayw | | 2.7000 |
| LLEDWGPCA | 12039 | HBV ayw | | 0.0180 |
| KLHLYSHPI | 12040 | HBV ayw | | 0.2900 |
| FLLAQFTSA | 12041 | HBV ayw | | 0.6600 |
| LLAQFTSAI | 12042 | HBV ayw | | 9.6000 |
| YMDDVVLGA | 12043 | HBV ayw | | 0.1600 |
| ALMPLYACI | 12044 | HBV ayw | | 0.2000 |
| GLCQVFADA | 12045 | HBV ayw | | 0.0180 |
| HLPDLVHFA | 12046 | HBV ayw | | 0.1100 |
| RLCCQLDPA | 12047 | HBV ayw | | 0.0290 |
| ALMPLYACI | 12048 | HBV ayw polymerase | | 0.5000 |
| FLCKQYLNL | 12049 | HBV ayw polymerase 665-673 | | 0.0210 |
| SLYADSPSV | 12050 | HBV polymerase | | 0.3500 |
| ALMPLYASI | 12051 | HBV polymerase | | 0.0760 |
| NLNNLNVSI | 12052 | HBV polymerase | | 0.0660 |
| ALSLIVNLL | 12053 | HBV polymerase | | 0.0470 |
| KLHLYSHPI | 12054 | HBV polymerase | | 0.2900 |
| WILRGTSFV | 12055 | HBV polymerase 1344-1352 | | 0.0270 |
| LVLQAGFFLL | 12056 | HBVadr | ENV | 0.0150 |
| FILLLCLIFL | 12057 | HBVadr | ENV | 0.0280 |
| WILRGTSFV | 12058 | HBVadr | POL | 0.0180 |
| IISCTCPTV | 12059 | HBVadw | PreCore | 0.0190 |
| LVPFVQWFV | 12060 | HBVadw | ENV | 0.0200 |
| LIISCSCPTV | 12061 | HBVadw | CORE | 0.0290 |
| FLPSDFFPSI | 12062 | HBVayr | PreCore | 0.2100 |
| LLCLGWLWGM | 12063 | HBVayr | PreCore | 0.0220 |
| QLFHLCLII | 12064 | HBVayw | PreCore | 0.0390 |
| CLGWLTGMDI | 12065 | HBVayw | PreCore | 0.0190 |
| FLGGTTVCL | 12066 | HBVayw | ENV | 0.1700 |
| SLYSILSPFL | 12067 | HBVayw | ENV | 0.2000 |
| FLPSDFFPS V | 12068 | HBVayw | CORE | 1.5000 |
| ILCWGELMTL | 12069 | HBVayw | CORE | 0.1900 |
| LMTLATWVGV | 12070 | HBVayw | CORE | 0.6800 |
| TLATWVGVNL | 12071 | HBVayw | CORE | 0.5700 |
| GLSRYVARL | 12072 | HBVayw | POL | 0.1200 |
| FLCKQYLNL | 12073 | HBVayw | POL | 0.1700 |
| RMRGTFSAPL | 12074 | HBVayw | POL | 0.0110 |
| SLYADSPSV | 12075 | HBVayw | POL | 0.3500 |
| YLYGVGSAV | 12076 | HCV | | 0.1600 |
| LLSTTEWQV | 12077 | HCV | | 0.0480 |
| IIGAETFYV | 12078 | HIV | POL | 0.0260 |
| QLWVTVYYGV | 12079 | HIV | ENV | 0.0250 |

TABLE 176-continued

| Sequence | SEQ ID NO | Antigen | Molecule | A2 Bind. |
|---|---|---|---|---|
| NLWVTVYYGV | 12080 | HIV | ENV | 0.0160 |
| KLWVTVYYGV | 12081 | HIV | ENV | 0.0150 |
| KLWVTVYYGV | 12082 | HIV.MN gp160 | | 0.0150 |
| YMLDLQPET | 12083 | HPV16 | E7 | 1.4000 |
| TLGIVCPI | 12084 | HPV16 | E7 | 0.6500 |
| YLLDLQEPV | 12085 | HPV 16(a) | E7 (a) | 0.2200 |
| YMLDLQPEV | 12086 | HPV 16(a) | E7 (a) | 1.9000 |
| MLDLQPETT | 12087 | HPV16E7 | E7 | 0.0130 |
| SLQDIEITCVYCKTV | 12088 | HPV18 | E6 | 0.0100 |
| RLLTSLFFL | 12089 | RSV | | 0.3400 |
| RLLTSLFFL | 12090 | RSV | | 0.3400 |
| LLLYYDYSL | 12091 | FISV | | 0.2800 |
| DMLGRVFFV | 12092 | RSV | | 0.0110 |
| TMFEALP HI | 12093 | LCMV | Gp | 0.2000 |
| ALISFLLLA | 12094 | LCMV | Gp | 0.2200 |
| TLMSIVSSL | 12095 | LCMV | Gp | 0.2000 |
| NISGYNFSL | 12096 | LCMV | Np | 0.0280 |
| ALLDGGNML | 12097 | LCMV | Np | 0.0320 |
| ALHLFKTTV | 12098 | LCMV | Gp | 0.0170 |
| SLISDQLLM | 12099 | LCMV | Gp | 0.0540 |
| WLVTNGSYL | 12100 | LCMV | Gp | 0.0180 |
| ALMDLLMFS | 12101 | LCMV | Gp | 0.4300 |
| LMDLLMFST | 12102 | LCMV | Gp | 0.0460 |
| LMFSTSAYL | 12103 | LCMV | Gp | 0.3600 |
| YLVSIFLHL | 12104 | LCMV | Gp | 0.4200 |
| SLHCKPEEA | 12105 | MAGE1 | | 0.0130 |
| ALGLVCVQA | 12106 | MAGE1 | | 0.0150 |
| LVLGTLEEV | 12107 | MAGE1 | | 0.0320 |
| GTLEEVPTA | 12108 | MAGE1 | | 0.0130 |
| CILESLFRA | 12109 | MAGE1 | | 0.0460 |
| KVADLVGFLL | 12110 | MAGE1 | | 0.0560 |
| KVADLVGFLLL | 12111 | MAGE1 | | 0.0200 |
| VMIAMEGGHA | 12112 | MAGE1 | | 0.0360 |
| SMHCKPEEV | 12113 | MAGE1(a) | | 0.0180 |
| AMGLVCVQV | 12114 | MAGE1(a) | | 0.0120 |
| LMLGTLEEV | 12115 | MAGE1(a) | | 0.1300 |
| KMADLVGFLV | 12116 | MAGE1(a) | | 1.5000 |
| VMVTCLGLS V | 12117 | MAGE1(a) | | 0.3000 |
| LLGDNQIMV | 12118 | MAGE1(a) | | 0.0430 |
| QMMPKTGFLV | 12119 | MAGE1(a) | | 0.0500 |
| VMIAMEGGHV | 12120 | MAGE1(a) | | 0.0530 |
| WMELSVMEV | 12121 | MAGE1(a) | | 0.0410 |
| FLWGPRALA | 12122 | MAGE1N | | 0.0420 |
| RALAETSYV | 12123 | MAGE1N | | 0.0100 |
| ALAETSYVKVL | 12124 | MAGE1N | | 0.0120 |
| ALAETSYVKV | 12125 | MAGE1N | | 0.0150 |
| KVLEYVIKV | 12126 | MAGE1N | | 0.0900 |
| YVIKVSARV | 12127 | MAGE1N | | 0.0140 |
| ALREEEEGV | 12128 | MAGE1N | | 0.0210 |
| YMFLWGPRV | 12129 | MAGE1N(a) | | 0.2200 |
| KMVELVHFLLL | 12130 | MAGE2 | | 0.6700 |
| KMVELVHFL | 12131 | MAGE2 | | 0.1600 |
| KMVELVHFLL | 12132 | MAGE2 | | 0.1100 |
| KA SEYLQLV | 12133 | MAGE2 | | 0.0110 |
| YLQLVFGIEV | 12134 | MAGE2 | | 0.3700 |
| LVFGIEVVEV | 12135 | MAGE2 | | 0.0120 |
| QLVFGIELMEV | 12136 | MAGE3 | | 0.3400 |
| KVAELVHFL | 12137 | MAGE3 | | 0.0550 |
| KVAELVHFLL | 12138 | MAGE3 | | 0.0120 |
| ELMEVDPIGHL | 12139 | MAGE3 | | 0.0260 |
| HLYIFATCLGL | 12140 | MAGE3 | | 0.0410 |
| IMPKAGLLIIV | 12141 | MAGE3 | | 0.0130 |
| LVFGIELMEV | 12142 | MAGE3 | | 0.1100 |
| ALGRNSFEV | 12143 | p53 264-272 A8(A1) | | 0.0570 |
| LLGANSFEV | 12144 | p53 264-272 A8 (A4) | | 0.1100 |
| LLGRASFEV | 12145 | p53 264-272 AS (A5) | | 0.2200 |
| LLGRNAFEV | 12146 | p53 264-272 A8 (A6) | | 0.0390 |
| LLGRNSFAV | 12147 | p53 264-272 A8 (A8) | | 0.0420 |
| RLGRNSFEV | 12148 | p53 264-272 AS (RI) | | 0.0190 |
| LLGRRSFEV | 12149 | p53 264-272 A8 (R5) | | 0.0540 |
| LLGRNSFRV | 12150 | p53 264-272 A8 (R8) | | 0.0250 |
| LLFFWLDRSV | 12151 | PAP | | 0.6000 |
| VLAKELKFV | 12152 | PAP | | 0.0590 |
| ILLWQPIPV | 12153 | PAP | | 1.3000 |
| IMYSAHDTTV | 12154 | PAP | | 0.0610 |

TABLE 176-continued

| Sequence | SEQ ID NO | Antigen | Molecule | A2 Bind. |
|---|---|---|---|---|
| FLTLSVTWI | 12155 | PSA | | 0.0150 |
| FLTLSVTWIGA | 12156 | PSA | | 0.0160 |
| FLTLSVTWI | 12157 | PSA | | 0.0150 |
| VLVHPQWVLTA | 12158 | PSA | | 0.0130 |
| SLFI-IPEDTGQV | 12159 | PSA | | 0.0190 |
| MLLRLSEPAEL | 12160 | PSA | | 0.1400 |
| ALGTTCYA | 12161 | PSA | | 0.0230 |
| KLQCVDLHVI | 12162 | PSA | | 0.0370 |
| FLPSDYFPSV | 12163 | HBVc18-27 analog | | 1.0000 |
| YSFLPSDFFPSV | 12164 | HBVc18-27 analog | | 0.0190 |

TABLE 177

| Sequence | SEQ ID NO | Antigen | Molecule | A2 Bind. |
|---|---|---|---|---|
| ALFLGFLGAA | 12165 | HIV | gp160 | 0.4950 |
| MLQLTVWGI | 12166 | HIV | gp160 | 0.2450 |
| RVIEVLQRA | 12167 | HIV | gp160 | 0.1963 |
| KLTPLCVTL | 12168 | HIV | gp160 | 0.1600 |
| LLIAARIVEL | 12169 | HIV | gp160 | 0.1550 |
| SLLNATDIAV | 12170 | HIV | gp160 | 0.1050 |
| ALFLGFLGA | 12171 | HIV | gp160 | 0.0945 |
| HMLQLTVWGI | 12172 | HIV | gp160 | 0.0677 |
| LLNATDIAV | 12173 | HIV | gp160 | 0.0607 |
| ALLYKLDIV | 12174 | HIV | gp160 | 0.0362 |
| WLWYIKIFI | 12175 | HIV | gp160 | 0.0355 |
| TIIVHLNESV | 12176 | HIV | gp160 | 0.0350 |
| LLQYWSQEL | 12177 | HIV | gp160 | 0.0265 |
| IMIVGGLVGL | 12178 | HIV | gp160 | 0.0252 |
| LLYKLDIVSI | 12179 | HIV | gp160 | 0.0245 |
| FLAIIWVDL | 12180 | HIV | gp160 | 0.0233 |
| TLQCKIKQII | 12181 | HIV | gp160 | 0.0200 |
| GLVGLRIVFA | 12182 | HIV | gp160 | 0.0195 |
| FLGAAGSTM | 12183 | HIV | gp160 | 0.0190 |
| IISLWDQSL | 12184 | HIV | gp160 | 0.0179 |
| TVWGIKQLQA | 12185 | HIV | gp160 | 0.0150 |
| LLGRRGWEV | 12186 | HIV | gp160 | 0.0142 |
| AVLSIVNRV | 12187 | HIV | gp160 | 0.0132 |
| FIMIVGGLV | 12188 | HIV | gp160 | 0.0131 |
| LLNATDIAVA | 12189 | HIV | gp160 | 0.0117 |
| FLYGALLLA | 12190 | PLP | | 1.9000 |
| SLLTFMIAA | 12191 | PLP | | 0.5300 |
| FMIAATYNFAV | 12192 | PLP | | 0.4950 |
| RMYGVLPWI | 12193 | PLP | | 0.1650 |
| IAATYNFAV | 12194 | PLP | | 0.0540 |
| GLLECCARCLV | 12195 | PLP | | 0.0515 |
| YALTVVWLL | 12196 | PLP | | 0.0415 |
| ALTVVWLLV | 12197 | PLP | | 0.0390 |
| FLYGALLL | 12198 | PLP | | 0.0345 |
| SLCADARMYGV | 12199 | PLP | | 0.0140 |
| LLVFACSAV | 12200 | PLP | | 0.0107 |

| Sequence | SEQ ID NO | Antigen | Molecule | A2 |
|---|---|---|---|---|
| KMVELVHFLL | 12201 | MAGE2 | | 0.2200 |
| KVAELVHFL | 12202 | MAGE3 | | 0.0550 |
| RALAETSYV | 12203 | MAGE1N | | 0.0100 |
| LVFGIELMEV | 12204 | MAGE3 | | 0.1100 |
| FLWGPRALA | 12205 | MAGE1N | | 0.0420 |
| ALAETSYVKV | 12206 | MAGE1 | | 0.0150 |
| LVLGTLEEV | 12207 | HIV | | 0.0320 |
| LLWKGEGAVV | 12208 | HIV | | 0.0360 |
| IIGAETFYV | 12209 | HIV | | 0.0260 |
| LMVTVYYGV | 12210 | HIV | | 0.4400 |
| LLFNILGGWV | 12211 | HCV | | 3.5000 |
| LLALLSCLTV | 12212 | HCV | | 0.6100 |
| YLVAYQATV | 12213 | HCV | | 0.2500 |
| FLLLADARV | 12214 | HCV | | 0.2300 |
| ILAGYGAGV | 12215 | HCV | | 0.2200 |
| YLLPRRGPRL | 12216 | HCV | | 0.0730 |
| GLLGCIITSL | 12217 | HCV | | 0.0610 |
| DLMGYIPLV | 12218 | HCV | | 0.0550 |
| LLALLSCLTI | 12219 | HCV | | 0.0340 |
| VLAALAAYCL | 12220 | HCV | | 0.0110 |

TABLE 177-continued

| | | | |
|---|---|---|---|
| LLVPFVQWFV | 12221 | HBV | 1.6000 |
| FLLAQFTSA | 12222 | HBV | 0.6600 |
| FLLSLGIHL | 12223 | HBV | 0.5200 |
| ALMPLYACI | 12224 | HBV | 0.5000 |
| ILLLCLIFLL | 12225 | HBV | 0.3000 |
| LLPIFFCLWV | 12226 | HBV | 0.1000 |
| YLHTLWKAGI | 12227 | HBV | 0.0560 |
| YLHTLWKAGV | 12228 | HBV | 0.1300 |

TABLE 178

| Pos | AA | P1 | P2 | P3 | P4 | P5 | P6 | P7 | P8 | P9 | P10 | SEQ ID NO | Allele | Motif |
|---|---|---|---|---|---|---|---|---|---|---|---|---|---|---|
| Human PLP peptides | | | | | | | | | | | | | | |
| 3 | 9 | L | L | E | C | C | A | R | C | L | | 12229 | A2.1 | (LM)2; (LVI)c |
| 23 | 9 | G | L | C | F | F | G | V | A | L | | 12230 | | |
| 39 | 9 | A | L | T | G | T | E | K | L | I | | 12231 | | |
| 134 | 9 | S | L | E | R | V | C | H | C | L | | 12232 | | |
| 145 | 9 | L | W | L | G | H | P | D | K | F | V | 12233 | | |
| 158 | 9 | A | L | T | V | V | W | L | L | V | | 12234 | | |
| 164 | 9 | L | L | V | F | A | C | S | A | V | | 12235 | | |
| 205 | 9 | R | M | Y | G | V | L | P | W | I | | 12236 | | |
| 2 | 10 | G | L | L | E | C | C | A | R | C | L | 12237 | | |
| 3 | 10 | L | L | E | C | C | A | R | C | L | V | 12238 | | |
| 10 | 10 | C | L | V | G | A | P | F | A | S | L | 12239 | | |
| 163 | 10 | W | L | L | V | F | A | C | S | A | V | 12240 | | |
| 250 | 10 | T | L | V | S | L | L | T | F | M | I | 12241 | | |
| 64 | 9 | V | T | H | A | F | Q | Y | V | I | | 12242 | | Algorithm |
| 80 | 9 | F | L | Y | G | A | L | L | L | A | | 12243 | | |
| 157 | 9 | Y | A | L | T | V | V | W | L | L | | 12244 | | |
| 163 | 9 | W | L | L | V | F | A | C | S | A | V | 12245 | | |
| 234 | 9 | Q | M | T | F | H | L | F | I | A | | 12246 | | |
| 251 | 9 | L | V | S | L | L | T | F | M | I | | 12247 | | |
| 253 | 9 | S | L | L | T | F | M | I | A | A | | 12248 | | |
| 259 | 9 | I | A | A | T | V | H | F | A | V | | 12249 | | |
| 84 | 10 | A | L | L | L | A | E | G | F | Y | T | 12250 | | |
| 157 | 10 | Y | A | L | T | V | V | W | L | L | V | 12251 | | |
| 165 | 10 | L | V | F | A | C | S | A | V | P | V | 12252 | | |
| 218 | 10 | K | V | C | G | S | N | L | L | S | I | 12253 | | |
| 253 | 10 | S | L | L | T | F | M | I | A | A | T | 12254 | | |
| Human Collagen Type IV peptides | | | | | | | | | | | | | | |
| 5 | 9 | A | L | M | G | P | L | G | L | L | | 12255 | A2.1 | (LM)2; (LVI)c |
| 11 | 9 | G | L | L | G | Q | I | G | P | L | | 12256 | | |
| 23 | 9 | G | M | L | G | Q | K | G | E | I | | 12257 | | |
| 231 | 9 | P | L | G | Q | D | G | L | P | V | | 12258 | | |
| 3 | 10 | T | L | A | L | M | G | P | L | G | L | 12259 | | |
| 24 | 10 | M | L | G | Q | K | G | E | I | G | L | 12260 | | |
| 59 | 10 | P | L | G | K | D | G | P | P | G | V | 12261 | | |
| 139 | 10 | P | L | G | L | P | G | A | S | G | L | 12262 | | |
| Human Collagen Type II peptides | | | | | | | | | | | | | | |
| 794 | 9 | G | L | A | G | Q | R | G | I | V | | 12263 | A2.1 | (LM)2; (LVI)c |
| 17 | 9 | V | M | Q | G | P | M | G | P | M | | 12264 | | Algorithm |
| Human GAD peptides | | | | | | | | | | | | | | |
| 56 | 9 | S | L | E | E | K | S | R | L | V | | 12265 | A2.1 | (LM)2; (LVI)c |
| 116 | 9 | F | L | L | E | V | V | D | I | L | | 12266 | | |
| 117 | 9 | L | L | E | V | V | D | I | L | L | | 12267 | | |
| 150 | 9 | G | M | E | G | F | N | L | E | L | | 12268 | | |
| 157 | 9 | E | L | S | D | H | P | E | S | L | | 12269 | | |
| 168 | 9 | I | L | V | D | C | R | D | T | L | | 12270 | | |
| 190 | 9 | Q | L | S | T | G | L | D | I | I | | 12271 | | |
| 229 | 9 | T | L | K | K | M | R | E | I | V | | 12272 | | |
| 275 | 9 | G | M | A | A | V | P | K | L | V | | 12273 | | |
| 300 | 9 | A | L | G | F | G | T | D | N | V | | 12274 | A2.1 | (LM)2; (LVI)c |
| 409 | 9 | V | L | L | Q | C | S | A | I | L | | 12275 | | |
| 410 | 9 | L | L | Q | C | S | A | I | L | V | | 12276 | | |
| 416 | 9 | I | L | V | K | E | K | G | I | L | | 12277 | | |
| 466 | 9 | L | M | W | K | A | K | G | T | V | | 12278 | | |
| 534 | 9 | K | L | H | K | V | A | P | K | I | | 12279 | | |
| 546 | 9 | M | M | E | S | G | T | T | M | V | | 12280 | | |
| 582 | 9 | F | L | I | E | E | I | E | R | L | | 12281 | | |
| 42 | 10 | K | L | G | L | K | I | C | G | F | L | 12282 | | |
| 116 | 10 | F | L | L | E | V | V | D | I | L | L | 12283 | | |
| 138 | 10 | V | L | D | F | H | H | P | H | Q | L | 12284 | | |
| 147 | 10 | L | L | E | G | M | E | G | F | N | L | 12285 | | |
| 212 | 10 | N | M | F | T | Y | E | I | A | P | V | 12286 | | |
| 275 | 10 | G | M | A | A | V | P | K | L | V | L | 12287 | | |
| 300 | 10 | A | L | G | F | G | T | D | N | V | I | 12288 | | |

TABLE 178-continued

| Pos | AA | P1 | P2 | P3 | P4 | P5 | P6 | P7 | P8 | P9 | P10 | SEQ ID NO | Allele | Motif |
|---|---|---|---|---|---|---|---|---|---|---|---|---|---|---|
| 328 | 10 | I | L | E | A | K | Q | K | G | Y | V | 12289 | | |
| 381 | 10 | L | M | S | R | K | H | R | H | K | L | 12290 | | |
| 409 | 10 | V | L | L | Q | C | S | A | I | L | V | 12291 | | |
| 435 | 10 | L | L | Q | P | D | K | Q | Y | D | V | 12292 | | |
| 465 | 10 | W | L | M | W | K | A | K | G | T | V | 12293 | | |
| 485 | 10 | E | L | A | E | Y | L | Y | A | K | I | 12294 | | |
| 545 | 10 | L | M | M | E | S | G | T | T | M | V | 12295 | | |
| 252 | 9 | G | A | I | S | N | M | Y | S | I | | 12296 | | Algorithm |
| 367 | 9 | N | L | W | L | H | V | D | A | A | | 12297 | | |
| 567 | 9 | R | M | V | I | S | N | P | A | A | | 12298 | | |
| 299 | 10 | A | A | L | G | F | G | T | D | N | V | 12299 | | |
| 406 | 10 | M | M | G | V | L | L | Q | C | S | A | 12300 | | |
| 423 | 10 | I | L | Q | G | C | N | Q | M | C | A | 12301 | | |

TABLE 179

HPV-16 Peptides for possible use in clinical trial

| Peptide Position/ Cytel ID | Sequence | SEQ ID NO | AA | A2.1 binding | Immunogenicity Experiment 1 | Immunogenicity Experiment 2 |
|---|---|---|---|---|---|---|
| E7.86/1088.01 | TLGIVCPI | 12302 | 8 | 0.15 | 94.4 (1.34) | 54.2 (1.43)* |
| E7.86/1088.06 | TLGIVCPIC | 12303 | 9 | 0.075 | 2.05 (4.93) | 1.3 (3.74) |
| E7.85/1088.08 | GTLGIVCPI | 12304 | 9 | 0.021 | 9/08 (3.93) | —** |
| E7.1111088.03 | YMLDLQPETT | 12305 | 10 | 0.15 | 10.32 (1.66) | 5.7 (2.39) |
| E7.11/1088.04 | YMLDLQPET | 12306 | 9 | 0.14 | 5.0 (3.70) | 2.6 (15.5) |
| E7.12/1088.09 | MLDLQPETT | 12307 | 9 | 0.0028 | — | — |
| E6.5211088.05 | FAFRDLCIV | 12308 | 9 | 0.057 | — | ND |
| E7.82/1088.02 | LLMGTLGIV | 12309 | 9 | 0.024 | 9.62 (2.53) | 8.93 (1.91) |
| E6.29/1088.10 | TIHDIILECV | 12310 | 10 | 0.021 | 22.13 (3.71) | 0.4 (3.52) |
| E7.711088.07 | TLHEYMLDL | 12311 | 9 | 0.0070 | — | 1.2 (3.88 |
| E6.18/1088.15 | KLPQLCTEL | 12312 | 9 | 0.0009 | — | 0.3 (5.64) |
| E6.7/1088.11 | AMFQDPQER | 12313 | 10 | 0.0002 | — | ND |
| E6.26/1088.12 | LQTTIHDII | 12314 | 9 | 0.0002 | — | — |
| E7.73/1088.13 | HVDIRTLED | 12315 | 9 | 0 | — | ND |

*_Lytic Units, geometric mean x + SD (3 mice/peptide)
** a dash indicates _Lytic Units with a geometric mean ≤0.2

TABLE 180

HPV Peptides single and in combinations
A

| Peptide/s injected | Peptides in restimulation and CTL assay 1088.01 | 1088.02 | 1088.03 | 1088.10 |
|---|---|---|---|---|
| same as in vitro | 116.1 (3.49)* | 55.98 (2.49) | 5.56 (1.75) | 16.4 (1.49) |
| 1088.01 + 1088.03 + 875.23 | 1.37 (16.56) | | 0 (0) | |
| 1088.02 + 1088.10+ 875.23 | | 1.11 (2.9) | | 1.62 (13.1) |
| 1088.01/.03 + 1088.02/.10 + 875.23 | 19.5 (4.1) | 4.68 (2.3) | 1.13 (21.9) | 1.17 (2.58) |

TABLE 180-continued

HPV Peptides single and in combinations
A

| Peptide/s injected | Peptides in restimulation and CTL assay 1088.01 | 1088.02 | 1088.03 | 1088.10 |
|---|---|---|---|---|
| 1088.all + 875.23 | 107.9 (4.77) | 13.52 (1.4) | 2.58 (5.07) | 102.3 (1.32) |
| 1088.all + PADRE 1 ig | 73.11 (4.48) | 16.83 (2.54) | 3.55 (2.9) | 20.13 (1.05) |
| 1088.all + PADRE 0.05 ig | 37.15 (2.25) | 26.79(2.09) | 6.5 (1.64) | 4.45 (4.14) |

*_ Lytic Units 30% geometric mean (+x deviation)

TABLE 181

| Peptide | Sequence | SEQ ID NO | AA | Virus | Strain | Molecule | Pos. | A2.1 |
|---|---|---|---|---|---|---|---|---|
| 1.0841 | ILSPFLPLL | 12316 | 9 | HBV | adr | ENV | 371 | 2.9 |
| 1.024 | TLQDIVLHL | 12317 | 9 | HPV | 18 | E7 | 7 | 0.76 |
| 1.0838 | WLSLLVPFV | 12318 | 9 | HBV | adr | ENV | 335 | 0.72 |
| 1.0851 | FLLSLGIHL | 12319 | 9 | HBV | adr | POL | 1147 | 0.52 |
| 1.0306 | QLFEDNYAL | 12320 | 9 | c-ERB2 | | | 106 | 0.46 |
| 1.0814 | LMVTVYYGV | 12321 | 9 | HIV | | ENV | 2182 | 0.44 |

TABLE 181-continued

| Peptide | Sequence | SEQ ID NO | AA | Virus | Strain | Molecule | Pos. | A2.1 |
|---|---|---|---|---|---|---|---|---|
| 1.0878 | MMWFWGTSL | 12322 | 9 | HBV | adw | ENV | 360 | 0.41 |
| 1.0839 | MMWWGPSL | 12323 | 9 | HBV | adr | ENV | 360 | 0.41 |
| 1.0384 | FLTKQYLNL | 12324 | 9 | HBV | adw | POL | 1279 | 0.29 |
| 1.0321 | 1LHNGAYSL | 12325 | 9 | c-ERB2 | | | 435 | 0.21 |
| 1.0834 | LLLCLIFLL | 12326 | 9 | HBV | adr | ENV | 250 | 0.19 |
| 1.0167 | GLYSSTVPV | 12327 | 9 | HBV | adr | POL | 635 | 0.15 |
| 1.0849 | HLYSHPIIL | 12328 | 9 | HBV | adr | POL | 1076 | 0.13 |
| 1.0275 | RMPEAAPPV | 12329 | 9 | p53 | | | 63 | 0.12 |
| 1.0854 | LLMGTLGIV | 12330 | 9 | HPV | 16 | E7 | 82 | 0.11 |
| 1.0880 | ILSPFMPLL | 12331 | 9 | HBV | adw | ENV | 371 | 0.11 |
| 1.0127 | YLVAYQATV | 12332 | 9 | HCV | | LORF | 1585 | 0.11 |
| 1.0151 | VLLDYQGML | 12333 | 9 | HBV | adr | ENV | 259 | 0.11 |
| 1.0018 | VLAEAMSQV | 12334 | 9 | HIV | | GAG | 367 | 0.11 |
| 1.0330 | KLLQETELV | 12335 | 9 | c-ERB2 | | | 689 | 0.091 |
| 1.0209 | SLYAVSPSV | 12336 | 9 | HBV | adr | POL | 1388 | 0.078 |
| 1.0816 | DLMGYIPLV | 12337 | 9 | HCV | | CORE | 132 | 0.055 |
| 1.0835 | LLCLIFLLV | 12338 | 9 | HBV | adr | ENV | 251 | 0.049 |
| 1.0852 | FLCQQYLHL | 12339 | 9 | HBV | adr | POL | 1250 | 0.048 |
| 1.0882 | NLYVSLMLL | 12340 | 9 | HBV | adw | POL | 1088 | 0.046 |
| 1.0837 | GMLPVCPLL | 12341 | 9 | HBV | adr | ENV | 265 | 0.046 |
| 1.0819 | ILPCSFTTL | 12342 | 9 | HCV | | NS1/ENV2 | 676 | 0.045 |
| 1.0109 | ALSTGLIHL | 12343 | 9 | HCV | | NS1/ENV2 | 686 | 0.042 |
| 1.0833 | ILLLCLIFL | 12344 | 9 | HBV | adr | ENV | 249 | 0.035 |
| 1.0301 | HLYQGCQVV | 12345 | 9 | c-ERB2 | | | 48 | 0.034 |
| 1.0337 | CLTSTVQLV | 12346 | 9 | c-ERB2 | | | 789 | 0.034 |
| 1.0842 | PLLPIFFCL | 12347 | 9 | HBV | adr | ENV | 377 | 0.031 |
| 1.0861 | ALCRWGLLL | 12348 | 9 | c-ERB2 | | | 5 | 0.031 |
| 1.0309 | VLIQRNPQL | 12349 | 9 | c-ERB2 | | | 153 | 0.029 |
| 1.0828 | QVLQACFFLL | 12350 | 9 | HBV | adr | ENV | 177 | 0.024 |
| 1.0844 | LLWFHISCL | 12351 | 9 | HBV | adr | CORE | 490 | 0.024 |
| 1.0135 | ILAGYGAGV | 12352 | 9 | HCV | | LORF | 1851 | 0.024 |
| 1.0870 | QLMPYGCLL | 12353 | 9 | c-ERB2 | | | 799 | 0.023 |
| 1.0075 | LLWKGEGAV | 12354 | 9 | HIV | | POL | 1496 | 0.023 |
| 1.0873 | FLGGTPVCL | 12355 | 9 | HBV | adw | ENV | 204 | 0.021 |
| 1.0323 | ALIHHNTHL | 12356 | 9 | c-ERB2 | | | 466 | 0.021 |
| 1.0859 | VLVHPQWVL | 12357 | 9 | PSA | | | 49 | 0.020 |
| 1.0267 | KLQCVDLHV | 12358 | 9 | PSA | | | 166 | 0.019 |
| 1.0820 | VLPCSFTTL | 12359 | 9 | HCV | | NS1/ENV2 | 676 | 0.017 |
| 1.0111 | HLHQNIVDV | 12360 | 9 | HCV | | NS1/ENV2 | 693 | 0.016 |
| 1.0103 | SMVGNWAKV | 12361 | 9 | HCV | | ENV1 | 364 | 0.016 |
| 1.0293 | LLGRNSFEV | 12362 | 9 | p53 | | | 264 | 0.014 |
| 1.0207 | GLYRPLLSL | 12363 | 9 | HBV | adr | POL | 1370 | 0.014 |
| 1.0389 | GLYRPLLRL | 12364 | 9 | HBV | adw | POL | 1399 | 0.014 |
| 1.0185 | NLSWLSLDV | 12365 | 9 | HBV | adr | POL | 996 | 0.013 |
| 1.0113 | FLLLADARV | 12366 | 9 | HCV | | NS1/ENV2 | 725 | 0.013 |
| 1.0119 | YLVTRHADV | 12367 | 9 | HCV | | LORF | 1131 | 0.011 |
| 1.0846 | CLTHIVNLL | 12368 | 9 | HBV | adr | POL | 912 | 0.010 |
| 1.0156 | ELMNLATWV | 12369 | 9 | HBV | adr | CORE | 454 | 0.010 |
| 1.0236 | KLPDLCTEL | 12370 | 9 | HPV | 18 | E6 | 13 | 0.010 |
| 1.0056 | ALQDSGLEV | 12371 | 9 | HIV | | POL | 1180 | 0.0083 |
| 1.0375 | LLSSDLSWL | 12372 | 9 | HBV | adw | POL | 1021 | 0.0081 |
| 1.0094 | ALAHGVRL | 12373 | 9 | HCV | | CORE | 150 | 0.0072 |
| 1.0129 | TLHGPTPLL | 12374 | 9 | HCV | | LORF | 1617 | 0.0070 |
| 1.0041 | KLLRGTKAL | 12375 | 9 | HIV | | POL | 976 | 0.0069 |
| 1.0131 | CMSADLEVV | 12376 | 9 | HCV | | LORF | 1348 | 0.0067 |
| 1.0872 | GLLCPLLVL | 12377 | 9 | HBV | adw | ENV | 170 | 0.0066 |
| 1.0228 | TLHEYMLDL | 12378 | 9 | HPV | 16 | E7 | 7 | 0.0059 |
| 1.0274 | KLLPENVL | 12379 | 9 | p53 | | | 24 | 0.0058 |
| 1.0043 | EILKEPVHGV | 12380 | 9 | HIV | | POL | 1004 | 0.0055 |
| 1.0206 | RLGLYRPLL | 12381 | 9 | HBV | adr | POL | 1368 | 0.0050 |
| 1.0188 | GLPRYVARL | 12382 | 9 | HBV | adr | POL | 1027 | 0.0050 |
| 1.0202 | KLIGTDNSV | 12383 | 9 | HBV | adr | POL | 1317 | 0.0050 |
| 1.0818 | FLLALLSCL | 12384 | 9 | HCV | | CORE | 177 | 0.0046 |
| 1.0184 | LLSSNLSWL | 12385 | 9 | HBV | adr | POL | 992 | 0.0046 |
| 1.0102 | QLLRIPQAV | 12386 | 9 | HCV | | ENV1 | 337 | 0.0039 |
| 1.0114 | GLRDLAVAV | 12387 | 9 | HCV | | LORF | 963 | 0.0034 |
| 1.0005 | TLNAWVKVI | 12388 | 9 | HIV | | GAG | 156 | 0.0032 |
| 1.0183 | NLQSLTNLL | 12389 | 9 | HBV | adr | POL | 985 | 0.0025 |
| 1.0359 | QULGRKPTPL | 12390 | 9 | HBV | adw | ENV | 89 | 0.0025 |
| 1.0150 | SLDSWWTSL | 12391 | 9 | HBV | adr | ENV | 194 | 0.0023 |
| 1.0362 | ILSKTGDPV | 12392 | 9 | HBV | adw | ENV | 153 | 0.0021 |
| 1.0866 | ILLVVVLGV | 12393 | 9 | c-ERB2 | | | 661 | 0.0020 |
| 1.0214 | LLHKRTLGL | 12394 | 9 | HBV | adr | “X” | 1510 | 0.0019 |
| 1.0216 | CLFKDWEEL | 12395 | 9 | HBV | adr | “X” | 1533 | 0.0019 |
| 1.0862 | GLGISWLGL | 12396 | 9 | c-ERB2 | | | 447 | 0.0018 |
| 1.0187 | HLLVGSSBL | 12397 | 9 | HBV | adr | POL | 1020 | 0.0018 |
| 1.0318 | TLEEITGYL | 12398 | 9 | c-ERB2 | | | 650 | 0.0018 |
| 1.0328 | PLTSIISAV | 12399 | 9 | c-ERB2 | | | 650 | 0.0015 |

TABLE 181-continued

| Peptide | Sequence | SEQ ID NO | AA | Virus | Strain | Molecule | Pos. | A2.1 |
|---|---|---|---|---|---|---|---|---|
| 1.0822 | LLGIITSL | 12400 | 9 | HCV | | LORF | 1089 | 0.0015 |
| 1.0277 | ALNKMFCQL | 12401 | 9 | p53 | | | 129 | 0.0013 |
| 1.0066 | HLEGKIILV | 12402 | 9 | HIV | | POL | 1322 | 0.0010 |
| 1.0308 | QLRSLTIEL | 12403 | 9 | c-ERB2 | | | 141 | 0.0008 |
| 1.0115 | DLAVAVEPV | 12404 | 9 | HCV | | LORF | 966 | 0.0008 |
| 1.0391 | VLHKRTLGL | 12405 | 9 | HBV | adw | "X" | 1539 | 0.0007 |
| 1.0876 | FLCILLLCL | 12406 | 9 | HBV | adw | ENV | 246 | 0.0007 |
| 1.0148 | LLDPRVRGL | 12407 | 9 | HBV | adr | ENV | 120 | 0.0006 |
| 1.0221 | KLPQLCTEL | 12408 | 9 | HPV | 16 | E6 | 18 | 0.0006 |
| 1.0065 | HLEGKVILV | 12409 | 9 | HIV | | POL | 1322 | 0.0006 |
| 1.0017 | EMMTACQGV | 12410 | 9 | HIV | | GAG | 350 | 0.0006 |
| 1.0055 | HLALQDSGL | 12411 | 9 | HIV | | POL | 1178 | 0.0005 |
| 1.0868 | VLGVVPGIL | 12412 | 9 | c-ERB2 | | | 666 | 0.0005 |
| 1.0004 | TLNAWVKVV | 12413 | 9 | HIV | | GAG | 156 | 0.0005 |
| 1.0381 | HLESLYAAV | 12414 | 9 | HBV | adw | POL | 1165 | 0.0005 |
| 1.0128 | CLIRLKPTL | 12415 | 9 | HCV | | LORF | 1610 | 0.0004 |
| 1.0255 | CLGSYDGL | 12416 | 9 | MAGE | 3-Jan | | 174 | 0.0004 |
| 1.0212 | HLSLRGLPV | 12417 | 9 | HBV | adr | | 1470 | 0.0004 |
| 1.0247 | ILESLFRAV | 12418 | 9 | MAGE | 1 | | 93 | 0.0004 |
| 1.0092 | TLTCGFACL | 12419 | 9 | HCV | | CORE | 93 | 0.0004 |
| 1.0108 | TLPALSTGL | 12420 | 9 | HCV | | NS1/ENV2 | 683 | 0.0003 |
| 1.0294 | ALAIPQCRL | 12421 | 9 | EBNA1 | | | 525 | 0.0003 |
| 1.0101 | DLCGSVFLV | 12422 | 9 | HCV | | ENVI | 280 | 0.0003 |
| 1.0231 | RLCVQSTHV | 12423 | 9 | HPV | 16 | E7 | 66 | 0.0003 |
| 1.0162 | LLDDEAGPL | 12424 | 9 | HBV | adr | POL | 587 | 0.0002 |
| 1.0829 | CLRRFIIFL | 12425 | 9 | HBV | adr | ENV | 239 | 0.0002 |
| 1.0126 | GLPVCQDHL | 12426 | 9 | HCV | | LORF | 1547 | 0.0001 |
| 1.0163 | PLEEELPRL | 12427 | 9 | HBV | adr | POL | 594 | 0.0001 |
| 1.0130 | PLLYRLGAV | 12428 | 9 | HCV | | LORF | 1623 | 0.0001 |
| 1.0042 | ELAENREIL | 12429 | 9 | HIV | | POL | 997 | 0 |
| 1.0054 | ELQAIHLAL | 12430 | 9 | HIV | | POL | 1173 | 0 |
| 1.0089 | LIPRRGPRL | 12431 | 9 | HCV | | CORE | 36 | 0 |
| 1.0091 | NLGKVIDTL | 12432 | 9 | HCV | | CORE | 118 | 0 |
| 1.0093 | PLGGAARAL | 12433 | 9 | HCV | | CORE | 143 | 0 |
| 1.0154 | DLLDTASAL | 12434 | 9 | HBV | adr | CORE | 419 | 0 |
| 1.0178 | QLKQSRLGL | 12435 | 9 | HBV | adr | POL | 791 | 0 |
| 1.0179 | CLQPQQGSL | 12436 | 9 | HBV | adr | POL | 798 | 0 |
| 1.0286 | PLDGEYFTL | 12437 | 9 | p53 | | | 322 | 0 |
| 1.0296 | VLKDAIKDL | 12438 | 9 | EBNA1 | | | 574 | 0 |
| 1.0310 | QLCYQDTIL | 12439 | 9 | c-ERB2 | | | 160 | 0 |
| 1.0007 | DLNTMLNTV | 12440 | 9 | HIV | | GAG | 188 | 0 |
| 1.0037 | ELHPDKWTV | 12441 | 9 | HIV | | POL | 928 | 0 |
| 1.0070 | ELKKIICQV | 12442 | 9 | HIV | | POL | 1412 | 0 |
| 1.0157 | ELVVSYVNV | 12443 | 9 | HBV | adr | CORE | 473 | 0 |
| 1.0160 | CLTPGRETV | 12444 | 9 | HBV | adr | CORE | 497 | 0 |
| 1.0164 | DLNLGNLNV | 12445 | 9 | HBV | adr | POL | 614 | 0 |
| 1.0867 | LLVVVLGVV | 12446 | 9 | c-ERB2 | | | 662 | 0 |
| 1.0159 | NMGLKIRQL | 12447 | 9 | HBV | adr | CORE | 482 | 0 |
| 1.0322 | SLRELGSGL | 12448 | 9 | c-ERB2 | | | 457 | <0.0002 |
| 1.0350 | DLLEKGERL | 12449 | 9 | c-ERB2 | | | 933 | <0.0002 |
| 1.0352 | DLVDAEEYL | 12450 | 9 | c-ERB2 | | | 1016 | <0.0002 |
| 1.0366 | PLEEELPIIL | 12451 | 9 | HBV | adw | POL | 623 | <0.0002 |
| 1.0372 | DLQHGRLVL | 12452 | 9 | HBV | adw | POL | 781 | <0.0002 |
| 1.0390 | PLPGPLGAL | 12453 | 9 | HBV | adw | | 1476 | <0.0002 |
| 1.0811 | LLTQIGCTL | 12454 | 9 | HIV | | POL | 685 | <0.0002 |
| 1.0812 | PLVKLWYQL | 12455 | 9 | HIV | | POL | 1116 | <0.0002 |
| 1.0832 | FLFILLLCL | 12456 | 9 | HBV | adr | ENV | 246 | <0.0002 |
| 1.0847 | NLYVSLLLL | 12457 | 9 | HBV | adr | POL | 1059 | <0.0002 |
| 1.0316 | PLQPEQLQV | 12458 | 9 | c-ERB2 | | | 391 | <0.0002 |
| 1.0342 | DLAARNVLV | 12459 | 9 | c-ERB2 | | | 845 | <0.0002 |
| 1.0343 | VLVKSPNHV | 12460 | 9 | c-ERB2 | | | 851 | <0.0002 |
| 1.0356 | TLSPGKNGV | 12461 | 9 | c-ERB2 | | | 1172 | <0.0002 |
| 1.0376 | DLSWLSLDV | 12462 | 9 | HBV | adw | POL | 1025 | <0.0002 |
| 1.0363 | NMENIASGL | 12463 | 9 | HBV | adw | ENV | 163 | <0.0002 |
| 1.0195 | TLPQEHIVL | 12464 | 9 | HBV | adr | POL | 1179 | <0.0003 |
| 1.0196 | KLKQCFRKL | 12465 | 9 | HBV | adr | POL | 1188 | <0.0003 |
| 1.0201 | PLPIHTAEL | 12466 | 9 | HBV | adr | POL | 1296 | <0.0003 |
| 1.0210 | QLDPARDVL | 12467 | 9 | HBV | adr | "X" | 1426 | <0.0003 |
| 1.0220 | VLGGCRHKL | 12468 | 9 | HBV | adr | "X" | 1551 | <0.0003 |
| 1.0229 | DLQETTDL | 12469 | 9 | HPV | 16 | E7 | 14 | <0.0003 |
| 1.0266 | DLPTQEPAL | 12470 | 9 | PSA | | | 136 | <0.0003 |
| 1.0279 | HLIRVEGNL | 12471 | 9 | p53 | | | 193 | <0.0003 |
| 1.0282 | TLEDSSGNL | 12472 | 9 | p53 | | | 256 | <0.0003 |
| 1.0238 | ELRHYSDSV | 12473 | 9 | HPV | 18 | E6 | 77 | <0.0003 |
| 1.0268 | DLHVISNDV | 12474 | 9 | PSA | | | 171 | <0.0003 |
| 1.0836 | CLIFLLVLL | 12475 | 9 | HBV | adr | ENV | 253 | <0.0006 |

TABLE 182

| Peptide | Sequence | SEQ ID NO | AA | Virus | Strain | Molecule | Pos. | A2.1 |
|---|---|---|---|---|---|---|---|---|
| 1.0890 | LLFNILGGWV | 12476 | 10 | HCV | | LORF | 1807 | 3.5 |
| 1.0930 | LLVPFVQWFV | 12477 | 10 | HBV | adw | ENV | 338 | 1.6 |
| 1.0884 | LLALLSCLTV | 12478 | 10 | HCV | | CORE | 178 | 0.61 |
| 1.0896 | ILLLCLEFLL | 12479 | 10 | HBV | adr | ENV | 249 | 0.30 |
| 1.0518 | GLSPTVWLSV | 12480 | 10 | HBV | adr | ENV | 348 | 0.28 |
| 1.0902 | SLYNILSPFL | 12481 | 10 | HBV | adr | ENV | 367 | 0.23 |
| 1.0892 | LLVLQAGFFL | 12482 | 10 | HBV | adr | ENV | 175 | 0.21 |
| 1.0686 | FLQTHIFAEV | 12483 | 10 | EBNA1 | | | 565 | 0.17 |
| 1.0628 | QLFLNTLSFV | 12484 | 10 | HPV | 18 | E7 | 88 | 0.11 |
| 1.0904 | LLPIFFCLWV | 12485 | 10 | HBV | adr | ENV | 378 | 0.10 |
| 1.0897 | LLLCLIFLLV | 12486 | 10 | HBV | adr | ENV | 250 | 0.099 |
| 1.0516 | LLDYQGMLPV | 12487 | 10 | HBV | adr | ENV | 260 | 0.085 |
| 1.0901 | WMMWYWGPSL | 12488 | 10 | HBV | adr | ENV | 359 | 0.084 |
| 1.0533 | GLYSSTVPVL | 12489 | 10 | HBV | adr | POL | 635 | 0.080 |
| 1.0469 | YLLPRRGPRL | 12490 | 10 | HCV | | CORE | 35 | 0.073 |
| 1.0888 | GLLGCIITSL | 12491 | 10 | HCV | | LORF | 1038 | 0.061 |
| 1.0907 | ILCWGELMNL | 12492 | 10 | HBV | adr | CORE | 449 | 0.052 |
| 1.0927 | LLGICLTSTV | 12493 | 10 | c-ERB2 | | | 785 | 0.049 |
| 1.0452 | LLWKGEGAVV | 12494 | 10 | HIV | | POL | 1496 | 0.036 |
| 1.0885 | LLALLSCLTI | 12495 | 10 | HCV | | CORE | 178 | 0.034 |
| 1.0620 | KLTNTGLYNL | 12496 | 10 | HPV | 18 | E6 | 92 | 0.032 |
| 1.0502 | RLIVFPDLGV | 12497 | 10 | HCV | | LORF | 2578 | 0.032 |
| 1.0659 | FLLTPKKLQCV | 12498 | 10 | PSA | | | 161 | 0.031 |
| 1.0932 | WMMWFWGPSL | 12499 | 10 | HBV | adw | ENV | 359 | 0.029 |
| 1.0772 | SLNFLGGTPV | 12500 | 10 | HBV | adw | ENV | 201 | 0.027 |
| 1.0609 | SLQDIEITCV | 12501 | 10 | HPV | 18 | E6 | 24 | 0.025 |
| 1.0526 | ILSTLPETTV | 12502 | 10 | HBV | adr | CORE | 529 | 0.022 |
| 1.0508 | RLHGLSAFSL | 12503 | 10 | HCV | | LORF | 2885 | 0.020 |
| 1.0493 | ILGGWVAAQL | 12504 | 10 | HCV | | LORF | 1811 | 0.018 |
| 1.0738 | VMAGVGSPYV | 12505 | 10 | c-ERB2 | | | 773 | 0.018 |
| 1.0460 | QLMVTVYYGV | 12506 | 10 | HIV | | ENV | 2181 | 0.017 |
| 1.0573 | ILRGTSFVYV | 12507 | 10 | HBV | adr | POL | 1345 | 0.016 |
| 1.0703 | SLTEILKGGV | 12508 | 10 | c-ERB2 | | | 144 | 0.015 |
| 1.0912 | LLGCAANWIL | 12509 | 10 | HBV | adr | POL | 1337 | 0.014 |
| 1.0798 | ALPPASPSAV | 12510 | 10 | HBV | adw | | 1483 | 0.013 |
| 1.0908 | QLLWFHISCL | 12511 | 10 | HBV | adr | CORE | 489 | 0.013 |
| 1.0677 | NLLGRNSFEV | 12512 | 10 | p53 | | | 263 | 0.013 |
| 1.0889 | VLAALAAYCL | 12513 | 10 | HCV | | LORF | 1666 | 0.011 |
| 1.0528 | LLLDDEAGPL | 12514 | 10 | HBV | adr | POL | 586 | 0.011 |
| 1.0500 | IMAKNBVFCV | 12515 | 10 | HCV | | LORF | 2558 | 0.0088 |
| 1.0492 | VLVGGVLAAL | 12516 | 10 | HCV | | LORF | 1661 | 0.0084 |
| 1.0898 | LLCLIFLLVL | 12517 | 10 | HBV | adr | ENV | 251 | 0.0075 |
| 1.0458 | KLMVTVYYGV | 12518 | 10 | HIV | | ENV | 2181 | 0.0069 |
| 1.0459 | NLMVTVYYGV | 12519 | 10 | HIV | | ENV | 2181 | 0.0067 |
| 1.0530 | GLSPTVWLSA | 12520 | 10 | HBV | adw | ENV | 248 | 0.0067 |
| 1.0759 | SLPTHDPSPL | 12521 | 10 | c-ERB2 | | | 1100 | 0.0059 |
| 1.0419 | VLPEKDSWTV | 12522 | 10 | HIV | POL | | 940 | 0.0056 |
| 1.0666 | FLHSGTAKSV | 12523 | 10 | p53 | | | 113 | 0.0050 |
| 1.0473 | GLIHLGQNIV | 12524 | 10 | HCV | NS1/ENV | | 2690 | 0.0047 |
| 1.0792 | SLYAAVTNFL | 12525 | 10 | HBV | adw | POL | 1168 | 0.0046 |
| 1.0780 | IMPARFYPNV | 12526 | 10 | HBV | adw | POL | 713 | 0.0043 |
| 1.0507 | YLTRDPTTPL | 12527 | 10 | HCV | | LORF | 2803 | 0.0042 |
| 1.0914 | GLYNLLIRCL | 12528 | 10 | HPV | 18 | E6 | 97 | 0.0036 |
| 1.0649 | YLEYGRCRTV | 12529 | 10 | MAGE | 1 | | 248 | 0.0034 |
| 1.0561 | SLFTSITNEL | 12530 | 10 | HBV | adr | POL | 1139 | 0.0034 |
| 1.0788 | NLLSSDLSWL | 12531 | 10 | HBV | adw | POL | 1020 | 0.0032 |
| 1.0753 | RMARDPQRFV | 12532 | 10 | c-ERB2 | | | 978 | 0.0020 |
| 1.0568 | RMRGTFVVPL | 12533 | 10 | HBV | adr | POL | 1288 | 0.0020 |
| 1.0642 | SLQLVFGIDV | 12534 | 10 | MAGE | 1 | | 150 | 0.0020 |
| 1.0582 | KLLHKRTLGL | 12535 | 10 | HBV | adr | "X" | 1509 | 0.0019 |
| 1.0713 | GLGMEHLREV | 12536 | 10 | c-ERB2 | | | 344 | 0.0017 |
| 1.0742 | GMSYLEDVRL | 12537 | 10 | c-ERB2 | | | 832 | 0.0017 |
| 1.0549 | NLLSSNLSWL | 12538 | 10 | HBV | adr | POL | 991 | 0.0016 |
| 1.0465 | QLTVWGIKQL | 12539 | 10 | HIV | | ENV | 2760 | 0.0015 |
| 1.0524 | VLEYLVSFGV | 12540 | 10 | HBV | adr | CORE | 505 | 0.0015 |
| 1.0483 | VLNPSVAATL | 12541 | 10 | HCV | | LORF | 1253 | 0.0015 |
| 1.0548 | SLTNLLSSNL | 12542 | 10 | HBV | adr | POL | 988 | 0.0014 |
| 1.0512 | ALLDPRVRGL | 12543 | 10 | HBV | adr | ENV | 119 | 0.0011 |
| 1.0676 | TLEDSSGNLL | 12544 | 10 | p53 | | | 256 | 0.0011 |
| 1.0719 | TLQGLGISWL | 12545 | 10 | c-ERB2 | | | 444 | 0.0011 |
| 1.0627 | DLRAFQQLFL | 12546 | 10 | HPV | 18 | E7 | 82 | 0.0010 |
| 1.0725 | VLQGLPREYV | 12547 | 10 | c-ERB2 | | | 546 | 0.0009 |
| 1.0918 | DLPPWFPPMV | 12548 | 10 | EBNAI | | | 605 | 0.0009 |
| 1.0499 | DLSDGSWSTV | 12549 | 10 | HCV | | LORF | 2399 | 0.0008 |
| 1.0559 | CLAFSYMDDV | 12550 | 10 | HBV | adr | POL | 1118 | 0.0008 |
| 1.0632 | PLVLGTLEEV | 12551 | 10 | MAGE | 1 | | 37 | 0.0008 |
| 1.0520 | NLATWVGSNL | 12552 | 10 | HBV | adr | CORE | 457 | 0.0008 |
| 1.0400 | NLLTQIGCTL | 12553 | 10 | HIV | | POL | 684 | 0.0007 |

TABLE 182-continued

| Peptide | Sequence | SEQ ID NO | AA | Virus | Strain | Molecule | Pos. | A2.1 |
|---|---|---|---|---|---|---|---|---|
| 1.0488 | GLTHIDAHFL | 12554 | 10 | HCV | | LORF | 1564 | 0.0007 |
| 1.0733 | VLGSGAFGTV | 12555 | 10 | c-ERB2 | | | 725 | 0.0007 |
| 1.0434 | QLIKKEKVYL | 12556 | 10 | HIV | | POL | 1219 | 0.0006 |
| 1.0451 | KLLWKGEGAV | 12557 | 10 | HIV | | POL | 1495 | 0.0006 |
| 1.0470 | SMVGNWAKVL | 12558 | 10 | HCV | | ENVI | 364 | 0.0006 |
| 1.0570 | KLIGTDNSVV | 12559 | 10 | HBV | adr | POL | 1317 | 0.0006 |
| 1.0924 | ILLVVVLGVV | 12560 | 10 | c-ERB2 | | | 661 | 0.0006 |
| 1.0397 | LLDTGADDTV | 12561 | 10 | HIV | | POL | 619 | 0.0005 |
| 1.0446 | HLKTAVQMAV | 12562 | 10 | HIV | | POL | 1426 | 0.0005 |
| 1.0604 | DLLMGTLGIV | 12563 | 10 | HPV | 16 | E7 | 81 | 0.0005 |
| 1.0443 | LLKLAGRWPV | 12564 | 10 | HIV | | POL | 1356 | 0.0004 |
| 1.0461 | DLMVTVYYGV | 12565 | 10 | HIV | | ENV | 2181 | 0.0004 |
| 1.0619 | TLEKLTNTGL | 12566 | 10 | HPV | 18 | E6 | 89 | 0.0004 |
| 1.0787 | SLTNLLSSDL | 12567 | 10 | HBV | adw | POL | 1017 | 0.0004 |
| 1.0521 | NLEDPASREL | 12568 | 10 | HBV | adr | CORE | 465 | 0.0003 |
| 1.0583 | GLSAMSTTDL | 12569 | 10 | HBV | adr | | 1517 | 0.0003 |
| 1.0652 | VLVASRGRAV | 12570 | 10 | PSA | | | 36 | 0.0003 |
| 1.0716 | DLSVFQNLQV | 12571 | 10 | c-ERB2 | | | 421 | 0.0003 |
| 1.0723 | QLFRNPHQAL | 12572 | 10 | c-ERB2 | | | 484 | 0.0003 |
| 1.0727 | PLTSIISAVV | 12573 | 10 | c-ERB2 | | | 650 | 0.0003 |
| 1.0479 | YLKGSSGGPL | 12574 | 10 | HCV | | LORF | 1160 | 0.0002 |
| 1.0497 | QLPCEPEPDV | 12575 | 10 | HCV | | LORF | 2159 | 0.0002 |
| 1.0523 | CLTFGRETVL | 12576 | 10 | HBV | adr | CORE | 497 | 0.0002 |
| 1.0603 | TLEDLLMGTL | 12577 | 10 | HPV | 16 | E7 | 78 | 0.0002 |
| 1.0631 | SLHCKPEEAL | 12578 | 10 | MAGE | 1 | | 7 | 0.0002 |
| 1.0680 | EMPRELNEAL | 12579 | 10 | p53 | | | 339 | 0.0002 |
| 1.0689 | VLKDA1KDLV | 12580 | 10 | ENBA1 | | | 574 | 0.0002 |
| 1.0757 | DLVDAEEYLV | 12581 | 10 | c-ERB2 | | | 1016 | 0.0002 |
| 1.0796 | RMRGTFVSPL | 12582 | 10 | HBV | adw | POL | 1317 | 0.0002 |
| 1.0669 | QLAKTCPVQL | 12583 | 10 | p53 | | | 136 | 0.0001 |
| 1.0717 | NLQVIRGRIL | 12584 | 10 | c-ERB2 | | | 427 | 0.0001 |
| 1.0721 | WLGLRSLREL | 12585 | 10 | c-ERB2 | | | 452 | 0.0001 |
| 1.0522 | NMGLKIRQLL | 12586 | 10 | HBV | adr | CORE | 482 | 0 |
| 1.0527 | PLSYQHFRKL | 12587 | 10 | HBV | adr | POL | 576 | 0 |
| 1.0529 | ELPRLADEGL | 12588 | 10 | HBV | adr | POL | 598 | 0 |
| 1.0531 | GLNRRVAEDL | 12589 | 10 | HBV | adr | POL | 606 | 0 |
| 1.0536 | PLTVNEKRRL | 12590 | 10 | HBV | adr | POL | 672 | 0 |
| 1.0539 | IMPARFYPNL | 12591 | 10 | HBV | adr | POL | 684 | 0 |
| 1.0550 | PLHPAAMPHL | 12592 | 10 | HBV | adr | POL | 1012 | 0 |
| 1.0552 | DLHDSCSRNL | 12593 | 10 | HBV | adr | POL | 1051 | 0 |
| 1.0555 | LLYKTFGRKL | 12594 | 10 | HBV | adr | POL | 1066 | 0 |
| 1.0557 | PMGVGLSPFLI | 12595 | 10 | HBV | adr | POL | 1090 | 0 |
| 1.0560 | VLGAKSVQHL | 12596 | 10 | HBV | adr | POL | 1128 | 0 |
| 1.0569 | PLPIHTAELL | 12597 | 10 | HBV | adr | POL | 1296 | 0 |
| 1.0579 | PLPSLAPSAV | 12598 | 10 | HBV | adr | | 1454 | 0 |
| 1.0585 | DLEAYFKDCL | 12599 | 10 | HBV | adr | | 1525 | 0 |
| 1.0587 | ELGEEIRLKV | 12600 | 10 | HBV | adr | | 1540 | 0 |
| 1.0589 | VLGGCRHKLV | 12601 | 10 | HBV | adr | | 1551 | 0 |
| 1.0597 | TLEQQYNKPL | 12602 | 10 | HPV | 16 | E6 | 94 | 0 |
| 1.0608 | DLCTELNTSL | 12603 | 10 | HPV | 18 | E6 | 16 | 0 |
| 1.0616 | RLQRRRETQV | 12604 | 10 | HPV | 18 | E6 | 49 | 0 |
| 1.0621 | HLEPQNEIPV | 12605 | 10 | HPV | 18 | E7 | 14 | 0 |
| 1.0639 | LLKYRAREPV | 12606 | 10 | MAGE | | 1/3 | 114 | 0 |
| 1.0643 | CLGLSYDGLL | 12607 | 10 | MAGE | | 1/3 | 174 | 0 |
| 1.0657 | DMSLLKNRFL | 12608 | 10 | PSA | | | 98 | 0 |
| 1.0658 | LLRLSEPAEL | 12609 | 10 | PSA | | | 119 | 0 |
| 1.0663 | PLSQETFSDL | 12610 | 10 | p53 | | | 13 | 0 |
| 1.0664 | PLPSQAMDDL | 12611 | 10 | p53 | | | 34 | 0 |
| 1.0690 | ELAALCRWGL | 12612 | 10 | c-ERB2 | | | 2 | 0 |
| 1.0692 | RLPASPETHL | 12613 | 10 | c-ERB2 | | | 34 | 0 |
| 1.0699 | RLRIVRGTQL | 12614 | 10 | c-ERB2 | | | 98 | 0 |
| 1.0701 | GLRELQLRSL | 12615 | 10 | c-ERB2 | | | 136 | 0 |
| 1.0730 | QMRILKETEL | 12616 | 10 | c-ERB2 | | | 711 | 0 |
| 1.0732 | ILKETELRKV | 12617 | 10 | c-ERB2 | | | 714 | 0 |
| 1.0754 | PLDSTFYRSL | 12618 | 10 | c-ERB2 | | | 999 | 0 |
| 1.0755 | LLEDDDMGDL | 12619 | 10 | c-ERB2 | | | 1008 | 0 |
| 1.0758 | DLGMGAAKGL | 12620 | 10 | c-ERB2 | | | 1089 | 0 |
| 1.0761 | PLPSETDGYV | 12621 | 10 | c-ERB2 | | | 1119 | 0 |
| 1.0763 | TLSGKNGVV | 12622 | 10 | c-ERB2 | | | 1172 | 0 |
| 1.0765 | TLQDPRVRAL | 12623 | 10 | HBV | adw | ENV | 119 | 0 |
| 1.0768 | NMENIASGLL | 12624 | 10 | HBV | adw | ENV | 163 | 0 |
| 1.0775 | ELPHLADEGL | 12625 | 10 | HBV | adw | POL | 627 | 0 |
| 1.0776 | GLNRPVAEDL | 12626 | 10 | HBV | adw | POL | 635 | 0 |
| 1.0777 | PLTVNENRRL | 12627 | 10 | HBV | adw | POL | 701 | 0 |
| 1.0790 | LLYKTYGRKL | 12628 | 10 | HBV | adw | POL | 1095 | 0 |
| 1.0801 | GLSAMSPTDL | 12629 | 10 | HBV | adw | | 1546 | 0 |
| 1.0802 | DLEAYFICDCV | 12630 | 10 | HBV | adw | | 1554 | 0 |
| 1.0803 | TLQDPRVRGL | 12631 | 10 | HBV | ayw | ENV | 119 | 0 |

TABLE 182-continued

| Peptide | Sequence | SEQ ID NO | AA | Virus | Strain | Molecule | Pos. | A2.1 |
|---|---|---|---|---|---|---|---|---|
| 1.0804 | NMENITSGFL | 12632 | 10 | HBV | ayw | ENV | 163 | 0 |
| 1.0891 | DLVNLLPAIL | 12633 | 10 | HCV | | LORF | 1878 | 0 |
| 1.0404 | PLTEEKIKAL | 12634 | 10 | HW | | POL | 720 | <0.0002 |
| 1.0409 | QLGIPHPAGL | 12635 | 10 | HIV | | POL | 786 | <0.0002 |
| 1.0411 | GLKKKKSVTV | 12636 | 10 | HIV | | POL | 794 | <0.0002 |
| 1.0450 | PIWKGPAKLL | 12637 | 10 | HIV | | POL | 1488 | <0.0002 |
| 1.0476 | DLAVAVEPVV | 12638 | 10 | HCV | | LORF | 966 | <0.0002 |
| 1.0478 | SLTGRDKNQV | 12639 | 10 | HCV | | LORF | 1046 | <0.0002 |
| 1.0490 | DLEVVTSTWV | 12640 | 10 | HCV | | LORF | 1652 | <0.0002 |
| 1.0494 | GLGKVLIDIL | 12641 | 10 | HCV | | LORF | 1843 | <0.0002 |
| 1.0505 | VLTTSCGNTL | 12642 | 10 | HCV | | LORF | 2704 | <0.0002 |
| 1.0506 | ELITSCSSNV | 12643 | 10 | HCV | | LORF | 1781 | <0.0002 |
| 1.0510 | CLRKLGVPPL | 12644 | 10 | HCV | | LORF | 1908 | <0.0002 |
| 1.0511 | PLGFFPDHQL | 12645 | 10 | HBV | adr | ENV | 10 | <0.0002 |
| 1.0514 | NMENTTSGFL | 12646 | 10 | HBV | adr | ENV | 163 | <0.0002 |

TABLE 183

B7-like cross-reactive binders

| PEPTIDE | AA | P1 | P2 | P3 | P4 | P5 | P6 | P7 | P8 | P9 | P10 | SEQ ID NO | Virus | B*0701 (nM) | B*3501 (nM) | B*5301 (nM) | B*5401 (nM) | Minimal population coverage |
|---|---|---|---|---|---|---|---|---|---|---|---|---|---|---|---|---|---|---|
| 15.066 | 9 | F | P | V | R | P | Q | V | P | L | | 12647 | HIV | 7.1 | 22 | 192 | 44 | 36.3 |
| 15.032 | 9 | I | P | I | P | S | S | W | A | F | | 12648 | HBV | 60 | 7.8 | 35 | 4000 | 32.6 |
| 15.044 | 9 | L | P | G | C | S | F | S | I | F | | 12649 | HCV | 61 | 113 | 122 | 8000 | 32.6 |
| 15.107 | 9 | V | P | I | S | H | L | Y | I | L | | 12650 | MAGE2 | 22 | 384 | 396 | 3525 | 32.6 |
| 15.037 | 9 | F | P | H | C | L | A | F | S | I | | 12651 | HBV | 3375 | 7.5 | 18 | 400 | 25.8 |
| 15.140 | 9 | M | P | E | A | G | L | L | I | I | | 12652 | MAGE3 | 320 | — | 92 | 112 | 21.6 |
| 15.134 | 9 | L | P | T | T | M | N | I | P | L | | 12653 | MAGE3 | 71 | 46 | 802 | 3152 | 27.9 |
| 16.012 | 9 | F | P | Y | L | V | A | Y | Q | A | | 12654 | HCV | 18000 | 182 | 1706 | 1.2 | 20.6 |
| 16.009 | 9 | L | P | V | C | A | F | S | S | A | | 12655 | HBV | 348 | 533 | — | 2.0 | 16.3 |
| 16.064 | 9 | F | P | R | I | W | L | H | J | L | | 12656 | HIV | 5.4 | 10286 | 16909 | 226 | 16.3 |
| 16.032 | 9 | A | P | L | L | L | A | R | A | A | | 12657 | PAP | 257 | — | — | 2.6 | 16.3 |
| 16.176 | 9 | H | P | Q | W | V | L | T | A | A | | 12658 | PSA | 225 | 1532 | — | 1.1 | 16.3 |
| 15.047 | 9 | Y | P | C | T | V | N | F | T | I | | 12659 | HCV | 10800 | 966 | 102 | 89 | 9.9 |
| 15.073 | 9 | F | P | I | S | P | I | E | T | V | | 12660 | HIV | 3484 | 1051 | 251 | 9.8 | 9.9 |
| 15.217 | 10 | F | P | H | C | L | A | F | S | Y | M | 12661 | HBV | 99 | 119 | 380 | 671 | 32.6 |
| 15.268 | 10 | Y | P | L | A | S | L | R | S | L | F | 12662 | HIV | 400 | 480 | 150 | 759 | 32.6 |
| 15.350 | 10 | T | P | Y | A | G | E | P | A | P | F | 12663 | P fal | 55 | 76 | 420 | 4674 | 32.6 |
| 15.214 | 10 | T | P | A | R | V | T | G | G | V | F | 12664 | HBV | 75 | 294 | — | — | 27.9 |
| 15.225 | 10 | Y | P | C | T | V | N | F | T | I | F | 12665 | HCV | 1521 | 399 | 1257 | 315 | 20.6 |
| 16.185 | 10 | I | P | Q | A | V | V | D | M | V | A | 12666 | HCV | 7043 | 300 | — | 5.7 | 20.6 |
| 16.187 | 10 | L | P | C | S | F | T | T | L | P | A | 12667 | HCV | 422 | 24000 | — | 16 | 16.3 |
| 16.196 | 10 | L | P | Q | G | W | K | G | S | P | A | 12668 | HIV | 450 | — | — | 18 | 16.3 |

TABLE 184

Murine MHC molecules

| MHC class | Allele | Cell Line | Ab utilized for Capture Assay |
|---|---|---|---|
| I | Db | ELA | |
| I | Db | P815 | |
| I | Kb | EL4 | |
| I | Kd | P815 | |
| I | Kk | CH27 | Y3 |
| I | Ld | P815 | |
| II | IAb | DB27.4 | |
| II | IAd | A20 | |
| II | IAk | CH12 | |
| II | IAs | LS102.9 | |
| II | IAu | 91.7 | |
| II | IEd | A20 | |
| II | IEk | CH12 | |

TABLE 185

HLA CLASS I MHC MOLECULES

| HLA-A, B Allele | Cell Lines | Ab utilized for Capture assay |
|---|---|---|
| A*0101 | Steinlin, MAT | W6/32 |
| A*2601 | Pure Protein, QBL | W6/32 |
| A*2902 | Sweig, Pure Protein, Pitout | W6/32 |
| A*3002 | DUCAF, Pure Protein | W6/32 |
| A*2301 | Pure Protein, WT51 | W6/32 |
| A*2402 | KT3, Pure Protein, KAS116 | W6/32 |
| A*0201 | JY, OMW | W6/32 |
| A*0202 | M7B | W6/32 |
| A*0203 | FUN | W6/32 |
| A*0205 | DAH | W6/32 |
| A*0206 | CLA | W6/32 |
| A*0207 | AP | W6/32 |
| A*6802 | AMAI | W6/32 |
| A*0301 | GM3107 | W6/32 |
| A*1101 | BVR | W6/32 |
| A*3101 | SPACH, OLL | W6/32 |

TABLE 185-continued

| HLA CLASS I MHC MOLECULES | | |
|---|---|---|
| HLA-A, B Allele | Cell Lines | Ab utilized for Capture assay |
| A*3301 | LWAGS | W6/32 |
| A*6801 | OR, 2F7 | W6/32 |
| B*0702 | GM3107, JY | W6/32 |
| B*3501 | CIR, BVR | W6/32 |
| B*5101 | KAS116 | W6/32 |
| B*5301 | AMAI | W6/32 |
| B*5401 | KT3 | W6/32 |
| B*1801 | DUCAF | W6/32 |
| B*4001 | 2F7 | W6/32 |
| B*4002 | Sweig | W6/32 |
| B*4402 | WT47 | B1.23.1 |
| B*4403 | Pitout | B1.23.1 |
| B*4501 | OMW | W6/32 |
| A*3201 | Pure Protein, WT47 | W6/32 |

TABLE 186

Binding affinity of HLA-DR supertype and DR3 motif-positive peptides

| Peptide | Sequence | SEQ ID NO | AA | Organism | Protein | Position | Analog | DRB1 *0101 | DRB1 *0301 | DRB1 *0401 | DRB1*0404 | DRB1 *0405 |
|---|---|---|---|---|---|---|---|---|---|---|---|---|
| F116.01 | MDIDPYKEFGATVELLSFLPSDFFP | 12669 | 25 | HBV | core | 1 | | 1563 | | 170 | | |
| F209.01 | LETTMRSPVFTDNSSPPVVP | 12670 | 20 | HCV | | | | 374 | 433 | 155 | 3648 | 65 |
| F209.02 | AYAAQGYKVLVLNPSVAA | 12671 | 18 | HCV | | | | 8.0 | 594 | 3.7 | 19 | 51 |
| F209.03 | TPAETTVRLRAYMNTPGLPV | 12672 | 20 | HCV | | | | 168 | 10,193 | 43 | 6.9 | 16 |
| F209.04 | ENLPYLVAYQATVCARAQAP | 12673 | 20 | HCV | | | | 4.2 | 471 | 3.6 | 10 | 76 |
| F209.05 | GIQYLAGLSTLPGNPAIA | 12674 | 18 | HCV | | | | 2.5 | — | 2.7 | 1.6 | 4.9 |
| F209.06 | KGGRKPARLIVFPDLGVRVC | 12675 | 20 | HCV | | | | 283 | 152 | 900 | 51 | 45 |
| F209.07 | CGKYLFNWAVRTKLKLTPIA | 12676 | 20 | HCV | | | | 48 | 546 | 187 | 401 | 91 |
| 90.0062 | NGWFYVEAVIDRQTG | 12677 | 15 | HPV | E1 | 15 | | 157 | 241 | 69 | 5136 | 12 |
| 90.0075 | TGWFEVEAVIERRTG | 12678 | 15 | HPV | E1 | 15 | | 17,057 | 17 | 139 | 5358 | 6108 |
| 90.0029 | NGWFYVEAVVEKKTG | 12679 | 15 | HPV | E1 | 16 | | 219 | 136 | 31 | 3174 | 27 |
| 90.0126 | EDEIDTDLDGFIDDS | 12680 | 15 | HPV | E1 | 40 | | 320 | 128 | — | 2040 | 1019 |
| 90.0077 | LLEFIDDSMENSIQA | 12681 | 15 | HPV | E1 | 47 | | 500 | 518 | 244 | 168 | 534 |
| 89.0078 | VDFIDTQLSICEQAE | 12682 | 15 | HPV | E1 | 48 | | 169 | 3780 | 1285 | 1207 | 284 |
| 90.0031 | VDFIVNDNDYLTQAE | 12683 | 15 | HPV | E1 | 49 | | 2826 | 42 | 145 | — | — |
| 90.0078 | ENSIQADTEAARALF | 12684 | 15 | HPV | E1 | 56 | | 3905 | 620 | — | — | — |
| 89.0022 | QAELETAQALFHAQE | 12685 | 15 | HPV | E1 | 60 | | 1814 | | 122 | 1086 | 592 |
| 89.0114 | GQQLLQVQTAHADKQ | 12686 | 15 | HPV | E1 | 66 | | — | | — | 4117 | — |
| 89.0115 | QQLLQVQTAHADKQT | 12687 | 15 | HPV | E1 | 67 | | 1113 | | 5496 | 9268 | — |
| 89.0001 | HALFTAQEAKQHRDA | 12688 | 15 | HPV | E1 | 68 | | 4690 | | 205 | — | 4747 |
| 90.0047 | AQEVHNDAQVLHVLK | 12689 | 15 | HPV | E1 | 72 | | 407 | 21 | 4528 | 10,588 | — |
| 89.0093 | EDDLHAVSAVKRKFT | 12690 | 15 | HPV | E1 | 76 | | 372 | | — | — | — |
| 90.0048 | GERLEVDTELSPRLQ | 12691 | 15 | HPV | E1 | 100 | | — | 15 | 2668 | — | — |
| 90.0129 | QQTVCREGVKRRLIL | 12692 | 15 | HPV | E1 | 100 | | 5891 | 711 | 82 | 2449 | 1072 |
| 90.0064 | LKAICIENNSKTAKR | 12693 | 15 | HPV | E1 | 109 | | 62 | 86 | 36 | 1933 | 369 |
| 90.0032 | LKAICIEKQSRAAKR | 12694 | 15 | HPV | E1 | 110 | | 259 | 21 | 307 | 830 | — |
| 89.0039 | NTEVETQQMVQVEEQ | 12695 | 15 | HPV | E1 | 135 | | 2634 | | — | 5961 | — |
| 89.0059 | NTEVETQQMVQQVES | 12696 | 15 | HPV | E1 | 135 | | — | | — | — | — |
| 89.0002 | NTEVETQQMLQVEGR | 12697 | 15 | HPV | E1 | 136 | | 4981 | | 1059 | 3887 | — |
| 89.0040 | MVQVEEQQTTLSCNG | 12698 | 15 | HPV | E1 | 143 | | 1164 | | 340 | 1501 | — |
| 89.0041 | LYGVSFMELIRPFQS | 12699 | 15 | HPV | E1 | 194 | | 444 | — | 5208 | 917 | 1803 |
| 89.0003 | LNVLKTSNAKAAMLA | 12700 | 15 | HPV | E1 | 195 | | 33 | 114 | 3.4 | 881 | 2378 |
| 89.0140 | TLLYKFKEAYGVSFM | 12701 | 15 | HPV | E1 | 199 | | 1097 | | — | 5155 | 16,743 |
| 89.0094 | TVLEKEKETYGVSFM | 12702 | 15 | HPV | E1 | 202 | | 54 | — | 993 | 2774 | 1957 |
| 89.0060 | AYGISFMELVRPFKS | 12703 | 15 | HPV | E1 | 207 | | 640 | 7088 | 1723 | 1170 | 4261 |
| 89.0095 | TYGVSFMELVRPFKS | 12704 | 15 | HPV | E1 | 210 | | 176 | | — | — | — |
| 90.0050 | MLAVFKDTYGLSFTD | 12705 | 15 | HPV | E1 | 214 | | 9668 | 45 | 829 | 2445 | — |
| 89.0042 | DWCVAAFGVTGTVAE | 12706 | 15 | HPV | E1 | 215 | | 11 | — | 294 | 76 | 184 |
| 89.0079 | DWVMAIFGVNPTVAE | 12707 | 15 | HPV | E1 | 228 | | 58 | 431 | 45 | 58 | 85 |
| 89.0080 | VMAIFGVNPTVAEGF | 12708 | 15 | HPV | E1 | 230 | | 190 | 699 | 77 | 36 | 17 |
| 90.0051 | VRNFKSDKTTCTDWV | 12709 | 15 | HPV | E1 | 230 | | — | 404 | 57 | 815 | 3300 |
| 89.0081 | MAIFGVNPTVAEGFK | 12710 | 15 | HPV | E1 | 231 | | 101 | 381 | 75 | 45 | 36 |
| 89.0096 | DWCIIGMGVTPSVAE | 12711 | 15 | HPV | E1 | 231 | | — | | 1063 | | — |
| 89.0097 | WCIIGMGVTPSVAEG | 12712 | 15 | HPV | E1 | 232 | | — | | — | — | — |
| 89.0119 | LKTIIKPHCMYYHMQ | 12713 | 15 | HPV | E1 | 238 | | — | | 1995 | 6042 | 11,579 |
| 89.0023 | VTAIFGVNPTIAEGF | 12714 | 15 | HPV | E1 | 244 | | 1137 | 3418 | 836 | 6545 | 100 |

TABLE 186-continued

Binding affinity of HLA-DR supertype and DR3 motif-positive peptides

| | | | | | | | | | | | |
|---|---|---|---|---|---|---|---|---|---|---|---|
| 89.0061 | LKVLIKQHSLYTHLQ | 12715 | 15 | HPV | E1 | 244 | 4.3 | 1829 | 17 | 229 | 687 |
| 89.0082 | FKTLIKPATLYAHIQ | 12716 | 15 | HPV | E1 | 244 | 23 | 825 | 123 | 1494 | 14 |
| 89.0142 | LKVLIKQHSIYTHLQ | 12717 | 15 | HPV | E1 | 244 | 8977 | | — | — | — |
| 89.0024 | TAIFGVNPTIAEGFK | 12718 | 15 | HPV | E1 | 245 | 566 | 374 | 54 | 1693 | 17 |
| 89.0083 | KTLIKPATLYAHIQC | 12719 | 15 | HPV | E1 | 245 | 60 | 1220 | 1429 | 666 | 841 |
| 89.0098 | LKVLIQPYSIYAHLQ | 12720 | 15 | HPV | E1 | 247 | 207 | 191 | 524 | 929 | 2242 |
| 89.0043 | ACSWGMVMLMLVRFK | 12721 | 15 | HPV | E1 | 248 | 1246 | | 1030 | 751 | 1530 |
| 89.0044 | SWGMVMLMLVRFKCA | 12722 | 15 | HPV | E1 | 250 | 4895 | | 3376 | 677 | 4764 |
| 89.0025 | FKTLIQPFILYAHIQ | 12723 | 15 | HPV | E1 | 258 | 27 | — | 728 | 359 | 463 |
| 89.0062 | DRGIIILLLIRFRCS | 12724 | 15 | HPV | E1 | 263 | — | | — | 1926 | 7177 |
| 89.0063 | RGIIILLLIRFRCSK | 12725 | 15 | HPV | E1 | 264 | 674 | — | 883 | 403 | 241 |
| 89.0099 | DRGVLILLLIRFKCG | 12726 | 15 | HPV | E1 | 266 | 20 | 470 | 1483 | 417 | 3340 |
| 89.0004 | ACSWGMVVLLLVRYK | 12727 | 15 | HPV | E1 | 268 | 1017 | | 701 | 951 | 1942 |
| 89.0005 | SWGMVVLLLVRYKCG | 12728 | 15 | HPV | E1 | 270 | 10,893 | | 4669 | 1123 | 401 |
| 89.0045 | EKLLEKLLCISTNCM | 12729 | 15 | HPV | E1 | 271 | 2118 | | 319 | 645 | 3012 |
| 89.0123 | RKTIAKALSSILNVP | 12730 | 15 | HPV | E1 | 274 | — | | 11,494 | 15,385 | — |
| 89.0026 | DCKWGVLILALLRYK | 12731 | 15 | HPV | E1 | 275 | 1234 | | 1086 | 954 | 1341 |
| 89.0027 | KWGVLILALLRYKCG | 12732 | 15 | HPV | E1 | 277 | 333 | — | 584 | 275 | 139 |
| 89.0064 | KNRLTVAKLMSNLLS | 12733 | 15 | HPV | E1 | 278 | 5.6 | 9724 | 21 | 99 | 12 |
| 89.0065 | RLTVAKLMSNLLSIP | 12734 | 15 | HPV | E1 | 280 | 4.3 | 4145 | 6.2 | 80 | 43 |
| 89,0046 | TNCMLIQPPKLRSTA | 12735 | 15 | HPV | E1 | 282 | 17 | | 1855 | 2930 | 3218 |
| 89,0100 | RLTVSKLMSQLLNIP | 12736 | 15 | HPV | E1 | 283 | 10,480 | | — | 3836 | — |
| 89.0047 | CMLIQPPKLRSTAAA | 12737 | 15 | HPV | E1 | 284 | 286 | 5764 | 2378 | 6250 | — |
| 89.0066 | AKLMSNLLSIPETCM | 12738 | 15 | HPV | E1 | 284 | 323 | 12,831 | 99 | 155 | 34 |
| 89.0101 | VSKLMSQLLNIPETH | 12739 | 15 | HPV | E1 | 286 | — | 922 | 10,576 | 2393 | |
| 89.0006 | RETIEKLLSKLLCVS | 12740 | 15 | HPV | E1 | 287 | 199 | 12,973 | — | 359 | 6166 |
| 89.0067 | SNLLSIPETCMVIEP | 12741 | 15 | HPV | E1 | 288 | 347 | — | 320 | 275 | 18 |
| 89.0124 | QEQMLIQPPKIRSPA | 12742 | 15 | HPV | E1 | 289 | — | | 991 | 18,467 | 8054 |
| 89.0007 | EKLLSKLLCVSPMCM | 12743 | 15 | HPV | E1 | 291 | 331 | | 1100 | 582 | 1172 |
| 89.0102 | SQLLNIPETHMVIEP | 12744 | 15 | HPV | E1 | 291 | — | | — | — | — |
| 89.0028 | RLTVAKGLSTLLHVP | 12745 | 15 | HPV | E1 | 294 | 46 | 14,544 | 53 | 73 | 379 |
| 89.0084 | ETCMLIEPPKLRSSV | 12746 | 15 | HPV | E1 | 295 | 35 | 359 | 2128 | 546 | 906 |
| 90.0083 | ETCMVIEPPKLRSQT | 12747 | 15 | HPV | E1 | 295 | 26 | 275 | 1548 | 536 | 2280 |
| 89.0103 | ETHMVIEPPKLRSAT | 12748 | 15 | HPV | E1 | 298 | 1253 | | 778 | 898 | 3542 |
| 90.0034 | PMCMMIEPPKLRSTA | 12749 | 15 | HPV | E1 | 302 | 37 | 182 | 366 | 4039 | 2110 |
| 89.0029 | ETCMLIQPPKLRSSV | 12750 | 15 | HPV | E1 | 309 | 60 | — | 901 | 719 | 1562 |
| 89.0048 | TPEWIERQTVLQHSF | 12751 | 15 | HPV | E1 | 316 | 643 | 34 | 451 | 1930 | |
| 89.0049 | PEWIERQTVLQHSFN | 12752 | 15 | HPV | E1 | 317 | 5243 | 210 | 18 | 139 | 440 |
| 89.0009 | LYWYKTGISNISEVY | 12753 | 15 | HPV | E1 | 319 | 41 | — | 20 | 495 | 113 |
| 89.0069 | TPEWIDRLTVLQHSF | 12754 | 15 | HPV | E1 | 329 | 14,615 | | 286 | 2930 | 987 |
| 90.0035 | ISEVYGDTPEWIQRQ | 12755 | 15 | HPV | E1 | 329 | — | 50 | — | — | 12,808 |
| 89.0070 | PEWIDRLTVLQHSFN | 12756 | 15 | HPV | E1 | 330 | 2614 | 10,315 | 54 | 28 | 79 |
| 89.0050 | DTTFDLSQMVQWAYD | 12757 | 15 | HPV | E1 | 332 | 722 | — | 157 | 2526 | — |
| 89.0104 | TPEWIEQQTVLQHSF | 12758 | 15 | HPV | E1 | 332 | 949 | | 111 | 577 | 2881 |
| 89.0105 | PEWIEQQTVLQHSFD | 12759 | 15 | HPV | E1 | 333 | 2076 | | 1817 | 3637 | 5594 |
| 89.0010 | TPEWIQRQTVLQHSF | 12760 | 15 | HPV | E1 | 336 | 1293 | 706 | 80 | 4707 | 17 |
| 90.0052 | ISEVMGDTPEWIQRL | 12761 | 15 | HPV | E1 | 336 | 2879 | 55 | — | 5445 | 4109 |
| 89.0011 | PEWIQRQTVLQHSFN | 12762 | 15 | HPV | E1 | 337 | 2262 | 155 | 18 | 243 | 259 |
| 90.0152 | QHSFNDDIFDLSEMI | 12763 | 15 | HPV | E1 | 340 | 42 | 534 | 37 | 282 | 384 |
| 89.0030 | TPEWIQRLTIIQHGI | 12764 | 15 | HPV | E1 | 343 | 669 | — | 190 | 1926 | 204 |
| 89.0031 | PEWIQRLTIIQHGID | 12765 | 15 | HPV | E1 | 344 | 879 | 4381 | 172 | 1942 | 131 |

TABLE 186-continued

Binding affinity of HLA-DR supertype and DR3 motif-positive peptides

| | | | | | | | | | | | |
|---|---|---|---|---|---|---|---|---|---|---|---|
| 90.0069 | DNDVMDDSEIAYKYA | 12766 | 15 | HPV | E1 | 346 | — | 53 | 3682 | — | 10,080 |
| 89.0106 | NSIFDFGEMVQWAYD | 12767 | 15 | HPV | E1 | 348 | 4846 | | 5252 | 9704 | — |
| 89.0051 | DSEIAYKYAQLADSD | 12768 | 15 | HPV | E1 | 352 | 314 | | — | 6026 | 12,151 |
| 89.0130 | DSQIAFQYAQLADVD | 12769 | 15 | HPV | E1 | 359 | — | | 2996 | 4692 | 9989 |
| 90.0085 | DNELTDDSDIAYYYA | 12770 | 15 | HPV | E1 | 359 | — | 98 | — | — | — |
| 90.0036 | QWAYDNDIVDDSEIA | 12771 | 15 | HPV | E1 | 362 | — | 990 | 11,814 | — | 4257 |
| 90.0117 | DHDITDDSDIAYKYA | 12772 | 15 | HPV | E1 | 362 | — | 100 | 510 | 3067 | 2211 |
| 89.0071 | DSDIAYYYAQLADSN | 12773 | 15 | HPV | E1 | 365 | 198 | | 1254 | — | 6029 |
| 89.0085 | ESDMAFQYAQLADCN | 12774 | 15 | HPV | E1 | 365 | 11 | | 233 | 4430 | 19,698 |
| 90.0037 | DNDIVDDSEIAYKYA | 12775 | 15 | HPV | E1 | 366 | — | 28 | 4621 | — | — |
| 89.0072 | IAYYYAQLADSNSNA | 12776 | 15 | HPV | E1 | 368 | 382 | | 753 | 3442 | 4870 |
| 89.0108 | DIAYKYAQLADVNSN | 12777 | 15 | HPV | E1 | 370 | 4725 | | 88 | 3136 | 2196 |
| 89.0012 | DSEIAYKYAQLADTN | 12778 | 15 | HPV | E1 | 372 | 734 | | 1952 | 4475 | 10,972 |
| 90.0070 | QAKIVKDCGTMCRHY | 12779 | 15 | HPV | E1 | 378 | — | 268 | — | 12,484 | — |
| 90.0055 | ESDMAFEYALLADSN | 12780 | 15 | HPV | E1 | 379 | 57 | 591 | 24 | 501 | 1413 |
| 90.0139 | QAKYVKDCGIMCRHY | 12781 | 15 | HPV | E1 | 385 | 276 | 326 | 47 | 304 | 190 |
| 90.0086 | QAKIVKDCGIMCRHY | 12782 | 15 | HPV | E1 | 391 | — | 818 | 4471 | 1134 | — |
| 90.0103 | QAKYLKDCAVMCRHY | 12783 | 15 | HPV | E1 | 391 | 234 | 81 | 2817 | 7809 | 14,353 |
| 90.0038 | QAKIVKDCATMCRHY | 12784 | 15 | HPV | E1 | 398 | — | 44 | 3843 | 2380 | — |
| 89.0052 | VKFLRYQQIEFVSFL | 12785 | 15 | HPV | E1 | 423 | 423 | | 1284 | 930 | 2767 |
| 89.0053 | VSFLSALKLFLKGVP | 12786 | 15 | HPV | E1 | 434 | 23 | 387 | 1572 | 207 | 1271 |
| 89.0013 | GGDWKQIVMFLRYQG | 12787 | 15 | HPV | E1 | 436 | 2045 | 6322 | 793 | 677 | 1369 |
| 89.0054 | LKLFLKGVPKKNCIL | 12788 | 15 | HPV | E1 | 440 | 200 | 9897 | 2911 | 423 | 5637 |
| 89.0014 | VMFLRYQGVEFMSFL | 12789 | 15 | HPV | E1 | 443 | 605 | 18,750 | 927 | 1506 | 629 |
| 89.0132 | FLSYFKLFLQGTPKH | 12790 | 15 | HPV | E1 | 443 | — | | 1370 | 1642 | 7811 |
| 89.0133 | YFKLFLQGTPKHNCL | 12791 | 15 | HPV | E1 | 446 | — | | 109 | 6687 | 6122 |
| 89.0134 | FKLFLQGTPKHNCLV | 12792 | 15 | HPV | E1 | 447 | 1370 | 1910 | 22 | 171 | 251 |
| 89.0055 | KNCILIHGAPNTGKS | 12793 | 15 | HPV | E1 | 450 | 3357 | | — | 2757 | 3853 |
| 89.0015 | VEFMSFLTALKRFLQ | 12794 | 15 | HPV | E1 | 451 | 19 | 347 | 72 | 27 | 453 |
| 89.0073 | FKKFLKGIPKKSCML | 12795 | 15 | HPV | E1 | 453 | 20 | — | 452 | 407 | 17,490 |
| 89.0086 | LKEFLKGTPKKNCIL | 12796 | 15 | HPV | E1 | 453 | 175 | | 1621 | 3514 | 14,903 |
| 89.0033 | IEFITFLGALKSFLK | 12797 | 15 | HPV | E1 | 458 | 8.6 | 2298 | 74 | 196 | 1642 |
| 89.0016 | LKRFLQGIPKKNCIL | 12798 | 15 | HPV | E1 | 460 | 69 | | 944 | 855 | — |
| 89.0034 | ITFLGALKSFLKGTP | 12799 | 15 | HPV | E1 | 461 | 18 | 3972 | 316 | 101 | 1649 |
| 89.0056 | GKSYFGMSLISFLQG | 12800 | 15 | HPV | E1 | 462 | 170 | | 1092 | 403 | 1227 |
| 89.0074 | SCMLICGPANTGKSY | 12801 | 15 | HPV | E1 | 464 | 164 | | 1233 | 607 | 5886 |
| 89.0087 | NCILLYGPANTGKSY | 12802 | 15 | HPV | E1 | 464 | 110 | | 280 | 2276 | 7343 |
| 89.0035 | LKSFLKGTPKKNCLV | 12803 | 15 | HPV | E1 | 467 | 30 | — | 320 | 79 | 387 |
| 89.0017 | NCILLYGAANTGKSL | 12804 | 15 | HPV | E1 | 471 | 81 | — | 552 | 2149 | 4060 |
| 89.0018 | ILLYGAANTGKSLFG | 12805 | 15 | HPV | E1 | 473 | 230 | | 150 | 3499 | — |
| 89.0075 | GKSYFGMSLIQFLKG | 12806 | 15 | HPV | E1 | 475 | 14 | 8828 | 456 | 871 | 1307 |
| 89.0146 | GKSYFGMSLIHFLKG | 12807 | 15 | HPV | E1 | 475 | — | | 561 | 904 | 13,208 |
| 89.0135 | LIKFFQGSVISFVNS | 12808 | 15 | HPV | E1 | 477 | — | | — | — | — |
| 89.0136 | IKFFQGSVISFVNSQ | 12809 | 15 | HPV | E1 | 478 | — | | 9676 | — | — |
| 89.0019 | GKSLFGMSLMKFLQG | 12810 | 15 | HPV | E1 | 482 | 17 | 2743 | 468 | 176 | 2182 |
| 89.0020 | KSLFGMSLMKFLQGS | 12811 | 15 | HPV | E1 | 483 | 2320 | — | 573 | 224 | 1814 |
| 89.0088 | FIHFLQGAIISFVNS | 12812 | 15 | HPV | E1 | 483 | 51 | 4391 | 2914 | — | |
| 89.0076 | IQFLKGCVISCVNSK | 12813 | 15 | HPV | E1 | 484 | 49 | 3690 | 1008 | 232 | 662 |
| 89.0089 | IHFLQGAIISFVNSN | 12814 | 15 | HPV | E1 | 484 | 4.2 | — | 499 | 84 | 2607 |
| 89.0147 | IHFLKGCIISYVNSK | 12815 | 15 | HPV | E1 | 484 | — | | 3841 | 531 | — |
| 89.0036 | FIHFIQGAVISFVNS | 12816 | 15 | HPV | E1 | 497 | 132 | | 552 | 2474 | 1217 |

TABLE 186-continued

Binding affinity of HLA-DR supertype and DR3 motif-positive peptides

| | | | | | | | | | | | |
|---|---|---|---|---|---|---|---|---|---|---|---|
| 89.0037 | IHFIQGAVISFVNST | 12817 | 15 | HPV | E1 | 498 | 31 | — | 5134 | — | 13,777 |
| 90.0087 | KIGMIDDVTPISWTY | 12818 | 15 | HPV | E1 | 510 | 3220 | 70 | 20 | 3873 | — |
| 90.0105 | KVAMLDDATHTCWTY | 12819 | 15 | HPV | E1 | 510 | 253 | 410 | 34 | 220 | 279 |
| 90.0040 | KIGMLDDATVPCWNY | 12820 | 15 | HPV | E1 | 517 | 4432 | 160 | 490 | 3192 | — |
| 89.0090 | CWTYFDNYMRNALDG | 12821 | 15 | HPV | E1 | 521 | 242 | | 3589 | 2475 | 4879 |
| 89.0137 | RNLVDGNPISLDRKH | 12822 | 15 | HPV | E1 | 524 | 11,190 | | 1041 | 3996 | — |
| 90.0059 | KVAMLDDATTTCWTY | 12823 | 15 | HPV | E1 | 524 | 864 | 551 | 1256 | 13,699 | 131 |
| 90.0041 | CWNYIDDNLRNALDG | 12824 | 15 | HPV | E1 | 528 | — | 446 | 3083 | 4667 | — |
| 89.0057 | LMQLKCPPLLITSNI | 12825 | 15 | HPV | E1 | 534 | 214 | | 1645 | 890 | 1485 |
| 89.0138 | LVQIKCPPLLITTNI | 12826 | 15 | HPV | E1 | 541 | — | | — | 6752 | — |
| 89.0077 | LVQLKCPPLLLTSNT | 12827 | 15 | HPV | E1 | 547 | 51 | | 4027 | 1205 | 3501 |
| 89.0091 | LLQLKCPPILLTSNI | 12828 | 15 | HPV | E1 | 547 | 37 | | 1441 | 4853 | — |
| 89.0139 | PPLLITTNINPMLDA | 12829 | 15 | HPV | E1 | 547 | 1221 | | 623 | 1534 | 3390 |
| 89.0058 | DDRWPYLHSRLVVFT | 12830 | 15 | HPV | E1 | 553 | 29 | — | — | 1734 | 17,711 |
| 89.0021 | LVQLKCPPLLITSNI | 12831 | 15 | HPV | E1 | 554 | 72 | | 4287 | 2860 | 7576 |
| 89.0038 | LIQLKCPPILLTTNI | 12832 | 15 | HPV | E1 | 561 | 15 | | 3802 | — | 3948 |
| 89.0113 | DPRWPYLHSRLVVFH | 12833 | 15 | HPV | E1 | 569 | 116 | 2718 | 138 | 359 | 6104 |
| 89.0092 | VTVFTFPHAFPFDKN | 12834 | 15 | HPV | E1 | 576 | 414 | — | 4228 | 3942 | 10,156 |
| 90.0106 | PHAFPFDKNGNPVYE | 12835 | 15 | HPV | E1 | 582 | 517 | 930 | 125 | — | 7191 |
| 90.0144 | RLNLDNDEDKENNGD | 12836 | 15 | HPV | E1 | 606 | 31 | 759 | 1775 | 344 | 1679 |
| 1601.21 | LSQRLNVCQDKILEH | 12837 | 15 | HPV | E2 | 4 | — | 210 | — | 3201 | 4631 |
| 90.0160 | RLNVCQDKILTHYEN | 12838 | 15 | HPV | E2 | 7 | 2.7 | 307 | 3.5 | 3121 | 6708 |
| 1601.01 | YENDSTDLRDHIDYW | 12839 | 15 | HPV | E2 | 19 | — | 15,766 | — | — | — |
| 1601.29 | LDHYENDSKDINSQI | 12840 | 15 | HPV | E2 | 22 | — | 1210 | — | — | — |
| 90.0021 | HWKLIRMECAIMYTA | 12841 | 15 | HPV | E2 | 32 | 28 | 82 | 843 | 2138 | 84 |
| 90.0199 | WKLIRMECALLYTAK | 12842 | 15 | HPV | E2 | 33 | 49 | 141 | 167 | 1925 | 1066 |
| 90.0230 | WKAVRHENVLYYKAR | 12843 | 15 | HPV | E2 | 33 | 164 | 76 | 718 | 938 | 10,293 |
| 90.0245 | WKLIRMECAIMYTAR | 12844 | 15 | HPV | E2 | 33 | 134 | 203 | 328 | 107 | 768 |
| 1601.44 | KHIRLLECVLMYKARE | 12845 | 16 | HPV | E2 | 34 | 120 | 72 | 67 | 34 | 236 |
| 89.0179 | LIRMECALLYTAKQM | 12846 | 15 | HPV | E2 | 35 | 998 | | 4756 | 2754 | — |
| 90.0022 | LIRMECAIMYTARQM | 12847 | 15 | HPV | E2 | 35 | 114 | 166 | 433 | 2256 | 815 |
| 90.0211 | WQLIRLENAILFTAR | 12848 | 15 | HPV | E2 | 39 | 4.1 | 41 | 514 | 74 | 308 |
| 90.0002 | LIRLENAILFTAREH | 12849 | 15 | HPV | E2 | 41 | 23 | | 1224 | 1640 | 1411 |
| 90.0010 | ITHIGHQVVPPMAVS | 12850 | 15 | HPV | E2 | 51 | 50 | | 235 | 2971 | 17,096 |
| 89.0168 | NHQVVPALSVSKAKA | 12851 | 15 | HPV | E2 | 55 | — | | 959 | 12,698 | — |
| 90.0011 | GHQVVPPMAVSKAKA | 12852 | 15 | HPV | E2 | 55 | 166 | | 451 | 2462 | 3360 |
| 89.0169 | HQVVPALSVSKAKAL | 12853 | 15 | HPV | E2 | 56 | 99 | | 398 | 2593 | 15,473 |
| 90.0012 | HQVVPPMAVSKAKAC | 12854 | 15 | HPV | E2 | 56 | 680 | | 2338 | 12,731 | — |
| 90.0023 | HQVVPSLVASKTKAF | 12855 | 15 | HPV | E2 | 56 | — | | — | — | — |
| 89.0150 | TLAVSKNKALQAIEL | 12856 | 15 | HPV | E2 | 61 | 12,500 | | — | 520 | 1642 |
| 89.0170 | ALSVSKAKALQAIEL | 12857 | 15 | HPV | E2 | 61 | 84 | | 281 | 1256 | 8429 |
| 90.0013 | PMAVSKAKACQAIEL | 12858 | 15 | HPV | E2 | 61 | 89 | | 1155 | 1274 | — |
| 89.0159 | AYNISKSKAHKAIEL | 12859 | 15 | HPV | E2 | 65 | 651 | | — | — | — |
| 89.0151 | NKALQAIELQLTLET | 12860 | 15 | HPV | E2 | 67 | 80 | | 1371 | 3669 | 3964 |
| 89.0171 | AKALQAIELQMMLET | 12861 | 15 | HPV | E2 | 67 | 16 | 1464 | 78 | 619 | 798 |
| 1601.30 | PINISKSKAHKAIEL | 12862 | 15 | HPV | E2 | 67 | 122 | 1068 | 255 | 97 | 1912 |
| 89.0181 | AFQVIELQMALETLS | 12863 | 15 | HPV | E2 | 69 | 3109 | 33 | 62 | 1144 | 252 |
| 90.0024 | AFQVIELQMALETLN | 12864 | 15 | HPV | E2 | 69 | 29 | 1279 | 182 | 1684 | 2096 |
| 89.0182 | FQVIELQMALETLSK | 12865 | 15 | HPV | E2 | 70 | 1008 | | 224 | 1984 | 232 |
| 90.0014 | CQAIELQLALEALNK | 12866 | 15 | HPV | E2 | 70 | 25 | 466 | 450 | 1622 | 1521 |
| 90.0018 | CSAIEVQIALESLST | 12867 | 15 | HPV | E2 | 70 | 314 | | 240 | — | 3321 |

TABLE 186-continued

| Binding affinity of HLA-DR supertype and DR3 motif-positive peptides | | | | | | | | | | | |
|---|---|---|---|---|---|---|---|---|---|---|---|
| 90.0025 | FQVIELQMALETLNA | 12868 | 15 | HPV | E2 | 70 | 20 | 743 | 75 | 1102 | 2487 |
| 89.0160 | HKAIELQMALQGLAQ | 12869 | 15 | HPV | E2 | 74 | — | | 350 | 2708 | — |
| 89.0183 | ELQMALETLSKSQYS | 12870 | 15 | HPV | E2 | 74 | 80 | | 434 | 1547 | 3286 |
| 90.0231 | EVQIALESLSTTIYN | 12871 | 15 | HPV | E2 | 74 | 179 | 708 | 1278 | 3236 | 4267 |
| 90.0004 | HKAIELQMALKGLAQ | 12872 | 15 | HPV | E2 | 76 | 2.1 | 32 | 6.7 | 732 | 3311 |
| 1601.22 | QMMLETLNNTEYKNE | 12873 | 15 | HPV | E2 | 76 | — | 9638 | 3773 | 333 | 63 |
| 1601.03 | LETIYNSQYSNEKWT | 12874 | 15 | HPV | E2 | 79 | 8607 | 14,325 | 99 | 2050 | 2999 |
| 90.0005 | ELQMALKGLAQSKYN | 12875 | 15 | HPV | E2 | 80 | 81 | 435 | 2219 | 1317 | 5946 |
| 90.0232 | TTIYNNEEWTLRDTC | 12876 | 15 | HPV | E2 | 84 | 10,608 | 282 | — | — | — |
| 90.0179 | QSRYKTEDWTLQDTC | 12877 | 15 | HPV | E2 | 88 | 115 | 335 | 71 | 154 | 1586 |
| 1601.23 | PTGCLKKHGYTVEVQ | 12878 | 15 | HPV | E2 | 106 | 17,932 | — | 19,760 | 7350 | — |
| 90.0026 | QKCFKKKGITVTVQY | 12879 | 15 | HPV | E2 | 107 | 463 | | 996 | 1327 | 2911 |
| 90.0167 | TVEVQFDGDICNTMH | 12880 | 15 | HPV | E2 | 116 | 2299 | 149 | 818 | 4161 | — |
| 1601.04 | DICNTMHYTNWTHIY | 12881 | 15 | HPV | E2 | 124 | 8963 | 14,814 | 883 | 7225 | 2816 |
| 1601.09 | GNKDNCMTYVAWDSV | 12882 | 15 | HPV | E2 | 127 | 2232 | 8832 | 2265 | 7100 | 186 |
| 90.0202 | GEIYIIEEDTCTMVT | 12883 | 15 | HPV | E2 | 135 | 1596 | 55 | 148 | 6173 | 8109 |
| 90.0214 | MNYVVWDSIYYITET | 12884 | 15 | HPV | E2 | 135 | 2605 | 151 | 1187 | 152 | 452 |
| 90.0250 | SEIYIIEETTCTLVA | 12885 | 15 | HPV | E2 | 135 | 174 | 133 | 166 | 1093 | 8080 |
| 90.0203 | EIYIIEEDTCTMVTG | 12886 | 15 | HPV | E2 | 136 | 1361 | 273 | 258 | 9565 | 3087 |
| 90.0251 | EIYIIEETTCTLVAG | 12887 | 15 | HPV | E2 | 136 | 174 | 176 | 213 | 12,579 | — |
| 1601.10 | VAWDSVYYMTDAGTW | 12888 | 15 | HPV | E2 | 136 | 7860 | 664 | 1655 | 385 | 7429 |
| 90.0204 | IYIIEEDTCTMVTGK | 12889 | 15 | HPV | E2 | 137 | 2230 | 142 | 151 | 4763 | 18,689 |
| 90.0182 | SVYYMTDAGTWDKTA | 12890 | 15 | HPV | E2 | 140 | 9.3 | 328 | 169 | 276 | 4065 |
| 90.0252 | CTLVAGEVDYVGLYY | 12891 | 15 | HPV | E2 | 145 | — | 238 | 776 | 731 | 9015 |
| 90.0171 | GLYYVHEGIRTYFVQ | 12892 | 15 | HPV | E2 | 156 | 26 | 689 | 668 | 793 | 4657 |
| 90.0226 | GLYYWCDGEKIYFVK | 12893 | 15 | HPV | E2 | 156 | 698 | 432 | 1473 | 3360 | 4057 |
| 1601.05 | VHEGIRTYFVQFKDD | 12894 | 15 | HPV | E2 | 160 | 9277 | 9335 | 12,106 | 2312 | 4232 |
| 90.0216 | GVYYIKDGDTTYYVQ | 12895 | 15 | HPV | E2 | 163 | 1553 | 176 | 2484 | 2528 | 7094 |
| 90.0205 | YFKYFKEDAAKYSKT | 12896 | 15 | HPV | E2 | 167 | 169 | 483 | 70 | 2279 | — |
| 90.0253 | YFKYFKEDAKKYSKT | 12897 | 15 | HPV | E2 | 167 | 4013 | 108 | 3615 | 4405 | — |
| 90.0206 | FKYFKEDAAKYSKTQ | 12898 | 15 | HPV | E2 | 168 | 63 | 451 | 19 | 2955 | 6856 |
| 1601.11 | EKYGNTGTWEVHFGN | 12899 | 15 | HPV | E2 | 181 | 505 | — | 1672 | — | 14,696 |
| 90.0237 | IWEVHMENESIYCPD | 12900 | 15 | HPV | E2 | 183 | 1776 | 588 | 3378 | 2791 | — |
| 89.0184 | EVHVGGQVIVCPTSI | 12901 | 15 | HPV | E2 | 185 | — | | — | — | 557 |
| 90.0015 | EVHVGGQVIVCPASV | 12902 | 15 | HPV | E2 | 185 | 4094 | | 2103 | 2443 | 6779 |
| 90.0238 | EVHMENESIYCPDSV | 12903 | 15 | HPV | E2 | 185 | 634 | 410 | 5247 | 11,990 | — |
| 89.0173 | GQVIVFPESVFSSDE | 12904 | 15 | HPV | E2 | 190 | 5813. | | 845 | 3871 | — |
| 89.0185 | GQVIVCPTSISSNQI | 12905 | 15 | HPV | E2 | 190 | 196 | | 91 | 855 | 7587 |
| 90.0016 | GQVIVCPASVSSNEV | 12906 | 15 | HPV | E2 | 190 | 24 | 7737 | 64 | — | 325 |
| 90.0027 | SRVIVCPTSIPSDQI | 12907 | 15 | HPV | E2 | 190 | — | | 1910 | 572 | 6144 |
| 90.0195 | ESVFSSDEISFAGIV | 12908 | 15 | HPV | E2 | 197 | 2379 | 862 | 33 | 2887 | 8580 |
| 1601.06 | SNEVSSPEIIRQHLA | 12909 | 15 | HPV | E2 | 202 | — | 4788 | — | 1651 | — |
| 1601.45 | SDEISFAGIVTKLPT | 12910 | 15 | HPV | E2 | 202 | 513 | 1658 | 8786 | 651 | 2350 |
| 89.0174 | EISFAGIVTKLPTAN | 12911 | 15 | HPV | E2 | 204 | 18,743 | | 1191 | 4156 | — |
| 89.0175 | FAGIVTKLPTANNTT | 12912 | 15 | HPV | E2 | 207 | 132 | | 153 | 645 | 5871 |
| 1601.13 | SDDTVSATQLVKQLQ | 12913 | 15 | HPV | E2 | 208 | 7238 | 10,474 | 9547 | 6337 | 16,299 |
| 1601.31 | STSDDTVSATQIVRQ | 12914 | 15 | HPV | E2 | 208 | 18,143 | 3744 | 558 | 2336 | — |
| 89.0162 | DDTVSATQLVKQLQH | 12915 | 15 | HPV | E2 | 209 | 111 | 241 | 100 | 132 | 674 |
| 89.0155 | RQHLANHPAATHTKA | 12916 | 15 | HPV | E2 | 212 | — | | — | 2675 | — |
| 89.0163 | TVSVGTAKTYGQTSA | 12917 | 15 | HPV | E2 | 231 | — | | 1812 | 944 | 2330 |
| 90.0208 | TKLFCADPALDNRTA | 12918 | 15 | HPV | E2 | 241 | — | 51 | 2477 | 3860 | 4511 |

TABLE 186-continued

Binding affinity of HLA-DR supertype and DR3 motif-positive peptides

| | | | | | | | | | | | |
|---|---|---|---|---|---|---|---|---|---|---|---|
| 89.0186 | DPALDNRTARTATNC | 12919 | 15 | HPV | E2 | 247 | 5552 | | 1057 | 11,737 | — |
| 1601.07 | PCHTTKLLHRDSVDS | 12920 | 15 | HPV | E2 | 250 | — | 7256 | — | — | — |
| 89.0156 | RDSVDSAPILTAFNS | 12921 | 15 | HPV | E2 | 259 | 7452 | | 20 | 1556 | — |
| 1601.34 | GRVNTHVHNPLLCSS | 12922 | 15 | HPV | E2 | 262 | 873 | 9950 | — | 1679 | 15,388 |
| 89.0165 | NPLLGAATPTGNNKR | 12923 | 15 | HPV | E2 | 264 | 655 | | 1242 | 1756 | 8250 |
| 1601.24 | DSVDSVNCGVISAAA | 12924 | 15 | HPV | E2 | 265 | 916 | — | 1283 | 113 | 13,605 |
| 1601.16 | KRRKLCSGNTTPIIH | 12925 | 15 | HPV | E2 | 277 | 522 | 5944 | 311 | 556 | 10,777 |
| 1601.08 | NCNSNTTPIVHLKGD | 12926 | 15 | HPV | E2 | 280 | 11,539 | — | 3106 | 960 | — |
| 1601.35 | NKRRKVCSGNTTPII | 12927 | 15 | HPV | E2 | 280 | — | — | 4945 | 2938 | — |
| 90.0255 | IVHLKGDPNSLKCLR | 12928 | 15 | HPV | E2 | 281 | 229 | 42 | 83 | 1334 | — |
| 1601.43 | RKVCSGNTTPIIHLK | 12929 | 15 | HPV | E2 | 283 | 1314 | — | 292 | 488 | 9213 |
| 1601.17 | TTPIIHKLGDRNSLK | 12930 | 15 | HPV | E2 | 286 | 85 | 501 | 392 | 280 | 19,007 |
| 1601.37 | NTTPIIHLKGDKNSL | 12931 | 15 | HPV | E2 | 289 | 860 | 7476 | 11,906 | 2745 | — |
| 90.0228 | IIHLKGDPNSLKCLR | 12932 | 15 | HPV | E2 | 290 | 136 | 11 | 121 | 1060 | 12,360 |
| 1601.25 | TTPIIHLKGDANILK | 12933 | 15 | HPV | E2 | 292 | 168 | 74 | 8823 | 627 | 19,514 |
| 90.0218 | IIHLKGDKNSLKCLR | 12934 | 15 | HPV | E2 | 293 | 851 | 42 | 347 | 373 | 12,714 |
| 90.0197 | IIHLKGDANILKCLR | 12935 | 15 | HPV | E2 | 295 | 69 | 26 | 64 | 468 | 6500 |
| 1601.26 | LKGDANILKCLRYRL | 12936 | 15 | HPV | E2 | 298 | 17,206 | 52 | 5592 | 2136 | 3143 |
| 89.0157 | HCTLYTAVSSTWHWT | 12937 | 15 | HPV | E2 | 308 | 2892 | | 18,959 | — | — |
| 90.0019 | RYRFQKYKTLFVDVT | 12938 | 15 | HPV | E2 | 308 | 74 | 5633 | 623 | 315 | 192 |
| 90.0241 | YKTLFVDVTSTYHWT | 12939 | 15 | HPV | E2 | 314 | 4031 | 56 | 75 | 615 | 549 |
| 90.0210 | TVTFVTEQQQQMFLG | 12940 | 15 | HPV | E2 | 322 | 1950 | 41 | 381 | 639 | 11,578 |
| 1601.38 | STWHWTGCNKNTGIL | 12941 | 15 | HPV | E2 | 322 | — | — | — | — | 16,674 |
| 1601.18 | AGNEKTGILTVTYHS | 12942 | 15 | HPV | E2 | 325 | — | — | 3991 | 736 | 6750 |
| 89.0187 | QQQMFLGTVKIPPTV | 12943 | 15 | HPV | E2 | 330 | 743 | | 70 | 620 | 6333 |
| 89.0188 | QMFLGTVKIPPTVQI | 12944 | 15 | HPV | E2 | 332 | 292 | 160 | 132 | 65 | 616 |
| 90.0028 | LNTVKIPPTVQISTG | 12945 | 15 | HPV | E2 | 340 | 8736 | | — | 2873 | — |
| 1601.19 | EKQRTKFLNTVAIPD | 12946 | 15 | HPV | E2 | 340 | 61 | 11,763 | 4500 | 458 | 552 |
| 1601.27 | TYISTSQRDDFLNTV | 12947 | 15 | HPV | E2 | 343 | — | 152 | 16,304 | 17,242 | 5199 |
| 1601.20 | FLNTVAIPDSVQILV | 12948 | 15 | HPV | E2 | 346 | 718 | 68 | 209 | 555 | 616 |
| 1601.39 | RNTFLDVVTIPNSVQ | 12949 | 15 | HPV | E2 | 346 | 555 | 6865 | 58 | 13 | 326 |
| 89.0158 | LSQVKIPKTITVSTG | 12950 | 15 | HPV | E2 | 347 | 4498 | | 373 | 2512 | — |
| 1601.40 | FLDVVTIPNSVQISV | 12951 | 15 | HPV | E2 | 349 | 551 | 8360 | 17 | 3.8 | 1778 |
| 90.0017 | LKTVKIPNTVQVIQG | 12952 | 15 | HPV | E2 | 350 | 8175 | | — | — | 19,154 |
| 90.0020 | LSHVKIPVVYRLVWD | 12953 | 15 | HPV | E2 | 352 | 79 | 4758 | 3951 | 703 | 525 |
| 1601.28 | DFLNTVKIPNTVSVS | 12954 | 15 | HPV | E2 | 352 | 777 | — | 500 | 102 | 11,843 |
| 1601.41 | VVTIPNSVQISVGYM | 12955 | 15 | HPV | E2 | 352 | 1535 | — | 835 | 18 | 3463 |
| 89.0178 | LNTVKIPNTVSVSTG | 12956 | 15 | HPV | E2 | 354 | 51 | 65 | 824 | 263 | 3017 |
| 1601.42 | TIPNSVQISVGYMTI | 12957 | 15 | HPV | E2 | 354 | 52 | 483 | 515 | 18 | 196 |
| 85.0001 | ECVYCKQQLLRREVY | 12958 | 15 | HPV | E6 | 36 | 986 | | — | — | 5901 |
| 85.0024 | SEVYDFAFADLTVVY | 12959 | 15 | HPV | E6 | 40 | 105 | 2996 | 260 | 872 | 102 |
| 85.0138 | YDFVFADLRIVYRDG | 12960 | 15 | HPV | E6 | 43 | 1160 | 13 | 1914 | 1306 | 627 |
| 85.0054 | DFVFADLRIVYRDGN | 12961 | 15 | HPV | E6 | 44 | 6699 | | 867 | 2879 | 337 |
| 85.0041 | RIVYRDNNPYGVCIM | 12962 | 15 | HPV | E6 | 51 | 524 | 325 | 20 | 173 | 2975 |
| 85.0002 | CIVYRDGNPYAVCDK | 12963 | 15 | HPV | E6 | 58 | 8096 | | 147 | 434 | 6666 |
| 85.0022 | CDLLIRCITCQRPLC | 12964 | 15 | HPV | E6 | 97 | 12,111 | | 19,710 | 15,699 | 423 |
| 85.0031 | NEILIRCIICQRPLC | 12965 | 15 | HPV | E6 | 97 | 7945 | | 11,739 | 9234 | 7422 |
| 85.0032 | IRCIICQRPLCPQEK | 12966 | 15 | HPV | E6 | 101 | 12,912 | | 5960 | 9238 | 3572 |
| 85.0013 | IRCLRCQKPLNPAEK | 12967 | 15 | HPV | E6 | 103 | 7211 | | 6334 | 3386 | 1455 |
| 1543.22 | QERPRKLPQLCTELQ | 12968 | 15 | HPV | E6 | | — | — | 5122 | 468 | — |
| 1543.23 | RGRWTGRCMSCCRSS | 12969 | 15 | HPV | E6 | | — | — | 3813 | 2151 | 6167 |

TABLE 186-continued

| Binding affinity of HLA-DR supertype and DR3 motif-positive peptides | | | | | | | | | | | | |
|---|---|---|---|---|---|---|---|---|---|---|---|---|
| 1543.24 | LCTELQTTIHDIILE | 12970 | 15 | HPV | E6 | | | 2714 | 80 | 3662 | 3186 | 5266 |
| 1543.25 | RREVYDFAFRDLCIV | 12971 | 15 | HPV | E6 | | | — | 11,042 | 4028 | 6287 | 2669 |
| 1543.26 | RHLDKKQRFHNIRGR | 12972 | 15 | HPV | E6 | | | 556 | 5207 | 6196 | 5627 | 1552 |
| 1543.27 | QRFHNIRGRWTGRCM | 12973 | 15 | HPV | E6 | | | 36 | — | 2897 | 4110 | 4469 |
| 1543.28 | HNIRGRWTGRCMSCC | 12974 | 15 | HPV | E6 | | | 2449 | 3524 | 4631 | 3662 | 973 |
| 1543.29 | WTGRCMSCCRSSRTR | 12975 | 15 | HPV | E6 | | | 1889 | — | 238 | 402 | 4346 |
| 1543.30 | RCMSCCRSSRTRRET | 12976 | 15 | HPV | E6 | | | 5871 | 2591 | 536 | 540 | 216 |
| 1543.31 | MSCCRSSRTRRETQL | 12977 | 15 | HPV | E6 | | | — | 6171 | 1563 | 634 | 659 |
| 1543.32 | TNTGLYNLLIRCLRC | 12978 | 15 | HPV | E6 | | | 367 | 9439 | 1485 | 62 | 406 |
| 1543.34 | TELNTSLQDIEITCV | 12979 | 15 | HPV | E6 | | | — | — | — | 4141 | — |
| 1543.35 | EVFEFAFKDLFVVYR | 12980 | 15 | HPV | E6 | | | 2865 | 73 | 347 | 553 | 1320 |
| 1543.37 | TGRCIACWRRPRTET | 12981 | 15 | HPV | E6 | | | 3167 | 1033 | 758 | 1146 | 733 |
| 1543.39 | CQALETTIHNIELQC | 12982 | 15 | HPV | E6 | | | 9729 | 16,517 | 400 | 515 | 3797 |
| 1543.40 | FHSIAGQYRGQCNTC | 12983 | 15 | HPV | E6 | | | 107 | — | 8.6 | 3305 | 358 |
| 1543.41 | QYRGQCNTCCDQARQ | 12984 | 15 | HPV | E6 | | | 9853 | — | 285 | — | 16,060 |
| 1543.42 | TRPRTLHELCEVLEE | 12985 | 15 | HPV | E6 | | | 17,998 | — | 13,091 | 2992 | 674 |
| 1543.46 | GCWRQTSREPRESTV | 12986 | 15 | HPV | E6 | | | 2635 | 902 | 1843 | — | 2304 |
| 1543.48 | SEVYDFVFADLRIVY | 12987 | 15 | HPV | E6 | | | 412 | 5.7 | 620 | 519 | 2924 |
| 1543.54 | RVCLLFYSKVRKYRY | 12988 | 15 | HPV | E6 | | | 1938 | 71 | 299 | 320 | 233 |
| 1543.55 | HGWTGSCLGCWRQTS | 12989 | 15 | HPV | E6 | | | — | — | 204 | 7933 | 3477 |
| 1543.56 | CLGCWRQTSREPRES | 12990 | 15 | HPV | E6 | | | 5941 | 3030 | 3347 | — | — |
| 1543.57 | IMCLRFLSKISEYRH | 12991 | 15 | HPV | E6 | | | 95 | 220 | 78 | 122 | 841 |
| 1543.58 | YRHYQYSLYGKTLEE | 12992 | 15 | HPV | E6 | | | 11 | — | 4.1 | 5271 | 25 |
| 1543.59 | KERHVNANKRFHNIM | 12993 | 15 | HPV | E6 | | | 413 | 1353 | 55 | 3568 | 26 |
| 1543.60 | RFHNIMGRWTGRCSE | 12994 | 15 | HPV | E6 | | | 5.6 | 5477 | 332 | 1204 | 1836 |
| 85.0092 | DLRVVQQLLMGALTV | 12995 | 15 | HPV | E7 | 82 | | 8.4 | — | 325 | 36 | 84 |
| 85.0101 | QLLMGTCTIVCPSCA | 12996 | 15 | HPV | E7 | 82 | | 6589 | | 3040 | 800 | 3181 |
| 1543.03 | EPDRAHYNIVTFCCK | 12997 | 15 | HPV | E7 | | | — | — | 8001 | 6777 | 14,641 |
| 1543.04 | LDLQPETTDLYCYEQ | 12998 | 15 | HPV | E7 | | | — | 590 | 1904 | — | — |
| 1543.05 | GVNHQHLPARRAEPQ | 12999 | 15 | HPV | E7 | | | 276 | — | — | — | — |
| 1543.07 | SADDLRAFQQLFLNT | 13000 | 15 | HPV | E7 | | | 295 | 10,431 | 1607 | 2097 | 411 |
| 1543.10 | DYVLDLQPEATDLHC | 13001 | 15 | HPV | E7 | | | 5046 | 10,978 | 35 | 246 | 678 |
| 1543.11 | QSTQVDIRILQELLM | 13002 | 15 | HPV | E7 | | | 544 | 2711 | 4559 | 107 | 3986 |
| 1543.12 | EYVLDLYPEPTDLYC | 13003 | 15 | HPV | E7 | | | 9080 | 760 | 403 | 1294 | 5876 |
| 1543.13 | LYCYEQLSDSSDEDE | 13004 | 15 | HPV | E7 | | | 5686 | — | 1117 | 1474 | 89 |
| 1543.14 | YYIVTCCHTCNTTVR | 13005 | 15 | HPV | E7 | | | 1694 | 116 | 1434 | 187 | 168 |
| 1543.15 | LCVNSTASDLRTIQQ | 13006 | 15 | HPV | E7 | | | 1584 | 6232 | 63 | 7.7 | 490 |
| 1543.16 | LLMGTVNIVCPTCAQ | 13007 | 15 | HPV | E7 | | | 1275 | — | 1166 | 147 | 6360 |
| 1543.17 | LMGTVNIVCPTCAQQ | 13008 | 15 | HPV | E7 | | | 797 | — | 368 | 100 | 13,699 |
| 1543.18 | DGVSHAQLPARRAEP | 13009 | 15 | HPV | E7 | | | 1270 | 2476 | — | 12,217 | — |
| 1543.19 | FLSTLSFVCPWCATN | 13010 | 15 | HPV | E7 | | | 876 | — | 411 | 692 | 2797 |
| 1543.20 | EIVLHLEPQNELDPV | 13011 | 15 | HPV | E7 | | | 967 | 354 | 12,052 | 947 | 273 |
| 1543.21 | EDLRTLQQLFLSTLS | 13012 | 15 | HPV | E7 | | | 20 | 6771 | 34 | 42 | 582 |
| 1543.43 | PDGQAEQATSNYYIV | 13013 | 15 | HPV | E7 | | | — | — | 2129 | — | 5124 |
| 1543.44 | TYCHSCDSTLRLCIH | 13014 | 15 | HPV | E7 | | | 3717 | 1830 | 645 | 358 | 4617 |
| 1543.45 | CIHSTATDLRTLQQM | 13015 | 15 | HPV | E7 | | | 448 | 213 | 14 | 5.7 | 370 |
| 1543.51 | EYILDLHPEPTDLFC | 13016 | 15 | HPV | E7 | | | 189 | 615 | 186 | 428 | 1139 |
| 1543.52 | TCGTTVRLCINSTTT | 13017 | 15 | HPV | E7 | | | 16,870 | — | 711 | 100 | 1938 |
| 1543.53 | LMGTCTIVCPSCAQQ | 13018 | 15 | HPV | E7 | | | 1245 | — | 154 | 132 | 1927 |
| 9014.0015 | NASLLIQNSIQNDTG | 13019 | 15 | Human | CEA | 104 | A | 100 | | | | |
| 9014.0071 | QNFIQNDTGFYTLHV | 13020 | 15 | Human | CEA | 110 | A | 677 | | | | |

TABLE 186-continued

Binding affinity of HLA-DR supertype and DR3 motif-positive peptides

| | | | | | | | | | | | | |
|---|---|---|---|---|---|---|---|---|---|---|---|---|
| 9014.0076 | QNWIQNDTGFYILHV | 13021 | 15 | Human | CEA | 110 | A | 894 | | | | |
| 9014.0077 | QNYIQNDTGFYTLHV | 13022 | 15 | Human | CEA | 110 | A | 454 | | | | |
| 9014.0085 | QNIIQNDVGFYTLIHV | 13023 | 15 | Human | CEA | 110 | A | 973 | | | | |
| 9014.0037 | KPSFSSNNSKPVEDK | 13024 | 15 | Human | CEA | 146 | A | 22 | | | | |
| 9014.0040 | KPSLSSNNSKPVEDK | 13025 | 15 | Human | CEA | 146 | A | 364 | | | | |
| 9014.0041 | KPSVSSNNSKPVEDK | 13026 | 15 | Human | CEA | 146 | A | 946 | | | | |
| 9014.0042 | KPSWSSNNSKPVEDK | 13027 | 15 | Human | CEA | 146 | A | 29 | | | | |
| 9014.0043 | KPSYSSNNSKPVEDK | 13028 | 15 | Human | CEA | 146 | A | 39 | | | | |
| 9014.0044 | KPSISSNNAKPVEDK | 13029 | 15 | Human | CEA | 146 | A | 101 | | | | |
| 58.0015 | LWWVNNESLPVSPRL | 13030 | 15 | Human | CEA | 177 | A | | 315 | | | |
| 9014.0054 | RTTFKTITVSAELPK | 13031 | 15 | Human | CEA | 488 | A | 55 | | | | |
| 9014.0058 | RTTLKTITVSAELPK | 13032 | 15 | Human | CEA | 488 | A | 308 | | | | |
| 9014.0059 | RTTWKTITVSAELPK | 13033 | 15 | Human | CEA | 488 | A | 733 | | | | |
| 9014.0060 | RTTYKTITVSAELPK | 13034 | 15 | Human | CEA | 488 | A | 306 | | | | |
| 9014.0065 | RTTVKTITLSAELPK | 13035 | 15 | Human | CEA | 488 | A | 721 | | | | |
| 9014.0088 | GTDFKLRLPASPETH | 13036 | 15 | Human | Her2/neu | 28 | A | 533 | | | | |
| 9014.0090 | GTDIKLRLPASPETH | 13037 | 15 | Human | Her2/neu | 28 | A | 979 | | | | |
| 9014.0094 | GTDWKLRLPASPETH | 13038 | 15 | Human | Her2/neu | 28 | A | 799 | | | | |
| 9014.0095 | GTDYKLRLPASPETH | 13039 | 15 | Human | Her2/neu | 28 | A | 594 | | | | |
| 9014.0096 | GTDMKLRLAASPETH | 13040 | 15 | Human | Her2/neu | 28 | A | 22 | | | | |
| 9014.0097 | GTDMKLRLFASPETH | 13041 | 15 | Human | Her2/neu | 28 | A | 170 | | | | |
| 9014.0098 | GTDMKLRLHASPETH | 13042 | 15 | Human | Her2/neu | 28 | A | 823 | | | | |
| 9014.0099 | GTDMKLRLIASPETH | 13043 | 15 | Human | Her2/neu | 28 | A | 18 | | | | |
| 9014.0100 | GTDMKLRLLASPETH | 13044 | 15 | Human | Her2/neu | 28 | A | 13 | | | | |
| 9014.0101 | GTDMKLRLNASPETH | 13045 | 15 | Human | Her2/neu | 28 | A | 225 | | | | |
| 9014.0102 | GTDMKLRLSASPETH | 13046 | 15 | Human | Her2/neu | 28 | A | 65 | | | | |
| 9014.0103 | GTDMKLRLTASPETH | 13047 | 15 | Human | Her2/neu | 28 | A | 45 | | | | |
| 9014.0104 | GTDMKLRLVASPETH | 13048 | 15 | Human | Her2/neu | 28 | A | 17 | | | | |
| 9014.0115 | DMKLRLAASPETHLD | 13049 | 15 | Human | Her2/neu | 30 | A | 47 | | | | |
| 9014.0116 | DMKLRLFASPETHLD | 13050 | 15 | Human | Her2/neu | 30 | A | 292 | | | | |
| 9014.0118 | DMKLRLIASPETHLD | 13051 | 15 | Human | Her2/neu | 30 | A | 12 | | | | |
| 9014.0119 | DMKLRLLASPETHLD | 13052 | 15 | Human | Her2/neu | 30 | A | 12 | | | | |
| 9014.0120 | DMKLRLNASPETHLD | 13053 | 15 | Human | Her2/neu | 30 | A | 902 | | | | |
| 9014.0121 | DMKLRLSASPETHLD | 13054 | 15 | Human | Her2/neu | 30 | A | 823 | | | | |
| 9014.0123 | DMKLRLVASPETHLD | 13055 | 15 | Human | Her2/neu | 30 | A | 28 | | | | |
| 9014.0131 | DMKYRLPASPETHLD | 13056 | 15 | Human | Her2/neu | 30 | A | 776 | | | | |
| 9014.0135 | DMKLRLPAIPETHLD | 13057 | 15 | Human | Her2/neu | 30 | A | 764 | | | | |
| 1533.07 | KIFGSLAFLPESFDGDPA | 13058 | 18 | Human | Her2/neu | 369 | | 597 | — | 1195 | 759 | 37 |
| 9014.0230 | KAFGSLAFLPESFDGDPA | 13059 | 18 | Human | Her2/neu | 369 | A | 365 | | | | |
| 9014.0231 | KFFGSLAFLPESFDGDPA | 13060 | 18 | Human | Her2/neu | 369 | A | 225 | | | | |
| 9014.0232 | KHFGSLAFLPESFDGDPA | 13061 | 18 | Human | Her2/neu | 369 | A | 631 | | | | |
| 9014.0233 | KKFGSLAFLPESFDGDPA | 13062 | 18 | Human | Her2/neu | 369 | A | 288 | | | | |
| 9014.0234 | KLFGSLAFLPESFDGDPA | 13063 | 18 | Human | Her2/neu | 369 | A | 795 | | | | |
| 9014.0235 | KVFGSLAFLPESFDGDPA | 13064 | 18 | Human | Her2/neu | 369 | A | 672 | | | | |
| 9014.0236 | KWFGSLAFLPESFDGDPA | 13065 | 18 | Human | Her2/neu | 369 | A | 447 | | | | |
| 9014.0237 | KYFGSLAFLPESFDGDPA | 13066 | 18 | Human | Her2/neu | 369 | A | 949 | | | | |
| 9014.0240 | KIFGSLIFLPESFDGDPA | 13067 | 18 | Human | Her2/neu | 369 | A | 731 | | | | |
| 9014.0241 | KIFGSLLFLPESFDGDPA | 13068 | 18 | Human | Her2/neu | 369 | A | 433 | | | | |
| 9014.0242 | KIFGSLNFLPESFDGDPA | 13069 | 18 | Human | Her2/neu | 369 | A | 225 | | | | |
| 9014.0243 | KIFGSLSFLPESFDGDPA | 13070 | 18 | Human | Her2/neu | 369 | A | 244 | | | | |
| 9014.0244 | KIFGSLTFLPESFDGDPA | 13071 | 18 | Human | Her2/neu | 369 | A | 233 | | | | |

TABLE 186-continued

Binding affinity of HLA-DR supertype and DR3 motif-positive peptides

| | | | | | | | | | | | |
|---|---|---|---|---|---|---|---|---|---|---|---|
| 9014.0245 | KIFGSLVFLPESFDGDPA | 13072 | 18 | Human | Her2/neu | 369 | A | 298 | | | |
| 9014.0246 | KIFGSLAALPESFDGDPA | 13073 | 18 | Human | Her2/neu | 369 | A | 27 | | | |
| 9014.0247 | KIFGSLAHLPESFDGDPA | 13074 | 18 | Human | Her2/neu | 369 | A | 950 | | | |
| 9014.0248 | KIFGSLAILPESFDGDPA | 13075 | 18 | Human | Her2/neu | 369 | A | 382 | | | |
| 9014.0250 | KIFGSLALLPESFDGDPA | 13076 | 18 | Human | Her2/neu | 369 | A | 202 | | | |
| 9014.0251 | KIFGSLAVLPESFDGDPA | 13077 | 18 | Human | Her2/neu | 369 | A | 229 | | | |
| 9014.0252 | KIFGSLAWLPESFDGDPA | 13078 | 18 | Human | Her2/neu | 369 | A | 120 | | | |
| 9014.0253 | KIFGSLAYLPESFDGDPA | 13079 | 18 | Human | Her2/neu | 369 | A | 636 | | | |
| 9014,0255 | KIFGSLAFLPESHDGDPA | 13080 | 18 | Human | Her2/neu | 369 | A | 813 | | | |
| 9014.0257 | KIFGSLAFLPESLDGDPA | 13081 | 18 | Human | Her2/neu | 369 | A | 891 | | | |
| 1385.01 | QIQVFETLEET | 13082 | 11 | Human | Her2/neu | 396 | | — | — | — | 663 |
| 9014.0141 | ETEAVEPLTPSGAMP | 13083 | 15 | Human | Her2/neu | 693 | A | 51 | | | |
| 9014.0142 | ETEFVEPLTPSGAMP | 13084 | 15 | Human | Her2/neu | 693 | A | 25 | | | |
| 9014.0143 | ETEHVEPLTPSGAMP | 13085 | 15 | Human | Her2/neu | 693 | A | 62 | | | |
| 9014.0144 | ETEIVEPLTPSGAMP | 13086 | 15 | Human | Her2/neu | 693 | A | 481 | | | |
| 9014.0145 | ETEKVEPLTPSGAMP | 13087 | 15 | Human | Her2/neu | 693 | A | 21 | | | |
| 9014.0146 | ETEVVEPLTPSGAMP | 13088 | 15 | Human | Her2/neu | 693 | A | 40 | | | |
| 9014.0147 | ETEWVEPLTPSGAMP | 13089 | 15 | Human | Her2/neu | 693 | A | 24 | | | |
| 9014.0148 | ETEYVEPLTPSGAMP | 13090 | 15 | Human | Her2/neu | 693 | A | 23 | | | |
| 9014.0149 | ETELVEPLAPSGAMP | 13091 | 15 | Human | Her2/neu | 693 | A | 45 | | | |
| 9014.0150 | ETELVEPLFPSGAMP | 13092 | 15 | Human | Her2/neu | 693 | A | 304 | | | |
| 9014.0151 | ETELVEPLHPSGAMP | 13093 | 15 | Human | Her2/neu | 693 | A | 31 | | | |
| 9014.0152 | ETELVEPLIPSGAMP | 13094 | 15 | Human | Her2/neu | 693 | A | 55 | | | |
| 9014.0153 | ETELVEPLLPSGAMP | 13095 | 15 | Human | Her2/neu | 693 | A | 335 | | | |
| 9014.0154 | ETELVEPLNPSGAMP | 13096 | 15 | Human | Her2/neu | 693 | A | 200 | | | |
| 9014.0155 | ETELVEPLSPSGAMP | 13097 | 15 | Human | Her2/neu | 693 | A | 117 | | | |
| 9014.0156 | ETELVEPLVPSGAMP | 13098 | 15 | Human | Her2/neu | 693 | A | 85 | | | |
| 9014.0169 | KEILDEAYIMAGVGS | 13099 | 15 | Human | Her2/neu | 765 | A | 621 | | | |
| 9014.0170 | KEILDEAYLMAGVGS | 13100 | 15 | Human | Her2/neu | 765 | A | 969 | | | |
| 9014.0177 | ITDIGLARLLDIDET | 13101 | 15 | Human | Her2/neu | 861 | A | 907 | | | |
| 9014.0183 | ITDFGLARALDIDET | 13102 | 15 | Human | Her2/neu | 861 | A | 25 | | | |
| 9014.0187 | ITDFGLARNLDIDET | 13103 | 15 | Human | Her2/neu | 861 | A | 442 | | | |
| 9014.0188 | ITDFGLARSLDIDET | 13104 | 15 | Human | Her2/neu | 861 | A | 69 | | | |
| 9014.0210 | CWAIDSECRPRFREL | 13105 | 15 | Human | Her2/neu | 958 | A | 839 | | | |
| 9014.0211 | CWFIDSECRPRFREL | 13106 | 15 | Human | Her2/neu | 958 | A | 681 | | | |
| 9014.0212 | CWHIDSECRPRFREL | 13107 | 15 | Human | Her2/neu | 958 | A | 438 | | | |
| 9014.0213 | CWIIDSECRPRFREL | 13108 | 15 | Human | Her2/neu | 958 | A | 365 | | | |
| 9014.0214 | CWKIDSECRPRFREL | 13109 | 15 | Human | Her2/neu | 958 | A | 257 | | | |
| 9014.0215 | CWLIDSECRPRFREL | 13110 | 15 | Human | Her2/neu | 958 | A | 789 | | | |
| 9014.0218 | CWYIDSECRPRFREL | 13111 | 15 | Human | Her2/neu | 958 | A | 871 | | | |
| 9014.0219 | CWMIDSEARPRFREL | 13112 | 15 | Human | Her2/neu | 958 | A | 55 | | | |
| 9014.0220 | CWMIDSEFRPRFREL | 13113 | 15 | Human | Her2/neu | 958 | A | 463 | | | |
| 9014.0221 | CWMIDSEHRPRFREL | 13114 | 15 | Human | Her2/neu | 958 | A | 868 | | | |
| 9014.0222 | CWMIDSEIRPRFREL | 13115 | 15 | Human | Her2/neu | 958 | A | 630 | | | |
| 9014.0223 | CWMIDSELRPRFREL | 13116 | 15 | Human | Her2/neu | 958 | A | 433 | | | |
| 9014.0224 | CWMIDSENRPRFREL | 13117 | 15 | Human | Her2/neu | 958 | A | 391 | | | |
| 9014.0225 | CWMIDSESRPRFREL | 13118 | 15 | Human | Her2/neu | 958 | A | 459 | | | |
| 9014.0226 | CWMIDSETRPRFREL | 13119 | 15 | Human | Her2/neu | 958 | A | 371 | | | |
| 9014.0227 | CWMIDSEVRPRFREL | 13120 | 15 | Human | Her2/neu | 958 | A | 753 | | | |
| 68.0001 | MWDLVLSIALSVGCT | 13121 | 15 | Human | Kallikrein | 1 | | 205 | | 1846 | |
| 68.0002 | DLVLSIALSVGCTGA | 13122 | 15 | Human | Kallikrein2 | 3 | | 1197 | | 13,038 | |

TABLE 186-continued

Binding affinity of HLA-DR supertype and DR3 motif-positive peptides

| | | | | | | | | | |
|---|---|---|---|---|---|---|---|---|---|
| 68.0003 | HPQWVLTAAHCLKKN | 13123 | 15 | Human | Kallikrein2 | 56 | 22 | 1103 | 875 |
| 68.0004 | QWVLTAAHCLKKNSQ | 13124 | 15 | Human | Kallikrein2 | 58 | 895 | | — |
| 68.0005 | GQRVPVSHSFPHPLY | 13125 | 15 | Human | Kallikrein2 | 87 | 1563 | | — |
| 68.0006 | RVPVSHSFPHPLYNM | 13126 | 15 | Human | Kallikrein2 | 89 | 67 | | — |
| 68.0007 | PHPLYNMSLLKHQSL | 13127 | 15 | Human | Kallikrein2 | 97 | 19,079 | | 819 |
| 68.0008 | HPLYNMSLLKHQSLR | 13128 | 15 | Human | Kallikrein2 | 98 | 232 | 13,007 | 499 |
| 68.0009 | NMSLLKHQSLRPDED | 13129 | 15 | Human | Kallikrein2 | 102 | 3131 | | — |
| 68.0010 | SHDLMLLRLSEPAKI | 13130 | 15 | Human | Kallikrein2 | 118 | 56 | 2396 | 2244 |
| 68.0011 | HDLMLLRLSEPAKIT | 13131 | 15 | Human | Kallikrein2 | 119 | 16 | 1406 | 3063 |
| 68.0015 | PEEFLRPRSLQCVSL | 13132 | 15 | Human | Kallikrein2 | 162 | 2001 | | — |
| 68.0016 | PRSLQCVSLHLLSND | 13133 | 15 | Human | Kallikrein2 | 168 | 1111 | | 16,000 |
| 68.0140 | LHLLSNDMCARAYSE | 13134 | 15 | Human | Kallikrein2 | 176 | 2104 | 938 | 4277 |
| 68.0017 | NGVLQGITSWGPEPC | 13135 | 15 | Human | Kallikrein2 | 220 | 1093 | 8433 | |
| 68.0018 | KPAVYTKVVHYRKWI | 13136 | 15 | Human | Kallikrein2 | 239 | 5000 | 1433 | |
| 58.0114 | VGNWQYFFPVIFSKA | 13137 | 15 | Human | MAGE3 | 140 | 37 | 4.1 | |
| F160.17 | LVEVTLGEVPAAESPD | 13138 | 16 | Human | MAGE3/6 | 45 | | 4020 | 976 |
| 68.0019 | AAPLLLARAASLSLG | 13139 | 15 | Human | PAP | 3 | 6.8 | — | 139 |
| 68.0020 | APLLLARAASLSLGF | 13140 | 15 | Human | PAP | 4 | 8.4 | — | 202 |
| 68.0021 | PLLLARAASLSLGFL | 13141 | 15 | Human | PAP | 5 | 10 | — | 521 |
| 68.0022 | SLSLGFLFLLFFWLD | 13142 | 15 | Human | PAP | 13 | 11,417 | | 4711 |
| 68.0023 | LLFFWLDRSVLAKEL | 13143 | 15 | Human | PAP | 21 | 2.9 | 6.3 | 2.6 |
| 68.0024 | DRSVLAKELKFVTLV | 13144 | 15 | Human | PAP | 27 | 705 | | 569 |
| 68.0025 | AKELKFVTLVFRHGD | 13145 | 15 | Human | PAP | 32 | 787 | — | 783 |
| 68.0026 | RSPIDTFPTDPIKES | 13146 | 15 | Human | PAP | 47 | — | | 13,095 |
| 68.0028 | FGQLTQLGMEQHYEL | 13147 | 15 | Human | PAP | 67 | 2259 | | 3210 |
| 68.0030 | DRTLMSAMTNLAALF | 13148 | 15 | Human | PAP | 110 | 97 | — | 13 |
| 68.0031 | MSAMTNLAALFPPEG | 13149 | 15 | Human | PAP | 114 | 1757 | | 700 |
| 68.0032 | MTNLAALFPPEGVSI | 13150 | 15 | Human | PAP | 117 | 24 | | — |
| 68.0033 | PEGVSIWNPILLWQP | 13151 | 15 | Human | PAP | 126 | 111 | | 1778 |
| 68.0034 | GVSIWNPILLWQPIP | 13152 | 15 | Human | PAP | 128 | 44 | — | 10,328 |
| 68.0035 | WNPILLWQPIPVHTV | 13153 | 15 | Human | PAP | 132 | 208 | — | 695 |
| 68.0036 | NPILLWQPIPVHTVP | 13154 | 15 | Human | PAP | 133 | 31 | — | 206 |
| 68.0037 | PILLWQPIPVHTVPL | 13155 | 15 | Human | PAP | 134 | 44 | — | 258 |
| 68.0038 | ILLWQPIPVHTVPLS | 13156 | 15 | Human | PAP | 135 | 45 | — | 170 |
| 68.0039 | WQPIPVHTVPLSEDQ | 13157 | 15 | Human | PAP | 138 | 6386 | | — |
| 68.0147 | TVPLSEDQLLYLPFR | 13158 | 15 | Human | PAP | 145 | 4012 | 332 | 10,755 |
| 68.0040 | LSGLHGQDLFGIWSK | 13159 | 15 | Human | PAP | 194 | 148 | | — |
| 68.0041 | YDPLYCESVHNFTLP | 13160 | 15 | Human | PAP | 210 | 1597 | 16,625 | 8889 |
| 68.0042 | LPSWATEDTMTKLRE | 13161 | 15 | Human | PAP | 223 | — | | 973 |
| 68.0043 | LRELSELSLLSLYGI | 13162 | 15 | Human | PAP | 235 | 655 | | 371 |
| 68.0044 | LSELSLLSLYGIHKQ | 13163 | 15 | Human | PAP | 238 | 482 | — | 1549 |
| 68.0045 | LSLLSLYGIHKQKEK | 13164 | 15 | Human | PAP | 241 | 656 | — | 4444 |
| 68.0046 | KSRLQGGVLVNEILN | 13165 | 15 | Human | PAP | 255 | 362 | | — |
| 68.0047 | GGVLVNEILNHMKRA | 13166 | 15 | Human | PAP | 260 | 2165 | 700 | 359 |
| 68.0048 | IPSYKKLIMYSAHDT | 13167 | 15 | Human | PAP | 277 | 9.9 | 9728 | 510 |
| 68.0049 | YKKLIMYSAHDTTVS | 13168 | 15 | Human | PAP | 280 | 17 | — | 207 |
| 68.0050 | LIMYSAHDTTVSGLQ | 13169 | 15 | Human | PAP | 283 | 4496 | | 24 |
| 68.0051 | DTTVSGLQMALDVYN | 13170 | 15 | Human | PAP | 290 | 171 | | 4424 |
| 68.0052 | ALDVYNGLLPPYASC | 13171 | 15 | Human | PAP | 299 | 18 | | 485 |
| 68.0053 | LDVYNGLLPPYASCH | 13172 | 15 | Human | PAP | 300 | 15 | | 348 |
| 68.0054 | YNGLLPPYASCHLTE | 13173 | 15 | Human | PAP | 303 | 42 | | 6189 |

TABLE 186-continued

Binding affinity of HLA-DR supertype and DR3 motif-positive peptides

| | | | | | | | | | | |
|---|---|---|---|---|---|---|---|---|---|---|
| 68.0153 | LTELYFEKGEYFVEM | 13174 | 15 | Human | PAP | 315 | 2249 | 592 | 8051 | |
| 68.0056 | FAELVGPVIPQDWST | 13175 | 15 | Human | PAP | 356 | 12 | | 4690 | |
| 68.0156 | GPVIPQDWSTECMTT | 13176 | 15 | Human | PAP | 361 | | — | | |
| K-09 | FLYGALLLAEGFYTTGAVRQ | 13177 | 20 | Human | PLP | 81 | | | | |
| F025.05 | QKGRGYRGQHQAHSLERVCH | 13178 | 20 | Human | PLP | 121 | | — | 88 | |
| K-18 | SAVPVYIYFNTWTTCQSIAF | 13179 | 20 | Human | PLP | 171 | | | | |
| F025.03 | WTTCQSIAFPSKTSASIGSL | 13180 | 20 | Human | PLP | 181 | | 17,308 | 22 | 2549 |
| F025.08 | AATYNFAVLKLMGRGTKF | 13181 | 18 | Human | PLP | 260 | | — | 533 | |
| 68.0058 | TLSVTWIGAAPLILS | 13182 | 15 | Human | PSA | 5 | 3.1 | — | 7273 | |
| 68.0059 | SVTWIGAAPLILSRI | 13183 | 15 | Human | PSA | 7 | 4.1 | — | 3152 | |
| 68.0060 | VTWIGAAPLILSRIV | 13184 | 15 | Human | PSA | 8 | 8.1 | — | 8000 | |
| 68.0061 | SQPWQVLVASRGRAV | 13185 | 15 | Human | PSA | 31 | 66 | — | 7628 | |
| 68.0062 | GRAVCGGVLVHPQWV | 13186 | 15 | Human | PSA | 42 | 386 | | — | |
| 68.0063 | GVLVHPQWVLTAAHC | 13187 | 15 | Human | PSA | 48 | 87 | — | 67 | |
| 68.0064 | HPQWVLTAAHCIRNK | 13188 | 15 | Human | PSA | 52 | 13 | 3632 | 1621 | |
| 68.0065 | QWVLTAAHCIRNKSV | 13189 | 15 | Human | PSA | 54 | 50 | | 19,403 | |
| 68.0066 | AHCIRNKSVILLGRH | 13190 | 15 | Human | PSA | 60 | 578 | — | 69 | |
| 68.0067 | SVILLGRHSLFHPED | 13191 | 15 | Human | PSA | 67 | 717 | 1400 | 12,649 | |
| 68.0068 | VILLGRHSLFHPEDT | 13192 | 15 | Human | PSA | 68 | 273 | 8744 | 8208 | |
| 68.0158 | HSLFHPEDTGQVFQV | 13193 | 15 | Human | PSA | 74 | | — | | |
| 68.0069 | GQVFQVSHSFPHPLY | 13194 | 15 | Human | PSA | 83 | 288 | — | 8.2 | |
| 68.0070 | VFQVSHSFPHPLYDM | 13195 | 15 | Human | PSA | 85 | 16 | — | 25 | |
| 68.0071 | PHPLYDMSLLKNRFL | 13196 | 15 | Human | PSA | 93 | 1315 | | — | |
| 68.0072 | SHDLMLLRLSEPAEL | 13197 | 15 | Human | PSA | 114 | 532 | 6215 | 4051 | |
| 68.0073 | HDLMLLRLSEPAELT | 13198 | 15 | Human | PSA | 115 | 62 | 2867 | 6193 | |
| 68.0074 | TDAVKVMDLPTQEPA | 13199 | 15 | Human | PSA | 129 | — | | — | |
| 68.0077 | LHVISNDVCAQVHPQ | 13200 | 15 | Human | PSA | 172 | 789 | 8318 | 790 | |
| 68.0078 | CAQVHPQKVTKFMLC | 13201 | 15 | Human | PSA | 180 | 10,206 | | 2566 | |
| 68.0079 | GGPLVCNGVLQGITS | 13202 | 15 | Human | PSA | 210 | 3353 | | 68 | |
| 68.0080 | GPLVCNGVLQGITSW | 13203 | 15 | Human | PSA | 211 | 1724 | | 30 | |
| 68.0081 | NGVLQGITSWGSEPC | 13204 | 15 | Human | PSA | 216 | 945 | — | 560 | |
| 68.0082 | RPSLYTKVVHYRKWI | 13205 | 15 | Human | PSA | 235 | 6041 | — | 339 | |
| 68.0083 | PRWLCAGALVLAGGF | 13206 | 15 | Human | PSM | 18 | 46 | | — | |
| 68.0084 | LGFLFGWFIKSSNEA | 13207 | 15 | Human | PSM | 35 | 10 | — | 1338 | |
| 68.0085 | LDELKAENIKKFLYN | 13208 | 15 | Human | PSM | 62 | 1136 | 1370 | 4842 | |
| 68.0086 | IKKFLYNFTQIPHLA | 13209 | 15 | Human | PSM | 70 | 449 | 8080 | 43 | |
| 68.0087 | KFLYNFTQIPHLAGT | 13210 | 15 | Human | PSM | 72 | 340 | 13,805 | 217 | |
| 68.0088 | WKEFGLDSVELAHYD | 13211 | 15 | Human | PSM | 100 | 1139 | 85 | 96 | |
| 68.0089 | LAHYDVLLSYPNKTH | 13212 | 15 | Human | PSM | 110 | 79 | — | 1117 | |
| 68.0165 | YISIINEDGNEIFNT | 13213 | 15 | Human | PSM | 127 | 498 | 397 | 624 | |
| 68.0166 | ISIINEDGNEIFNTS | 13214 | 15 | Human | PSM | 128 | 507 | 559 | — | |
| 68.0090 | GNEIFNTSLFEPPPP | 13215 | 15 | Human | PSM | 135 | — | | — | |
| 68.0167 | EDFFKLERDMKINCS | 13216 | 15 | Human | PSM | 183 | 2710 | 468 | 226 | |
| 68.0168 | FFKLERDMKINCSGK | 13217 | 15 | Human | PSM | 185 | 4419 | 121 | 483 | |
| 68.0096 | GKVFRGNKVKNAQLA | 13218 | 15 | Human | PSM | 206 | 612 | | 1087 | |
| 68.0097 | GNKVKNAQLAGAKGV | 13219 | 15 | Human | PSM | 211 | 677 | | 13,333 | |
| 68.0170 | GVILYSDPADYFAPG | 13220 | 15 | Human | PSM | 224 | 1566 | 17 | 7508 | |
| 68.0100 | EYAYRRGIAEAVGLP | 13221 | 15 | Human | PSM | 276 | 5.1 | | 213 | |
| 68.0101 | AEAVGLPSIPVHPIG | 13222 | 15 | Human | PSM | 284 | 5.4 | | 9923 | |
| 68.0102 | AVGLPSIPVHPIGYY | 13223 | 15 | Human | PSM | 286 | 3.6 | | 4193 | |
| 68.0103 | IGYYDAQKLLEKMGG | 13224 | 15 | Human | PSM | 297 | 1923 | | 12,649 | |

TABLE 186-continued

Binding affinity of HLA-DR supertype and DR3 motif-positive peptides

| | | | | | | | | | | | | |
|---|---|---|---|---|---|---|---|---|---|---|---|---|
| 68.0105 | TGNFSTQKVKMHIHS | 13225 | 15 | Human | PSM | 334 | | 11,180 | | 833 | | |
| 68.0107 | TRIYNVIGTLRGAVE | 13226 | 15 | Human | PSM | 353 | | 14 | — | 6.3 | | |
| 68.0173 | GAAVVHEIVRSFGTL | 13227 | 15 | Human | PSM | 391 | | | 12,409 | | | |
| 68.0176 | NSRLLQERGVAYINA | 13228 | 15 | Human | PSM | 438 | | 614 | 318 | 5089 | | |
| 68.0109 | ERGVAYINADSSIEG | 13229 | 15 | Human | PSM | 444 | | 2440 | | 6761 | | |
| 68.0110 | GVAYINADSSIEGNY | 13230 | 15 | Human | PSM | 446 | | 1054 | | 146 | | |
| 68.0177 | VAYINADSSIEGNYT | 13231 | 15 | Human | PSM | 447 | | 4716 | 531 | 411 | | |
| 68.0111 | DSSIEGNYTLRVDCT | 13232 | 15 | Human | PSM | 453 | | 16,667 | | 3360 | | |
| 68.0112 | NYTLRVDCTPLMYSL | 13233 | 15 | Human | PSM | 459 | | 6804 | 45 | 9.9 | | |
| 68.0113 | CTPLMYSLVHNLTKE | 13234 | 15 | Human | PSM | 466 | | 93 | 19,437 | 245 | | |
| 68.0114 | DFEVFFQRLGIASGR | 13235 | 15 | Human | PSM | 520 | | 143 | | 221 | | |
| 68.0115 | EVFFQRLGIASGRAR | 13236 | 15 | Human | PSM | 522 | | 28 | — | 22 | | |
| 68.0116 | TNKFSGYPLYHSVYE | 13237 | 15 | Human | PSM | 543 | | 3402 | | 5521 | | |
| 68.0117 | YDPMFKYHLTVAQVR | 13238 | 15 | Human | PSM | 566 | | 9.0 | — | 19 | | |
| 68.0118 | DPMFKYHLTVAQVRG | 13239 | 15 | Human | PSM | 567 | | 5.7 | — | 9.1 | | |
| 68.0119 | MFKYHLTVAQVRGGM | 13240 | 15 | Human | PSM | 569 | | 16 | — | 18 | | |
| 68.0120 | KYHLTVAQVRGGMVF | 13241 | 15 | Human | PSM | 571 | | 137 | — | 806 | | |
| 68.0121 | VAQVRGGMVFELANS | 13242 | 15 | Human | PSM | 576 | | 228 | | 662 | | |
| 68.0122 | RGGMVFELANSIVLP | 13243 | 15 | Human | PSM | 580 | | 10 | — | 229 | | |
| 68.0123 | GMVFELANSIVLPFD | 13244 | 15 | Human | PSM | 582 | | 15 | 4604 | 230 | | |
| 68.0124 | VFELANSIVLPFDCR | 13245 | 15 | Human | PSM | 584 | | 19 | 667 | 999 | | |
| 68.0125 | ADKIYSISMKHPQEM | 13246 | 15 | Human | PSM | 608 | | — | | 5310 | | |
| 68.0126 | IYSISMKHPQEMKTY | 13247 | 15 | Human | PSM | 611 | | 8452 | | 16,000 | | |
| 68.0127 | PQEMKTYSVSFDSLF | 13248 | 15 | Human | PSM | 619 | | 15,143 | | 3024 | | |
| 68.0128 | TYSVSFDSLFSAVKN | 13249 | 15 | Human | PSM | 624 | | 219 | 101 | 73 | | |
| 68.0130 | VLRMMNDQLMFLERA | 13250 | 15 | Human | PSM | 660 | | 118 | 183 | 29 | | |
| 68.0131 | LRMMNDQLMFLERAF | 13251 | 15 | Human | PSM | 661 | | 2704 | | 392 | | |
| 68.0181 | DQLMFLERAFIDPLG | 13252 | 15 | Human | PSM | 666 | | | — | | | |
| 68.0133 | RHVIYAPSSHNKYAG | 13253 | 15 | Human | PSM | 688 | | 2174 | | 481 | | |
| 68.0134 | RQIYVAAFTVQAAAE | 13254 | 15 | Human | PSM | 730 | | 3.7 | — | 1.2 | | |
| 68.0135 | QIYVAAFTVQAAAET | 13255 | 15 | Human | PSM | 731 | | 1.6 | — | 1.6 | | |
| 68.0136 | VAAFTVQAAAETLSE | 13256 | 15 | Human | PSM | 734 | | 14 | — | 58 | | |
| Peptide | Sequence | SEQ ID NO | AA | Organism | Protein | Position | Analog | DRB1 *0701 | DRB1 *0802 | DRB1 *0901 | DRB1 *1101 | DRB1 *1201 |
| F116.01 | MDIDPYKEFGATVELLSFLPSDFFP | 12669 | 25 | HBV | core | 1 | | 6609 | | | | |
| F209.01 | LETTMRSPVFTDNSSPPVVP | 12670 | 20 | HCV | | | | 893 | — | 2371 | — | 7032 |
| F209.02 | AYAAQGYKVLVLNPSVAA | 12671 | 18 | HCV | | | | 192 | 18,665 | 2568 | 37 | 278 |
| F209.03 | TPAETTVRLRAYMNTPGLPV | 12672 | 20 | HCV | | | | 20 | 818 | 706 | 277 | 1565 |
| F209.04 | ENLPYLVAYQATVCARAQAP | 12673 | 20 | HCV | | | | 267 | 2502 | 2608 | 111 | 636 |
| F209.05 | GIQYLAGLSTLPGNPAIA | 12674 | 18 | HCV | | | | 2170 | 200 | 2137 | 9.5 | 235 |
| F209.06 | KGGRKPARLIVFPDLGVRVC | 12675 | 20 | HCV | | | | 458 | 3515 | 9058 | 3311 | 2593 |
| F209.07 | CGKYLFNWAVRTKLKLTPIA | 12676 | 20 | HCV | | | | 131 | 457 | 4909 | 138 | 876 |
| 90.0062 | NGWFYVEAVIDRQTG | 12677 | 15 | HPV | E1 | 15 | | 157 | 3990 | 453 | 3347 | 4041 |
| 90.0075 | TGWFEVEAVIERRTG | 12678 | 15 | HPV | E1 | 15 | | 4933 | 9321 | — | 10,818 | — |
| 90.0029 | NGWFYVEAVVEKKTG | 12679 | 15 | HPV | E1 | 16 | | 307 | 6398 | 955 | 2738 | 13,285 |
| 90.0126 | EDEIDTDLDGFIDDS | 12680 | 15 | HPV | E1 | 40 | | 268 | 2420 | 215 | — | 138 |
| 90.0077 | LLEFIDDSMENSIQA | 12681 | 15 | HPV | E1 | 47 | | — | — | 6676 | 7621 | — |
| 89.0078 | VDFIDTQLSICEQAE | 12682 | 15 | HPV | E1 | 48 | | 426 | 7428 | 5995 | 3922 | 2018 |
| 90.0031 | VDFIVNDNDYLTQAE | 12683 | 15 | HPV | E1 | 49 | | 7281 | — | — | — | 17,143 |

TABLE 186-continued

Binding affinity of HLA-DR supertype and DR3 motif-positive peptides

| | | | | | | | | | | | |
|---|---|---|---|---|---|---|---|---|---|---|---|
| 90.0078 | ENSIQADTEAARALF | 12684 | 15 | HPV | E1 | 56 | 5820 | — | — | — | 7437 |
| 89.0022 | QAELETAQALFHAQE | 12685 | 15 | HPV | E1 | 60 | 3011 | — | 338 | — | |
| 89.0114 | GQQLLQVQTAHADKQ | 12686 | 15 | HPV | E1 | 66 | — | — | — | 5846 | |
| 89.0115 | QQLLQVQTAHADKQT | 12687 | 15 | HPV | E1 | 67 | — | — | — | 9681 | |
| 89.0001 | HALFTAQEAKQHRDA | 12688 | 15 | HPV | E1 | 68 | — | 14,192 | — | — | |
| 90.0047 | AQEVHNDAQVLHVLK | 12689 | 15 | HPV | E1 | 72 | 7796 | 9340 | 10,208 | 10,741 | — |
| 89.0093 | EDDLHAVSAVKRKFT | 12690 | 15 | HPV | E1 | 76 | 52 | 258 | 1029 | 2796 | |
| 90.0048 | GERLEVDTELSPRLQ | 12691 | 15 | HPV | E1 | 100 | — | — | — | — | — |
| 90.0129 | QQTVCREGVKRRLIL | 12692 | 15 | HPV | E1 | 100 | — | 3737 | 3917 | 1023 | 12,680 |
| 90.0064 | LKAICIENNSKTAKR | 12693 | 15 | HPV | E1 | 109 | 6355 | 10,751 | — | 1923 | 4582 |
| 90.0032 | LKAICIEKQSRAAKR | 12694 | 15 | HPV | E1 | 110 | 1813 | 273 | 13,352 | 545 | 11,750 |
| 89.0039 | NTEVETQQMVQVEEQ | 12695 | 15 | HPV | E1 | 135 | — | 12,431 | — | — | |
| 89.0059 | NTEVETQQMVQQVES | 12696 | 15 | HPV | E1 | 135 | — | — | — | — | |
| 89.0002 | NTEVETQQMLQVEGR | 12697 | 15 | HPV | E1 | 136 | 1850 | — | — | — | |
| 89.0040 | MVQVEEQQTTLSCNG | 12698 | 15 | HPV | E1 | 143 | — | — | — | — | |
| 89.0041 | LYGVSFMELIRPFQS | 12699 | 15 | HPV | E1 | 194 | 444 | 175 | 64 | 39 | 966 |
| 89.0003 | LNVLKTSNAKAAMLA | 12700 | 15 | HPV | E1 | 195 | 20 | 1713 | 197 | 198 | 531 |
| 89.0140 | TLLYKFKEAYGVSFM | 12701 | 15 | HPV | E1 | 199 | — | — | — | — | |
| 89.0094 | TVLEKEKETYGVSFM | 12702 | 15 | HPV | E1 | 202 | 14 | 191 | 416 | 773 | 2733 |
| 89.0060 | AYGISFMELVRPFKS | 12703 | 15 | HPV | E1 | 207 | 263 | 158 | 126 | 51 | 1369 |
| 89.0095 | TYGVSFMELVRPFKS | 12704 | 15 | HPV | E1 | 210 | 7568 | — | — | 10,935 | |
| 90.0050 | MLAVFKDTYGLSFTD | 12705 | 15 | HPV | E1 | 214 | 75 | 7940 | 1569 | 2291 | 7426 |
| 89.0042 | DWCVAAFGVTGTVAE | 12706 | 15 | HPV | E1 | 215 | 349 | 3504 | 901 | 3234 | — |
| 89.0079 | DWVMAIFGVNPTVAE | 12707 | 15 | HPV | E1 | 228 | 108 | 6717 | 1624 | 1825 | 430 |
| 89.0080 | VMAIFGVNPTVAEGF | 12708 | 15 | HPV | E1 | 230 | 336 | — | 12,904 | 5602 | 446 |
| 90.0051 | VRNFKSDKTFCTDWV | 12709 | 15 | HPV | E1 | 230 | 827 | 14,687 | — | 2654 | 3455 |
| 89.0081 | MAIFGVNPTVAEGFK | 12710 | 15 | HPV | E1 | 231 | 325 | 1093 | 1557 | 41 | 1201 |
| 89.0096 | DWCIIGMGVTPSVAE | 12711 | 15 | HPV | E1 | 231 | 2644 | — | — | — | |
| 89.0097 | WCIIGMGVTPSVAEG | 12712 | 15 | HPV | E1 | 232 | 3547 | — | — | — | |
| 89.0119 | LKTIIKPHCMYYHMQ | 12713 | 15 | HPV | E1 | 238 | — | — | — | — | |
| 89.0023 | VTAIFGVNPTIAEGF | 12714 | 15 | HPV | E1 | 244 | 192 | — | 2915 | — | 6577 |
| 89.0061 | LKVLIKQHSLYTHLQ | 12715 | 15 | HPV | E1 | 244 | 451 | 57 | 313 | 43 | 33 |
| 89.0082 | FKTLIKPATLYAHIQ | 12716 | 15 | HPV | E1 | 244 | 313 | 11 | 570 | 5.5 | 84 |
| 89.0142 | LKVLIKQHSIYTHLQ | 12717 | 15 | HPV | E1 | 244 | — | — | — | — | |
| 89.0024 | TAIFGVNPTIAEGFK | 12718 | 15 | HPV | E1 | 245 | 180 | 11,054 | 4478 | 4038 | 3746 |
| 89.0083 | KTLIKPATLYAHIQC | 12719 | 15 | HPV | E1 | 245 | 308 | 231 | 1174 | 35 | 422 |
| 89.0098 | LKVLIQPYSIYAHLQ | 12720 | 15 | HPV | E1 | 247 | 26 | 4766 | 12,817 | 681 | 237 |
| 89.0043 | ACSWGMVMLMLVRFK | 12721 | 15 | HPV | E1 | 248 | — | 2901 | 10,519 | 679 | |
| 89.0044 | SWGMVMLMLVRFKCA | 12722 | 15 | HPV | E1 | 250 | — | 9987 | — | 333 | |
| 89.0025 | FKTLIQPFILYAHIQ | 12723 | 15 | HPV | E1 | 258 | 882 | 186 | 97 | 744 | 513 |
| 89.0062 | DRGIIILLLIRFRCS | 12724 | 15 | HPV | E1 | 263 | — | 85 | — | 8275 | |
| 89.0063 | RGIIILLLIRFRCSK | 12725 | 15 | HPV | E1 | 264 | 721 | 6422 | — | 1712 | 2014 |
| 89.0099 | DRGVLILLLIRFKCG | 12726 | 15 | HPV | E1 | 266 | 384 | 4729 | 14,154 | 1629 | 711 |
| 89.0004 | ACSWGMVVLLLVRYK | 12727 | 15 | HPV | E1 | 268 | 1183 | 4774 | 2001 | 1262 | |
| 89.0005 | SWGMVVLLLVRYKCG | 12728 | 15 | HPV | E1 | 270 | 3177 | — | 777 | 2111 | |
| 89.0045 | EKLLEKLLCISTNCM | 12729 | 15 | HPV | E1 | 271 | 2011 | 18,333 | 5116 | 10,741 | |
| 89.0123 | RKTIAKALSSILNVP | 12730 | 15 | HPV | E1 | 274 | — | — | — | — | |
| 89.0026 | DCKWGVLILALLRYK | 12731 | 15 | HPV | E1 | 275 | 7361 | 1800 | 1003 | 389 | |
| 89.0027 | KWGVLILALLRYKCG | 12732 | 15 | HPV | E1 | 277 | — | 1161 | 810 | 490 | 621 |
| 89.0064 | KNRLTVAKLMSNLLS | 12733 | 15 | HPV | E1 | 278 | 2.8 | 580 | 2682 | 1584 | 89 |
| 89.0065 | RLTVAKLMSNLLSIP | 12734 | 15 | HPV | E1 | 280 | 45 | 483 | 994 | 62 | 107 |

TABLE 186-continued

Binding affinity of HLA-DR supertype and DR3 motif-positive peptides

| | | | | | | | | | | |
|---|---|---|---|---|---|---|---|---|---|---|
| 89.0046 | TNCMLIQPPKLRSTA | 12735 | 15 | HPV | E1 | 282 | 1120 | 1157 | — | 1091 | |
| 89.0100 | RLTVSKLMSQLLNIP | 12736 | 15 | HPV | E1 | 283 | 4991 | — | — | — | |
| 89.0047 | CMLIQPPKLRSTAAA | 12737 | 15 | HPV | E1 | 284 | 470 | 2652 | 7535 | 982 | 3694 |
| 89.0066 | AKLMSNLLSIPETCM | 12738 | 15 | HPV | E1 | 284 | 388 | — | 9140 | 14,577 | 261 |
| 89.0101 | VSKLMSQLLNIPETH | 12739 | 15 | HPV | E1 | 286 | — | — | — | — | |
| 89.0006 | RETIEKLLSKLLCVS | 12740 | 15 | HPV | E1 | 287 | 187 | 652 | 6478 | 715 | 523 |
| 89.0067 | SNLLSIPETCMVIEP | 12741 | 15 | HPV | E1 | 288 | 194 | 16,828 | 1313 | 12,804 | 3862 |
| 89.0124 | QEQMLIQPPKIRSPA | 12742 | 15 | HPV | E1 | 289 | 7224 | — | 1472 | 18,365 | |
| 89.0007 | EKLLSKLLCVSPMCM | 12743 | 15 | HPV | E1 | 291 | 207 | 2753 | 7568 | 5826 | |
| 89.0102 | SQLLNIPETHMVIEP | 12744 | 15 | HPV | E1 | 291 | — | — | — | — | |
| 89.0028 | RLTVAKGLSTLLHVP | 12745 | 15 | HPV | E1 | 294 | 180 | 501 | 399 | 232 | 274 |
| 89.0084 | ETCMLIEPPKLRSSV | 12746 | 15 | HPV | E1 | 295 | 756 | 1347 | 5121 | 123 | 708 |
| 90.0083 | ETCMVIEPPKLRSQT | 12747 | 15 | HPV | E1 | 295 | 794 | 4298 | — | 4736 | 825 |
| 89.0103 | ETHMVIEPPKLRSAT | 12748 | 15 | HPV | E1 | 298 | — | 12,172 | — | 3257 | |
| 90.0034 | PMCMMIEPPKLRSTA | 12749 | 15 | HPV | E1 | 302 | 369 | 4328 | 11,301 | 2038 | 1322 |
| 89.0029 | ETCMLIQPPKLRSSV | 12750 | 15 | HPV | E1 | 309 | 354 | 5082 | 19,514 | 541 | 1367 |
| 89.0048 | TPEWIERQTVLQHSF | 12751 | 15 | HPV | E1 | 316 | — | 2365 | — | 1370 | |
| 89.0049 | PEWIERQTVLQHSFN | 12752 | 15 | HPV | E1 | 317 | 2868 | 707 | 4522 | 401 | 7976 |
| 89.0009 | LYWYKTGISNISEVY | 12753 | 15 | HPV | E1 | 319 | 19 | 1440 | 631 | 6282 | 4618 |
| 89.0069 | TPEWIDRLTVLQHSF | 12754 | 15 | HPV | E1 | 329 | 5211 | 275 | — | 1275 | |
| 90.0035 | ISEVYGDTPEWIQRQ | 12755 | 15 | HPV | E1 | 329 | 6873 | — | — | — | — |
| 89.0070 | PEWIDRLTVLQHSFN | 12756 | 15 | HPV | E1 | 330 | — | 3509 | 4145 | 2636 | 203 |
| 89.0050 | DTFFDLSQMVQWAYD | 12757 | 15 | HPV | E1 | 332 | 1173 | — | 99 | 12,500 | 266 |
| 89.0104 | TPEWIEQQTVLQHSF | 12758 | 15 | HPV | E1 | 332 | — | 14,106 | — | — | |
| 89.0105 | PEWIEQQTVLQHSFD | 12759 | 15 | HPV | E1 | 333 | 6207 | — | — | — | |
| 89.0010 | TPEWIQRQTVLQHSF | 12760 | 15 | HPV | E1 | 336 | 321 | 1999 | 2868 | 738 | — |
| 90.0052 | ISEVMGDTPEWIQRL | 12761 | 15 | HPV | E1 | 336 | 4024 | — | — | — | — |
| 89.0011 | PEWIQRQTVLQHSFN | 12762 | 15 | HPV | E1 | 337 | 6123 | 213 | 6184 | 261 | 4016 |
| 90.0152 | QHSFNDDIFDLSEMI | 12763 | 15 | HPV | E1 | 340 | 3280 | 7612 | 1433 | 4378 | 268 |
| 89.0030 | TPEWIQRLTIIQHGI | 12764 | 15 | HPV | E1 | 343 | 155 | 374 | 2430 | 389 | 418 |
| 89.0031 | PEWIQRLTIIQHGID | 12765 | 15 | HPV | E1 | 344 | 443 | 187 | 4511 | 596 | 527 |
| 90.0069 | DNDVMDDSEIAYKYA | 12766 | 15 | HPV | E1 | 346 | 6414 | — | — | — | 12,680 |
| 89.0106 | NSIFDFGEMVQWAYD | 12767 | 15 | HPV | E1 | 348 | 5977 | — | — | — | |
| 89.0051 | DSEIAYKYAQLADSD | 12768 | 15 | HPV | E1 | 352 | — | 624 | 5324 | 3382 | |
| 89.0130 | DSQIAFQYAQLADVD | 12769 | 15 | HPV | E1 | 359 | — | — | — | — | |
| 90.0085 | DNELTDDSDIAYYYA | 12770 | 15 | HPV | E1 | 359 | — | — | — | — | — |
| 90.0036 | QWAYDNDIVDDSEIA | 12771 | 15 | HPV | E1 | 362 | — | — | — | — | — |
| 90.0117 | DHDITDDSDIAYKYA | 12772 | 15 | HPV | E1 | 362 | — | — | 12,269 | — | — |
| 89.0071 | DSDIAYYYAQLADSN | 12773 | 15 | HPV | E1 | 365 | 4132 | 1791 | 2336 | 9140 | |
| 89.0085 | ESDMAFQYAQLADCN | 12774 | 15 | HPV | E1 | 365 | 3246 | 5919 | 1411 | 19,960 | |
| 90.0037 | DNDIVDDSEIAYKYA | 12775 | 15 | HPV | E1 | 366 | — | — | — | — | 5301 |
| 89.0072 | IAYYYAQLADSNSNA | 12776 | 15 | HPV | E1 | 368 | 6640 | 7815 | 3088 | — | |
| 89.0108 | DIAYKYAQLADVNSN | 12777 | 15 | HPV | E1 | 370 | 1019 | — | 10,608 | 12,594 | |
| 89.0012 | DSEIAYKYAQLADTN | 12778 | 15 | HPV | E1 | 372 | — | 1118 | 1927 | 3536 | |
| 90.0070 | QAKIVKDCGTMCRHY | 12779 | 15 | HPV | E1 | 378 | — | — | — | — | 8212 |
| 90.0055 | ESDMAFEYALLADSN | 12780 | 15 | HPV | E1 | 379 | 122 | 5731 | 826 | 4685 | 16,344 |
| 90.0139 | QAKYVKDCGIMCRHY | 12781 | 15 | HPV | E1 | 385 | 103 | — | — | 15,380 | 1353 |
| 90.0086 | QAKIVKDCGIMCRHY | 12782 | 15 | HPV | E1 | 391 | — | — | — | 4223 | 16,060 |
| 90.0103 | QAKYLKDCAVMCRHY | 12783 | 15 | HPV | E1 | 391 | 8168 | 11,538 | — | 2107 | 12,403 |
| 90.0038 | QAKIVKDCATMCRHY | 12784 | 15 | HPV | E1 | 398 | — | — | — | — | 16,518 |
| 89.0052 | VKFLRYQQIEFVSFL | 12785 | 15 | HPV | E1 | 423 | 4594 | 7055 | 3210 | 1098 | |

TABLE 186-continued

Binding affinity of HLA-DR supertype and DR3 motif-positive peptides

| | | | | | | | | | | | |
|---|---|---|---|---|---|---|---|---|---|---|---|
| 89.0053 | VSFLSALKLFLKGVP | 12786 | 15 | HPV | E1 | 434 | 569 | 290 | 2121 | 64 | 82 |
| 89.0013 | GGDWKQIVMFLRYQG | 12787 | 15 | HPV | E1 | 436 | 2464 | 1431 | 3636 | 198 | 725 |
| 89.0054 | LKLFLKGVPKKNCIL | 12788 | 15 | HPV | E1 | 440 | 1536 | 341 | 2012 | 306 | 1729 |
| 89.0014 | VMFLRYQGVEFMSFL | 12789 | 15 | HPV | E1 | 443 | 2542 | 13,442 | 4018 | 3238 | 1323 |
| 89.0132 | FLSYFKLFLQGTPKH | 12790 | 15 | HPV | E1 | 443 | — | — | ---- | — | |
| 89.0133 | YFKLFLQGTPKHNCL | 12791 | 15 | HPV | E1 | 446 | — | — | — | | |
| 89.0134 | FKLFLQGTPKHNCLV | 12792 | 15 | HPV | E1 | 447 | 400 | — | 2747 | 4068 | 7871 |
| 89.0055 | KNCILIHGAPNTGKS | 12793 | 15 | HPV | E1 | 450 | 7296 | — | 16,986 | 19,920 | |
| 89.0015 | VEFMSFLTALKRFLQ | 12794 | 15 | HPV | E1 | 451 | 109 | 102 | 2512 | 44 | 91 |
| 89.0073 | FKKFLKGIPKKSCML | 12795 | 15 | HPV | E1 | 453 | 2093 | 320 | 2480 | 64 | 709 |
| 89.0086 | LKEFLKGTPKKNCIL | 12796 | 15 | HPV | E1 | 453 | 5433 | 3200 | 11,938 | 5385 | |
| 89.0033 | IEFITFLGALKSFLK | 12797 | 15 | HPV | E1 | 458 | 410 | 552 | 15,250 | 142 | 410 |
| 89.0016 | LKRFLQGIPKKNCIL | 12798 | 15 | HPV | E1 | 460 | — | 3288 | 7669 | 2541 | |
| 89.0034 | ITFLGALKSFLKGTP | 12799 | 15 | HPV | E1 | 461 | 2957 | 292 | 7621 | 118 | 44 |
| 89.0056 | GKSYFGMSLISFLQG | 12800 | 15 | HPV | E1 | 462 | 284 | 6024 | 512 | 900 | |
| 89.0074 | SCMLICGPANTGKSY | 12801 | 15 | HPV | E1 | 464 | 4373 | 3758 | — | 1146 | |
| 89.0087 | NCILLYGPANTGKSY | 12802 | 15 | HPV | E1 | 464 | — | 13,503 | — | 8045 | |
| 89.0035 | LKSFLKGTPKKNCLV | 12803 | 15 | HPV | E1 | 467 | 262 | 208 | 2688 | 1047 | 3230 |
| 89.0017 | NCILLYGAANTGKSL | 12804 | 15 | HPV | E1 | 471 | — | 2691 | 1172 | 5781 | — |
| 89.0018 | ILLYGAANTGKSLFG | 12805 | 15 | HPV | E1 | 473 | 6133 | 1754 | — | 2757 | |
| 89.0075 | GKSYFGMSLIQFLKG | 12806 | 15 | HPV | E1 | 475 | 211 | 1563 | 73 | 2960 | 499 |
| 89.0146 | GKSYFGMSLIHFLKG | 12807 | 15 | HPV | E1 | 475 | — | — | — | — | |
| 89.0135 | LIKFFQGSVISFVNS | 12808 | 15 | HPV | E1 | 477 | — | 7977 | — | — | |
| 89.0136 | IKFFQGSVISFVNSQ | 12809 | 15 | HPV | E1 | 478 | — | — | — | — | |
| 89.0019 | GKSLFGMSLMKFLQG | 12810 | 15 | HPV | E1 | 482 | 16 | 704 | 148 | 1356 | 80 |
| 89.0020 | KSLFGMSLMKFLQGS | 12811 | 15 | HPV | E1 | 483 | 21 | 1260 | 310 | 535 | 944 |
| 89.0088 | FIHFLQGAIISFVNS | 12812 | 15 | HPV | E1 | 483 | 1646 | — | 867 | 5598 | |
| 89.0076 | IQFLKGCVISCVNSK | 12813 | 15 | HPV | E1 | 484 | 596 | 6780 | 1313 | 2026 | 202 |
| 89.0089 | IHFLQGAIISFVNSN | 12814 | 15 | HPV | E1 | 484 | 1023 | 1901 | 192 | 1805 | 71 |
| 89.0147 | IHFLKGCIISYVNSK | 12815 | 15 | HPV | E1 | 484 | 6493 | — | — | — | |
| 89.0036 | FIHFIQGAVISFVNS | 12816 | 15 | HPV | E1 | 497 | 147 | 3420 | 137 | 4331 | 1377 |
| 89.0037 | IHFIQGAVISFVNST | 12817 | 15 | HPV | E1 | 498 | 338 | 11,746 | 313 | — | 732 |
| 90.0087 | KIGMIDDVTPISWTY | 12818 | 15 | HPV | E1 | 510 | — | 8374 | — | — | 2722 |
| 90.0105 | KVAMLDDATHTCWTY | 12819 | 15 | HPV | E1 | 510 | 1063 | 8182 | — | 2259 | 9276 |
| 90.0040 | KIGMLDDATVPCWNY | 12820 | 15 | HPV | E1 | 517 | — | — | — | — | 12,682 |
| 89.0090 | CWTYFDNYMRNALDG | 12821 | 15 | HPV | E1 | 521 | 2910 | 3690 | — | — | |
| 89.0137 | RNLVDGNPISLDRKH | 12822 | 15 | HPV | E1 | 524 | 7384 | — | — | — | |
| 90.0059 | KVAMLDDATTTCWTY | 12823 | 15 | HPV | E1 | 524 | 4717 | — | — | — | — |
| 90.0041 | CWNYIDDNLRNALDG | 12824 | 15 | HPV | E1 | 528 | — | — | — | — | — |
| 89.0057 | LMQLKCPPLLITSNI | 12825 | 15 | HPV | E1 | 534 | 1171 | 2797 | 5075 | 4141 | |
| 89.0138 | LVQIKCPPLLITTNI | 12826 | 15 | HPV | E1 | 541 | — | — | — | — | |
| 89.0077 | LVQLKCPPLLLTSNT | 12827 | 15 | HPV | E1 | 547 | 1093 | 1428 | 11,695 | 17,610 | |
| 89.0091 | LLQLKCPPILLTSNI | 12828 | 15 | HPV | E1 | 547 | 613 | 7290 | — | — | |
| 89.0139 | PPLLITTNINPMLDA | 12829 | 15 | HPV | E1 | 547 | 7540 | 7648 | — | 7372 | |
| 89.0058 | DDRWPYLHSRLVVFT | 12830 | 15 | HPV | E1 | 553 | 68 | 1696 | 158 | 435 | 297 |
| 89.0021 | LVQLKCPPLLITSNI | 12831 | 15 | HPV | E1 | 554 | 514 | — | — | — | |
| 89.0038 | LIQLKCPPILLTTNI | 12832 | 15 | HPV | E1 | 561 | 990 | 1174 | — | — | |
| 89.0113 | DPRWPYLHSRLVVFH | 12833 | 15 | HPV | E1 | 569 | 90 | 19,831 | 5398 | 5137 | 5931 |
| 89.0092 | VTVFTFPHAFPFDKN | 12834 | 15 | HPV | E1 | 576 | 5.5 | 309 | 33 | 5330 | 131 |
| 90.0106 | PHAFPFDKNGNPVYE | 12835 | 15 | HPV | E1 | 582 | 7115 | — | 296 | — | 671 |
| 90.0144 | RLNLDNDEDKENNGD | 12836 | 15 | HPV | E1 | 606 | 865 | 4008 | 19,683 | 1601 | 4409 |

TABLE 186-continued

Binding affinity of HLA-DR supertype and DR3 motif-positive peptides

| | | | | | | | | | | | |
|---|---|---|---|---|---|---|---|---|---|---|---|
| 1601.21 | LSQRLNVCQDKILEH | 12837 | 15 | HPV | E2 | 4 | — | — | — | — | |
| 90.0160 | RLNVCQDKILTHYEN | 12838 | 15 | HPV | E2 | 7 | 7977 | 125 | 50 | 372 | 256 |
| 1601.01 | YENDSTDLRDHIDYW | 12839 | 15 | HPV | E2 | 19 | — | — | — | — | |
| 1601.29 | LDHYENDSKDINSQI | 12840 | 15 | HPV | E2 | 22 | 19,901 | — | — | — | |
| 90.0021 | HWKLIRMECAIMYTA | 12841 | 15 | HPV | E2 | 32 | 2645 | 14,143 | 2505 | 2127 | 176 |
| 90.0199 | WKLIRMECALLYTAK | 12842 | 15 | HPV | E2 | 33 | 3158 | 2701 | 4000 | 2004 | 159 |
| 90.0230 | WKAVRHENVLYYKAR | 12843 | 15 | HPV | E2 | 33 | 666 | 613 | 1183 | 2117 | 415 |
| 90.0245 | WKLIRMECAIMYTAR | 12844 | 15 | HPV | E2 | 33 | 4615 | 9174 | 4870 | 2718 | 195 |
| 1601.44 | KHIRLLECVLMYKARE | 12845 | 16 | HPV | E2 | 34 | 6704 | 1765 | 7479 | 613 | |
| 89.0179 | LIRMECALLYTAKQM | 12846 | 15 | HPV | E2 | 35 | 7472 | — | — | — | |
| 90.0022 | LIRMECAIMYTARQM | 12847 | 15 | HPV | E2 | 35 | 473 | 3057 | 4125 | 738 | 201 |
| 90.0211 | WQLIRLENAILFTAR | 12848 | 15 | HPV | E2 | 39 | 89 | 1842 | 2269 | 269 | 99 |
| 90.0002 | LIRLENAILFTAREH | 12849 | 15 | HPV | E2 | 41 | 35 | 11,742 | 2129 | 5690 | |
| 90.0010 | ITHIGHQVVPPMAVS | 12850 | 15 | HPV | E2 | 51 | 4987 | 12,247 | — | — | |
| 89.0168 | NHQVVPALSVSKAKA | 12851 | 15 | HPV | E2 | 55 | — | — | — | — | |
| 90.0011 | GHQVVPPMAVSKAKA | 12852 | 15 | HPV | E2 | 55 | 6244 | 1628 | 10,833 | 2060 | |
| 89.0169 | HQVVPALSVSKAKAL | 12853 | 15 | HPV | E2 | 56 | 4725 | — | 1623 | — | |
| 90.0012 | HQVVPPMAVSKAKAC | 12854 | 15 | HPV | E2 | 56 | 434 | 1794 | 1211 | 7008 | |
| 90.0023 | HQVVPSLVASKTKAF | 12855 | 15 | HPV | E2 | 56 | 2731 | — | — | — | |
| 89.0150 | TLAVSKNKALQAIEL | 12856 | 15 | HPV | E2 | 61 | — | — | 5219 | — | |
| 89.0170 | ALSVSKAKALQAIEL | 12857 | 15 | HPV | E2 | 61 | 3215 | — | 4328 | — | |
| 90.0013 | PMAVSKAKACQAIEL | 12858 | 15 | HPV | E2 | 61 | 317 | 179 | 1162 | 1547 | |
| 89.0159 | AYNISKSKAHKAIEL | 12859 | 15 | HPV | E2 | 65 | — | — | — | — | |
| 89.0151 | NKALQAIELQLTLET | 12860 | 15 | HPV | E2 | 67 | 1203 | 15,222 | 16,790 | 5334 | |
| 89.0171 | AKALQAIELQMMLET | 12861 | 15 | HPV | E2 | 67 | 51 | — | 84 | 2396 | 243 |
| 1601.30 | PINISKSKAHKAIEL | 12862 | 15 | HPV | E2 | 67 | 17 | 3172 | 170 | 327 | |
| 89.0181 | AFQVIELQMALETLS | 12863 | 15 | HPV | E2 | 69 | 245 | 8160 | 257 | 2141 | 3769 |
| 90.0024 | AFQVIELQMALETLN | 12864 | 15 | HPV | E2 | 69 | 2437 | 4950 | 843 | 3342 | 466 |
| 89.0182 | FQVIELQMALETLSK | 12865 | 15 | HPV | E2 | 70 | 183 | — | 751 | 2111 | |
| 90.0014 | CQAIELQLALEALNK | 12866 | 15 | HPV | E2 | 70 | — | 3593 | 1779 | 3229 | 1099 |
| 90.0018 | CSAIEVQIALESLST | 12867 | 15 | HPV | E2 | 70 | 5261 | — | 11,987 | — | |
| 90.0025 | FQVIELQMALETLNA | 12868 | 15 | HPV | E2 | 70 | 2648 | — | 1967 | 3987 | 708 |
| 89.0160 | HKAIELQMALQGLAQ | 12869 | 15 | HPV | E2 | 74 | — | — | — | 16,807 | |
| 89.0183 | ELQMALETLSKSQYS | 12870 | 15 | HPV | E2 | 74 | 3139 | 1156 | 204 | 12,302 | |
| 90.0231 | EVQIALESLSTTIYN | 12871 | 15 | HPV | E2 | 74 | 32 | — | 406 | — | 263 |
| 90.0004 | HKAIELQMALKGLAQ | 12872 | 15 | HPV | E2 | 76 | 5769 | 38 | 153 | 10 | 293 |
| 1601.22 | QMMLETLNNTEYKNE | 12873 | 15 | HPV | E2 | 76 | — | — | — | — | |
| 1601.03 | LETIYNSQYSNEKWT | 12874 | 15 | HPV | E2 | 79 | — | — | 6095 | — | |
| 90.0005 | ELQMALKGLAQSKYN | 12875 | 15 | HPV | E2 | 80 | — | 127 | 348 | 64 | 41 |
| 90.0232 | TTIYNNEEWTLRDTC | 12876 | 15 | HPV | E2 | 84 | — | — | — | 3427 | — |
| 90.0179 | QSRYKTEDWTLQDTC | 12877 | 15 | HPV | E2 | 88 | 6502 | 585 | 1970 | 2094 | 193 |
| 1601.23 | PTGCLKKHGYTVEVQ | 12878 | 15 | HPV | E2 | 106 | 2271 | — | 1741 | — | |
| 90.0026 | QKCFKKKGITVTVQY | 12879 | 15 | HPV | E2 | 107 | 4394 | 1329 | 639 | 7822 | |
| 90.0167 | TVEVQFDGDICNTMH | 12880 | 15 | HPV | E2 | 116 | 250 | — | 583 | — | — |
| 1601.04 | DICNTMHYTNWTHIY | 12881 | 15 | HPV | E2 | 124 | 412 | 17,726 | 4848 | — | |
| 1601.09 | GNKDNCMTYVAWDSV | 12882 | 15 | HPV | E2 | 127 | 4393 | 11,493 | — | — | |
| 90.0202 | GEIYIIEEDTCTMVT | 12883 | 15 | HPV | E2 | 135 | 6599 | — | — | — | — |
| 90.0214 | MNYVVWDSIYYITET | 12884 | 15 | HPV | E2 | 135 | 55 | — | 888 | 1617 | 1140 |
| 90.0250 | SEIYIIEETTCTLVA | 12885 | 15 | HPV | E2 | 135 | — | — | — | — | — |
| 90.0203 | EIYIIEEDTCTMVTG | 12886 | 15 | HPV | E2 | 136 | 1027 | — | — | 13,795 | — |
| 90.0251 | EIYIIEETTCTLVAG | 12887 | 15 | HPV | E2 | 136 | — | — | — | — | — |

TABLE 186-continued

Binding affinity of HLA-DR supertype and DR3 motif-positive peptides

| | | | | | | | | | | | |
|---|---|---|---|---|---|---|---|---|---|---|---|
| 1601.10 | VAWDSVYYMTDAGTW | 12888 | 15 | HPV | E2 | 136 | 343 | — | 587 | — | |
| 90.0204 | IYIIEEDTCTMVTGK | 12889 | 15 | HPV | E2 | 137 | 8187 | — | — | 11,901 | 16,544 |
| 90.0182 | SVYYMTDAGTWDKTA | 12890 | 15 | HPV | E2 | 140 | 1169 | 8465 | 1603 | 2881 | 708 |
| 90.0252 | CTLVAGEVDYVGLYY | 12891 | 15 | HPV | E2 | 145 | — | — | 981 | 6722 | 3633 |
| 90.0171 | GLYYVHEGIRTYFVQ | 12892 | 15 | HPV | E2 | 156 | 5579 | 7385 | 1003 | 5358 | 182 |
| 90.0226 | GLYYWCDGEKIYFVK | 12893 | 15 | HPV | E2 | 156 | 4929 | — | — | 9143 | 3363 |
| 1601.05 | VHEGIRTYFVQFKDD | 12894 | 15 | HPV | E2 | 160 | 5730 | 12,200 | 5861 | — | |
| 90.0216 | GVYYIKDGDTTYYVQ | 12895 | 15 | HPV | E2 | 163 | 3410 | 5615 | 1621 | — | 5736 |
| 90.0205 | YFKYFKEDAAKYSKT | 12896 | 15 | HPV | E2 | 167 | 3634 | 6028 | 2864 | 1895 | 8050 |
| 90.0253 | YFKYFKEDAKKYSKT | 12897 | 15 | HPV | E2 | 167 | — | 569 | — | 244 | — |
| 90.0206 | FKYFKEDAAKYSKTQ | 12898 | 15 | HPV | E2 | 168 | 725 | 835 | 1696 | 303 | 399 |
| 1601.11 | EKYGNTGTWEVHFGN | 12899 | 15 | HPV | E2 | 181 | 91 | — | 2492 | — | |
| 90.0237 | IWEVHMENESIYCPD | 12900 | 15 | HPV | E2 | 183 | — | — | 5489 | — | — |
| 89.0184 | EVHVGGQVIVCPTSI | 12901 | 15 | HPV | E2 | 185 | — | — | — | — | |
| 90.0015 | EVHVGGQVIVCPASV | 12902 | 15 | HPV | E2 | 185 | 187 | — | 2601 | — | |
| 90.0238 | EVHMENESIYCPDSV | 12903 | 15 | HPV | E2 | 185 | — | — | — | — | — |
| 89.0173 | GQVIVFPESVFSSDE | 12904 | 15 | HPV | E2 | 190 | — | 2118 | — | — | |
| 89.0185 | GQVIVCPTSISSNQI | 12905 | 15 | HPV | E2 | 190 | — | 1627 | — | 6525 | |
| 90.0016 | GQVIVCPASVSSNEV | 12906 | 15 | HPV | E2 | 190 | 56 | 13,089 | 197 | 4820 | 12,549 |
| 90.0027 | SRVIVCPTSIPSDQI | 12907 | 15 | HPV | E2 | 190 | — | 13,799 | — | — | |
| 90.0195 | ESVFSSDEISFAGIV | 12908 | 15 | HPV | E2 | 197 | 609 | — | 672 | — | — |
| 1601.06 | SNEVSSPEIIRQHLA | 12909 | 15 | HPV | E2 | 202 | 8609 | — | 10,821 | — | |
| 1601.45 | SDEISFAGIVTKLPT | 12910 | 15 | HPV | E2 | 202 | 901 | 10,684 | 1279 | 12,164 | |
| 89.0174 | EISFAGIVTKLPTAN | 12911 | 15 | HPV | E2 | 204 | 7800 | 11,310 | — | — | |
| 89.0175 | FAGIVTKLPTANN'TT | 12912 | 15 | HPV | E2 | 207 | 1281 | 1557 | — | 7628 | |
| 1601.13 | SDDTVSATQLVKQLQ | 12913 | 15 | HPV | E2 | 208 | 7665 | 19,337 | 15,333 | 15,553 | |
| 1601.31 | STSDDTVSATQIVRQ | 12914 | 15 | HPV | E2 | 208 | 5213 | — | — | — | |
| 89.0162 | DDTVSATQLVKQLQH | 12915 | 15 | HPV | E2 | 209 | 904 | 1033 | 1972 | 943 | 275 |
| 89.0155 | RQHLANHPAATHTKA | 12916 | 15 | HPV | E2 | 212 | — | — | — | 16,000 | |
| 89.0163 | TVSVGTAKTYGQTSA | 12917 | 15 | HPV | E2 | 231 | — | — | — | — | |
| 90.0208 | TKLFCADPALDNRTA | 12918 | 15 | HPV | E2 | 241 | — | — | — | — | — |
| 89.0186 | DPALDNRTARTATNC | 12919 | 15 | HPV | E2 | 247 | 962 | — | 6487 | — | |
| 1601.07 | PCHTTKLLHRDSVDS | 12920 | 15 | HPV | E2 | 250 | — | 2784 | — | 2955 | |
| 89.0156 | RDSVDSAPILTAFNS | 12921 | 15 | HPV | E2 | 259 | 335 | — | 222 | 7047 | |
| 1601.34 | GRVNTHVHNPLLCSS | 12922 | 15 | HPV | E2 | 262 | 6022 | 2687 | 3346 | — | |
| 89.0165 | NPLLGAATPTGNNKR | 12923 | 15 | HPV | E2 | 264 | — | — | 9377 | — | |
| 1601.24 | DSVDSVNCGVISAAA | 12924 | 15 | HPV | E2 | 265 | 2140 | — | 6729 | — | |
| 1601.16 | KRRKLCSGNTTPIIH | 12925 | 15 | HPV | E2 | 277 | 143 | 4738 | 61 | — | |
| 1601.08 | NCNSNTTPIVHLKGD | 12926 | 15 | HPV | E2 | 280 | 5768 | — | 3138 | — | |
| 1601.35 | NKRRKVCSGNTTPII | 12927 | 15 | HPV | E2 | 280 | 775 | 7414 | 9709 | — | |
| 90.0255 | IVHLKGDPNSLKCLR | 12928 | 15 | HPV | E2 | 281 | — | 2209 | — | 12,122 | 4647 |
| 1601.43 | RKVCSGNTTPIIHLK | 12929 | 15 | HPV | E2 | 283 | 1430 | 8060 | 1119 | — | |
| 1601.17 | TTPIIHKLGDRNSLK | 12930 | 15 | HPV | E2 | 286 | — | 419 | — | 4798 | |
| 1601.37 | NTTPIIHLKGDKNSL | 12931 | 15 | HPV | E2 | 289 | 18,795 | 1898 | — | — | |
| 90.0228 | IIHLKGDPNSLKCLR | 12932 | 15 | HPV | E2 | 290 | 2540 | 877 | — | — | 5828 |
| 1601.25 | TTPIIHLKGDANILK | 12933 | 15 | HPV | E2 | 292 | 3714 | 4480 | 17,365 | 7331 | |
| 90,0218 | IIHLKGDKNSLKCLR | 12934 | 15 | HPV | E2 | 293 | — | 5029 | — | — | 2128 |
| 90.0197 | IIHLKGDANILKCLR | 12935 | 15 | HPV | E2 | 295 | 3053 | 2992 | 14,059 | 12,285 | 5031 |
| 1601.26 | LKGDANILKCLRYRL | 12936 | 15 | HPV | E2 | 298 | 9024 | 1806 | — | 5525 | |
| 89.0157 | HCTLYTAVSSTWHWT | 12937 | 15 | HPV | E2 | 308 | — | — | — | — | |
| 90.0019 | RYRFQKYKTLFVDVT | 12938 | 15 | HPV | E2 | 308 | 43 | 407 | 226 | 728 | 4515 |

TABLE 186-continued

Binding affinity of HLA-DR supertype and DR3 motif-positive peptides

| | | | | | | | | | | | |
|---|---|---|---|---|---|---|---|---|---|---|---|
| 90.0241 | YKTLFVDVTSTYHWT | 12939 | 15 | HPV | E2 | 314 | 647 | 14,138 | 2232 | 4196 | 3903 |
| 90.0210 | TVTFVTEQQQQMFLG | 12940 | 15 | HPV | E2 | 322 | — | 6019 | — | — | 2769 |
| 1601.38 | STWHWTGCNKNTGIL | 12941 | 15 | HPV | E2 | 322 | 153 | 11,723 | — | 662 | |
| 1601.18 | AGNEKTGILTVTYHS | 12942 | 15 | HPV | E2 | 325 | 2129 | — | — | — | |
| 89.0187 | QQQMFLGTVKIPPTV | 12943 | 15 | HPV | E2 | 330 | — | 7287 | — | 5882 | |
| 89.0188 | QMFLGTVKIPPTVQI | 12944 | 15 | HPV | E2 | 332 | 4654 | 503 | — | 474 | 553 |
| 90.0028 | LNTVKIPPTVQISTG | 12945 | 15 | HPV | E2 | 340 | — | — | 6925 | — | |
| 1601.19 | EKQRTKFLNTVAIPD | 12946 | 15 | HPV | E2 | 340 | 123 | — | 284 | — | |
| 1601.27 | TYISTSQRDDFLNTV | 12947 | 15 | HPV | E2 | 343 | 1157 | — | 12,960 | — | |
| 1601.20 | FLNTVAIPDSVQILV | 12948 | 15 | HPV | E2 | 346 | 15 | — | 534 | — | |
| 1601.39 | RNTFLDVVTIPNSVQ | 12949 | 15 | HPV | E2 | 346 | 270 | 776 | 5872 | 371 | |
| 89.0158 | LSQVKIPKTITVSTG | 12950 | 15 | HPV | E2 | 347 | 5828 | — | 5477 | 3628 | |
| 1601.40 | FLDVVTIPNSVQISV | 12951 | 15 | HPV | E2 | 349 | 492 | 14,703 | 9346 | 2203 | |
| 90.0017 | LKTVKIPNTVQVIQG | 12952 | 15 | HPV | E2 | 350 | 777 | — | — | — | |
| 90.0020 | LSHVKIPVVYRLVWD | 12953 | 15 | HPV | E2 | 352 | 118 | 3569 | 469 | 1528 | 100 |
| 1601.28 | DFLNTVKIPNTVSVS | 12954 | 15 | HPV | E2 | 352 | 469 | 2093 | 373 | 277 | |
| 1601.41 | VVTIPNSVQISVGYM | 12955 | 15 | HPV | E2 | 352 | 71 | 3077 | 176 | 4224 | |
| 89.0178 | LNTVKIPNTVSVSTG | 12956 | 15 | HPV | E2 | 354 | 5483 | 3693 | 1141 | 976 | 361 |
| 1601.42 | TIPNSVQISVGYMTI | 12957 | 15 | HPV | E2 | 354 | 9.0 | 6226 | 91 | 487 | |
| 85.0001 | ECVYCKQQLLRREVY | 12958 | 15 | HPV | E6 | 36 | — | | — | 4802 | |
| 85.0024 | SEVYDFAFADLTVVY | 12959 | 15 | HPV | E6 | 40 | 1850 | | 174 | — | |
| 85.0138 | YDFVFADLRIVYRDG | 12960 | 15 | HPV | E6 | 43 | — | | 5419 | 16,198 | |
| 85.0054 | DFVFADLRIVYRDGN | 12961 | 15 | HPV | E6 | 44 | 9847 | | 1962 | 1462 | |
| 85.0041 | RIVYRDNNPYGVCIM | 12962 | 15 | HPV | E6 | 51 | 8307 | | — | 5242 | |
| 85.0002 | CIVYRDGNPYAVCDK | 12963 | 15 | HPV | E6 | 58 | — | | — | — | |
| 85.0022 | CDLLIRCITCQRPLC | 12964 | 15 | HPV | E6 | 97 | 12,279 | | — | — | |
| 85.0031 | NEILIRCIICQRPLC | 12965 | 15 | HPV | E6 | 97 | 16,901 | | — | — | |
| 85.0032 | IRCIICQRPLCPQEK | 12966 | 15 | HPV | E6 | 101 | — | | — | 10,260 | |
| 85.0013 | IRCLRCQKPLNPAEK | 12967 | 15 | HPV | E6 | 103 | 16,787 | | — | — | |
| 1543.22 | QERPRKLPQLCTELQ | 12968 | 15 | HPV | E6 | | — | — | — | — | 11,687 |
| 1543.23 | RGRWTGRCMSCCRSS | 12969 | 15 | HPV | E6 | | 4951 | 983 | — | 3304 | — |
| 1543.24 | LCTELQTTIHDIILE | 12970 | 15 | HPV | E6 | | 2250 | — | — | — | — |
| 1543.25 | RREVYDFAFRDLCIV | 12971 | 15 | HPV | E6 | | 73 | 9025 | — | — | 11,018 |
| 1543.26 | RHLDKKQRFHNIRGR | 12972 | 15 | HPV | E6 | | 591 | 7723 | — | 2132 | — |
| 1543.27 | QRFHNIRGRWTGRCM | 12973 | 15 | HPV | E6 | | 277 | 894 | — | 574 | 14,594 |
| 1543.28 | HNIRGRWTGRCMSCC | 12974 | 15 | HPV | E6 | | 633 | 142 | — | 1727 | 7647 |
| 1543.29 | WTGRCMSCCRSSRTR | 12975 | 15 | HPV | E6 | | 1254 | 7991 | 13,791 | 2614 | 10,920 |
| 1543.30 | RCMSCCRSSRTRRET | 12976 | 15 | HPV | E6 | | 732 | — | 5446 | 5542 | — |
| 1543.31 | MSCCRSSRTRRETQL | 12977 | 15 | HPV | E6 | | 969 | — | 3099 | 2916 | — |
| 1543.32 | TNTGLYNLLIRCLRC | 12978 | 15 | HPV | E6 | | 4038 | 41 | 13,620 | 17 | 4057 |
| 1543.34 | TELNTSLQDIEITCV | 12979 | 15 | HPV | E6 | | — | 5516 | — | — | — |
| 1543.35 | EVFEFAFKDLFVVYR | 12980 | 15 | HPV | E6 | | 14,415 | 1415 | — | 6079 | 624 |
| 1543.37 | TGRCIACWRRPRTET | 12981 | 15 | HPV | E6 | | 11,460 | 512 | 13,556 | 158 | 4949 |
| 1543.39 | CQALETTIHNIELQC | 12982 | 15 | HPV | E6 | | 8117 | — | — | — | |
| 1543.40 | FHSIAGQYRGQCNTC | 12983 | 15 | HPV | E6 | | 2403 | 7644 | 1992 | 416 | 10,126 |
| 1543.41 | QYRGQCNTCCDQARQ | 12984 | 15 | HPV | E6 | | 13,367 | — | — | 5198 | — |
| 1543.42 | TRPRTLHELCEVLEE | 12985 | 15 | HPV | E6 | | — | — | — | — | — |
| 1543.46 | GCWRQTSREPRESTV | 12986 | 15 | HPV | E6 | | 72 | 356 | 3198 | 144 | — |
| 1543.48 | SEVYDFVFADLRIVY | 12987 | 15 | HPV | E6 | | 51 | 4038 | 33 | — | 8089 |
| 1543.54 | RVCLLFYSKVRKYRY | 12988 | 15 | HPV | E6 | | 232 | 269 | 656 | 4263 | 603 |
| 1543.55 | HGWTGSCLGCWRQTS | 12989 | 15 | HPV | E6 | | 114 | 7005 | 5910 | 16,900 | — |

TABLE 186-continued

Binding affinity of HLA-DR supertype and DR3 motif-positive peptides

| | | | | | | | | | | | | |
|---|---|---|---|---|---|---|---|---|---|---|---|---|
| 1543.56 | CLGCWRQTSREPRES | 12990 | 15 | HPV | E6 | | | 1206 | 446 | — | 469 | — |
| 1543.57 | IMCLRFLSKISEYRH | 12991 | 15 | HPV | E6 | | | 2930 | 109 | 2524 | 27 | 337 |
| 1543.58 | YRHYQYSLYGKTLEE | 12992 | 15 | HPV | E6 | | | 146 | 410 | 273 | 953 | 11,961 |
| 1543.59 | KERHVNANKRFHNIM | 12993 | 15 | HPV | E6 | | | 4757 | 1229 | 2850 | 83 | 260 |
| 1543.60 | RFHNIMGRWTGRCSE | 12994 | 15 | HPV | E6 | | | 169 | 27 | 8865 | 24 | 18,290 |
| 85.0092 | DLRVVQQLLMGALTV | 12995 | 15 | HPV | E7 | 82 | | 508 | | 1845 | 754 | |
| 85.0101 | QLLMGTCTIVCPSCA | 12996 | 15 | HPV | E7 | 82 | | 10,940 | | 13,642 | — | |
| 1543.03 | EPDRAHYNIVTFCCK | 12997 | 15 | HPV | E7 | | | 7504 | 9161 | — | 7023 | — |
| 1543.04 | LDLQPETTDLYCYEQ | 12998 | 15 | HPV | E7 | | | — | — | — | — | — |
| 1543.05 | GVNHQHLPARRAEPQ | 12999 | 15 | HPV | E7 | | | 16,850 | — | — | — | |
| 1543.07 | SADDLRAFQQLFLNT | 13000 | 15 | HPV | E7 | | | 124 | 6996 | 559 | 3589 | 305 |
| 1543.10 | DYVLDLQPEATDLHC | 13001 | 15 | HPV | E7 | | | — | — | — | — | 4880 |
| 1543.11 | QSTQVDIRILQELLM | 13002 | 15 | HPV | E7 | | | 5388 | 16,678 | — | 6478 | 2338 |
| 1543.12 | EYVLDLYPEPTDLYC | 13003 | 15 | HPV | E7 | | | — | — | — | — | 2206 |
| 1543.13 | LYCYEQLSDSSDEDE | 13004 | 15 | HPV | E7 | | | 9772 | — | — | 3381 | — |
| 1543.14 | YYIVTCCHTCNTTVR | 13005 | 15 | HPV | E7 | | | 162 | 3137 | — | — | 2198 |
| 1543.15 | LCVNSTASDLRTIQQ | 13006 | 15 | HPV | E7 | | | 723 | 4378 | — | 18,497 | 1585 |
| 1543.16 | LLMGTVNIVCPTCAQ | 13007 | 15 | HPV | E7 | | | 2496 | 7198 | 17,812 | — | — |
| 1543.17 | LMGTVNIVCPTCAQQ | 13008 | 15 | HPV | E7 | | | 947 | 4280 | — | 5240 | — |
| 1543.18 | DGVSHAQLPARRAEP | 13009 | 15 | HPV | E7 | | | — | — | — | — | — |
| 1543.19 | FLSTLSFVCPWCATN | 13010 | 15 | HPV | E7 | | | 34 | 6720 | 11,288 | 13,754 | 139 |
| 1543.20 | EIVLHLEPQNELDPV | 13011 | 15 | HPV | E7 | | | 3490 | — | — | — | — |
| 1543.21 | EDLRTLQQLFLSTLS | 13012 | 15 | HPV | E7 | | | 390 | 12,792 | 15,517 | 279 | 958 |
| 1543.43 | PDGQAEQATSNYYIV | 13013 | 15 | HPV | E7 | | | 51 | — | 2331 | 8892 | — |
| 1543.44 | TYCHSCDSTLRLCIH | 13014 | 15 | HPV | E7 | | | 3398 | — | — | 12,659 | — |
| 1543.45 | CIHSTATDLRTLQQM | 13015 | 15 | HPV | E7 | | | 459 | 493 | 19,048 | 429 | 4515 |
| 1543.51 | EYILDLHPEPTDLFC | 13016 | 15 | HPV | E7 | | | — | 16,272 | — | 19,544 | 2595 |
| 1543.52 | TCGTTVRLCINSITT | 13017 | 15 | HPV | E7 | | | — | 9316 | — | — | 7112 |
| 1543.53 | LMGTCTIVCPSCAQQ | 13018 | 15 | HPV | E7 | | | 1038 | 8998 | 642 | 2691 | — |
| 9014.0015 | NASLLIQNSIQNDTG | 13019 | 15 | Human | CEA | 104 | A | | | | | |
| 9014.0071 | QNFIQNDTGFYTLHV | 13020 | 15 | Human | CEA | 110 | A | | | | | |
| 9014.0076 | QNWIQNDTGFYTLHV | 13021 | 15 | Human | CEA | 110 | A | | | | | |
| 9014.0077 | QNYIQNDTGFYTLHV | 13022 | 15 | Human | CEA | 110 | A | | | | | |
| 9014.0085 | QNIIQNDVGFYTLHV | 13023 | 15 | Human | CEA | 110 | A | | | | | |
| 9014.0037 | KPSFSSNNSKPVEDK | 13024 | 15 | Human | CEA | 146 | A | | | | | |
| 9014.0040 | KPSLSSNNSKPVEDK | 13025 | 15 | Human | CEA | 146 | A | | | | | |
| 9014.0041 | KPSVSSNNSKPVEDK | 13026 | 15 | Human | CEA | 146 | A | | | | | |
| 9014.0042 | KPSWSSNNSKPVEDK | 13027 | 15 | Human | CEA | 146 | A | | | | | |
| 9014.0043 | KPSYSSNNSKPVEDK | 13028 | 15 | Human | CEA | 146 | A | | | | | |
| 9014.0044 | KPSISSNNAKPVEDK | 13029 | 15 | Human | CEA | 146 | A | | | | | |
| 58.0015 | LWWVNNESLPVSPRL | 13030 | 15 | Human | CEA | 177 | A | | | | | |
| 9014.0054 | RTTFKTITVSAELPK | 13031 | 15 | Human | CEA | 488 | A | | | | | |
| 9014.0058 | RTTLKTITVSAELPK | 13032 | 15 | Human | CEA | 488 | A | | | | | |
| 9014.0059 | RTTWKTITVSAELPK | 13033 | 15 | Human | CEA | 488 | A | | | | | |
| 9014.0060 | RTTYKTITVSAELPK | 13034 | 15 | Human | CEA | 488 | A | | | | | |
| 9014,0065 | RTTVKTITLSAELPK | 13035 | 15 | Human | CEA | 488 | A | | | | | |
| 9014.0088 | GTDFKLRLPASPETH | 13036 | 15 | Human | Her2/neu | 28 | A | | | | | |
| 9014.0090 | GTDIKLRLPASPETH | 13037 | 15 | Human | Her2/neu | 28 | A | | | | | |
| 9014.0094 | GTDWKLRLPASPETH | 13038 | 15 | Human | Her2/neu | 28 | A | | | | | |
| 9014.0095 | GTDYKLRLPASPETH | 13039 | 15 | Human | Her2/neu | 28 | A | . | | | | |
| 9014.0096 | GTDMKLRLAASPETH | 13040 | 15 | Human | Her2/neu | 28 | A | | | | | |

TABLE 186-continued

Binding affinity of HLA-DR supertype and DR3 motif-positive peptides

| | | | | | | | | | | | |
|---|---|---|---|---|---|---|---|---|---|---|---|
| 9014.0097 | GTDMKLRLFASPETH | 13041 | 15 | Human | Her2/neu | 28 | A | | | | |
| 9014.0098 | GTDMKLRLHASPETH | 13042 | 15 | Human | Her2/neu | 28 | A | | | | |
| 9014.0099 | GTDMKLRLIASPETH | 13043 | 15 | Human | Her2/neu | 28 | A | | | | |
| 9014.0100 | GTDMKLRLLASPETH | 13044 | 15 | Human | Her2/neu | 28 | A | | | | |
| 9014.0101 | GTDMKLRLNASPETH | 13045 | 15 | Human | Her2/neu | 28 | A | | | | |
| 9014.0102 | GTDMKLRLSASPETH | 13046 | 15 | Human | Her2/neu | 28 | A | | | | |
| 9014.0103 | GTDMKLRLTASPETH | 13047 | 15 | Human | Her2/neu | 28 | A | | | | |
| 9014.0104 | GTDMKLRLVASPETH | 13048 | 15 | Human | Her2/neu | 28 | A | | | | |
| 9014.0115 | DMKLRLAASPETHLD | 13049 | 15 | Human | Her2/neu | 30 | A | | | | |
| 9014.0116 | DMKLRLFASPETHLD | 13050 | 15 | Human | Her2/neu | 30 | A | | | | |
| 9014.0118 | DMKLRLIASPETHLD | 13051 | 15 | Human | Her2/neu | 30 | A | | | | |
| 9014.0119 | DMKLRLLASPETHLD | 13052 | 15 | Human | Her2/neu | 30 | A | | | | |
| 9014.0120 | DMKLRLNASPETHLD | 13053 | 15 | Human | Her2/neu | 30 | A | | | | |
| 9014.0121 | DMKLRLSASPETHLD | 13054 | 15 | Human | Her2/neu | 30 | A | | | | |
| 9014.0123 | DMKLRLVASPETHLD | 13055 | 15 | Human | Her2/neu | 30 | A | | | | |
| 9014.0131 | DMKYRLPASPETHLD | 13056 | 15 | Human | Her2/neu | 30 | A | | | | |
| 9014.0135 | DMKLRLPAIPETHLD | 13057 | 15 | Human | Her2/neu | 30 | A | | | | |
| 1533.07 | KIFGSLAFLPESFDGDPA | 13058 | 18 | Human | Her2/neu | 369 | | 377 | — | 15,796 | — |
| 9014.0230 | KAFGSLAFLPESFDGDPA | 13059 | 18 | Human | Her2/neu | 369 | A | | | | |
| 9014.0231 | KFFGSLAFLPESFDGDPA | 13060 | 18 | Human | Her2/neu | 369 | A | | | | |
| 9014.0232 | KHFGSLAFLPESFDGDPA | 13061 | 18 | Human | Her2/neu | 369 | A | | | | |
| 9014.0233 | KKFGSLAFLPESFDGDPA | 13062 | 18 | Human | Her2/neu | 369 | A | | | | |
| 9014.0234 | KLFGSLAFLPESFDGDPA | 13063 | 18 | Human | Her2/neu | 369 | A | | | | |
| 9014.0235 | KVFGSLAFLPESFDGDPA | 13064 | 18 | Human | Her2/neu | 369 | A | | | | |
| 9014.0236 | KWFGSLAFLPESFDGDPA | 13065 | 18 | Human | Her2/neu | 369 | A | | | | |
| 9014.0237 | KYFGSLAFLPESFDGDPA | 13066 | 18 | Human | Her2/neu | 369 | A | | | | |
| 9014.0240 | KIFGSLIFLPESFDGDPA | 13067 | 18 | Human | Her2/neu | 369 | A | | | | |
| 9014.0241 | KIFGSLLFLPESFDGDPA | 13068 | 18 | Human | Her2/neu | 369 | A | | | | |
| 9014.0242 | KIFGSLNFLPESFDGDPA | 13069 | 18 | Human | Her2/neu | 369 | A | | | | |
| 9014.0243 | KIFGSLSFLPESFDGDPA | 13070 | 18 | Human | Her2/neu | 369 | A | | | | |
| 9014.0244 | KIFGSLTFLPESFDGDPA | 13071 | 18 | Human | Her2/neu | 369 | A | | | | |
| 9014.0245 | KIFGSLVFLPESFDGDPA | 13072 | 18 | Human | Her2/neu | 369 | A | | | | |
| 9014.0246 | KIFGSLAALPESFDGDPA | 13073 | 18 | Human | Her2/neu | 369 | A | | | | |
| 9014.0247 | KIFGSLAHLPESFDGDPA | 13074 | 18 | Human | Her2/neu | 369 | A | | | | |
| 9014.0248 | KIFGSLAILPESFDGDPA | 13075 | 18 | Human | Her2/neu | 369 | A | | | | |
| 9014.0250 | KIFGSLALLPESFDGDPA | 13076 | 18 | Human | Her2/neu | 369 | A | | | | |
| 9014.0251 | KIFGSLAVLPESFDGDPA | 13077 | 18 | Human | Her2/neu | 369 | A | | | | |
| 9014.0252 | KIFGSLAWLPESFDGDPA | 13078 | 18 | Human | Her2/neu | 369 | A | | | | |
| 9014.0253 | KIFGSLAYLPESFDGDPA | 13079 | 18 | Human | Her2/neu | 369 | A | | | | |
| 9014.0255 | KIFGSLAFLPESHDGDPA | 13080 | 18 | Human | Her2/neu | 369 | A | | | | |
| 9014.0257 | KIFGSLAFLPESLDGDPA | 13081 | 18 | Human | Her2/neu | 369 | A | | | | |
| 1385.01 | QIQVFETLEET | 13082 | 11 | Human | Her2/neu | 396 | | | | | |
| 9014.0141 | ETEAVEPLTPSGAMP | 13083 | 15 | Human | Her2/neu | 693 | A | | | | |
| 9014.0142 | ETEFVEPLTPSGAMP | 13084 | 15 | Human | Her2/neu | 693 | A | | | | |
| 9014.0143 | ETEHVEPLTPSGAMP | 13085 | 15 | Human | Her2/neu | 693 | A | | | | |
| 9014.0144 | ETEIVEPLTPSGAMP | 13086 | 15 | Human | Her2/neu | 693 | A | | | | |
| 9014.0145 | ETEKVEPLTPSGAMP | 13087 | 15 | Human | Her2/neu | 693 | A | | | | |
| 9014.0146 | ETEVVEPLTPSGAMP | 13088 | 15 | Human | Her2/neu | 693 | A | | | | |
| 9014.0147 | ETEWVEPLTPSGAMP | 13089 | 15 | Human | Her2/neu | 693 | A | | | | |
| 9014.0148 | ETEYVEPLTPSGAMP | 13090 | 15 | Human | Her2/neu | 693 | A | | | | |
| 9014.0149 | ETELVEPLAPSGAMP | 13091 | 15 | Human | Her2/neu | 693 | A | | | | |

TABLE 186-continued

Binding affinity of HLA-DR supertype and DR3 motif-positive peptides

| | | | | | | | | | | | | |
|---|---|---|---|---|---|---|---|---|---|---|---|---|
| 9014.0150 | ETELVEPLFPSGAMP | 13092 | 15 | Human | Her2/neu | 693 | A | | | | | |
| 9014.0151 | ETELVEPLHPSGAMP | 13093 | 15 | Human | Her2/neu | 693 | A | | | | | |
| 9014.0152 | ETELVEPLIPSGAMP | 13094 | 15 | Human | Her2/neu | 693 | A | | | | | |
| 9014.0153 | ETELVEPLLPSGAMP | 13095 | 15 | Human | Her2/neu | 693 | A | | | | | |
| 9014.0154 | ETELVEPLNPSGAMP | 13096 | 15 | Human | Her2/neu | 693 | A | | | | | |
| 9014,0155 | ETELVEPLSPSGAMP | 13097 | 15 | Human | Her2/neu | 693 | A | | | | | |
| 9014.0156 | ETELVEPLVPSGAMP | 13098 | 15 | Human | Her2/neu | 693 | A | | | | | |
| 9014.0169 | KEILDEAYIMAGVGS | 13099 | 15 | Human | Her2/neu | 765 | A | | | | | |
| 9014.0170 | KEILDEAYLMAGVGS | 13100 | 15 | Human | Her2/neu | 765 | A | | | | | |
| 9014.0177 | ITDIGLARLLDIDET | 13101 | 15 | Human | Her2/neu | 861 | A | | | | | |
| 9014.0183 | ITDFGLARALDIDET | 13102 | 15 | Human | Her2/neu | 861 | A | | | | | |
| 9014.0187 | ITDFGLARNLDIDET | 13103 | 15 | Human | Her2/neu | 861 | A | | | | | |
| 9014.0188 | ITDFGLARSLDIDET | 13104 | 15 | Human | Her2/neu | 861 | A | | | | | |
| 9014.0210 | CWAIDSECRPRFREL | 13105 | 15 | Human | Her2/neu | 958 | A | | | | | |
| 9014.0211 | CWFIDSECRPRFREL | 13106 | 15 | Human | Her2/neu | 958 | A | | | | | |
| 9014.0212 | CWHIDSECRPRFREL | 13107 | 15 | Human | Her2/neu | 958 | A | | | | | |
| 9014.0213 | CWIIDSECRPRFREL | 13108 | 15 | Human | Her2/neu | 958 | A | | | | | |
| 9014.0214 | CWKIDSECRPRFREL | 13109 | 15 | Human | Her2/neu | 958 | A | | | | | |
| 9014.0215 | CWLIDSECRPRFREL | 13110 | 15 | Human | Her2/neu | 958 | A | | | | | |
| 9014.0218 | CWYIDSECRPRFREL | 13111 | 15 | Human | Her2/neu | 958 | A | | | | | |
| 9014.0219 | CWMIDSEARPRFREL | 13112 | 15 | Human | Her2/neu | 958 | A | | | | | |
| 9014.0220 | CWMIDSEFRPRFREL | 13113 | 15 | Human | Her2/neu | 958 | A | | | | | |
| 9014.0221 | CWMIDSEHRPRFREL | 13114 | 15 | Human | Her2/neu | 958 | A | | | | | |
| 9014.0222 | CWMIDSEIRPRFREL | 13115 | 15 | Human | Her2/neu | 958 | A | | | | | |
| 9014.0223 | CWMIDSELRPRFREL | 13116 | 15 | Human | Her2/neu | 958 | A | | | | | |
| 9014.0224 | CWMIDSENRPRFREL | 13117 | 15 | Human | Her2/neu | 958 | A | | | | | |
| 9014.0225 | CWMIDSESRPRFREL | 13118 | 15 | Human | Her2/neu | 958 | A | | | | | |
| 9014.0226 | CWMIDSETRPRFREL | 13119 | 15 | Human | Her2/neu | 958 | A | | | | | |
| 9014.0227 | CWMIDSEVRPRFREL | 13120 | 15 | Human | Her2/neu | 958 | A | | | | | |
| 68.0001 | MWDLVLSIALSVGCT | 13121 | 15 | Human | Kallikrein2 | 1 | | 3032 | — | 1727 | — | 4575 |
| 68.0002 | DLVLSIALSVGCTGA | 13122 | 15 | Human | Kallikrein2 | 3 | | 4029 | — | 2200 | — | 4915 |
| 68.0003 | HPQWVLTAAHCLKKN | 13123 | 15 | Human | Kallikrein2 | 56 | | 563 | 1693 | 822 | 981 | 11,452 |
| 68.0004 | QWVLTAAHCLKKNSQ | 13124 | 15 | Human | Kallikrein2 | 58 | | 3402 | — | 4813 | 14,213 | — |
| 68.0005 | GQRVPVSHSFPHPLY | 13125 | 15 | Human | Kallikrein2 | 87 | | 629 | — | 102 | — | 5507 |
| 68.0006 | RVPVSHSFPHPLYNM | 13126 | 15 | Human | Kallikrein2 | 89 | | 101 | — | 97 | — | 10,398 |
| 68.0007 | PHPLYNMSLLKHQSL | 13127 | 15 | Human | Kallikrein2 | 97 | | — | 3315 | 1592 | 6455 | 860 |
| 68.0008 | HPLYNMSLLKHQSLR | 13128 | 15 | Human | Kallikrein2 | 98 | | 1282 | 382 | 199 | 248 | 95 |
| 68.0009 | NMSLLKHQSLRPDED | 13129 | 15 | Human | Kallikrein2 | 102 | | — | — | — | — | 1288 |
| 68.0010 | SHDLMLLRLSEPAKI | 13130 | 15 | Human | Kallikrein2 | 118 | | 106 | 1327 | 112 | 5267 | 591 |
| 68.0011 | HDLMLLRLSEPAKIT | 13131 | 15 | Human | Kallikrein2 | 119 | | 109 | 544 | 43 | 1147 | 84 |
| 68.0015 | PEEFLRPRSLQCVSL | 13132 | 15 | Human | Kallikrein2 | 162 | | 5156 | 2207 | 5839 | 10,675 | 6024 |
| 68.0016 | PRSLQCVSLHLLSND | 13133 | 15 | Human | Kallikrein2 | 168 | | 2217 | 6107 | — | 11,128 | 3861 |
| 68.0140 | LHLLSNDMCARAYSE | 13134 | 15 | Human | Kallikrein2 | 176 | | — | — | — | — | 1152 |
| 68.0017 | NGVLQGITSWGPEPC | 13135 | 15 | Human | Kallikrein2 | 220 | | 2285 | — | — | — | — |
| 68.0018 | KPAVYTKVVHYRKWI | 13136 | 15 | Human | Kallikrein2 | 239 | | 2401 | 53 | 3677 | 327 | 1303 |
| 58.0114 | VGNWQYFFPVIFSKA | 13137 | 15 | Human | MAGE3 | 140 | | 100 | | | | |
| F160.17 | LVEVTLGEVPAAESPD | 13138 | 16 | Human | MAGE3/6 | 45 | | | | | | |
| 68.0019 | AAPLLLARAASLSLG | 13139 | 15 | Human | PAP | 3 | | 160 | 30 | 64 | 100 | 564 |
| 68.0020 | APLLLARAASLSLGF | 13140 | 15 | Human | PAP | 4 | | 59 | 76 | 124 | 322 | 225 |
| 68.0021 | PLLLARAASLSLGFL | 13141 | 15 | Human | PAP | 5 | | 162 | 37 | 58 | 1255 | 1511 |
| 68.0022 | SLSLGFLFLLFFWLD | 13142 | 15 | Human | PAP | 13 | | — | — | — | — | 1221 |

TABLE 186-continued

Binding affinity of HLA-DR supertype and DR3 motif-positive peptides

| | | | | | | | | | | | |
|---|---|---|---|---|---|---|---|---|---|---|---|
| 68.0023 | LLFFWLDRSVLAKEL | 13143 | 15 | Human | PAP | 21 | 135 | 163 | 518 | 154 | 179 |
| 68.0024 | DRSVLAKELKFVTLV | 13144 | 15 | Human | PAP | 27 | 2016 | 15,815 | 4719 | — | 301 |
| 68,0025 | AKELKFVTLVFRHGD | 13145 | 15 | Human | PAP | 32 | 606 | 1953 | 2355 | 12,309 | 693 |
| 68.0026 | RSPIDTFPTDPIKES | 13146 | 15 | Human | PAP | 47 | — | — | 6124 | — | — |
| 68.0028 | FGQLTQLGMEQHYEL | 13147 | 15 | Human | PAP | 67 | — | — | — | — | 653 |
| 68.0030 | DRTLMSAMTNLAALF | 13148 | 15 | Human | PAP | 110 | 383 | 2362 | 222 | 2367 | 704 |
| 68.0031 | MSAMTNLAALFPPEG | 13149 | 15 | Human | PAP | 114 | — | — | — | — | 3873 |
| 68.0032 | MTNLAALFPPEGVSI | 13150 | 15 | Human | PAP | 117 | — | — | — | — | 4531 |
| 68.0033 | PEGVSIWNPILLWQP | 13151 | 15 | Human | PAP | 126 | 15,030 | — | — | — | 7975 |
| 68.0034 | GVSIWNPILLWQPIP | 13152 | 15 | Human | PAP | 128 | 4992 | 11,008 | 3985 | 10,287 | 3902 |
| 68.0035 | WNPILLWQPIPVHTV | 13153 | 15 | Human | PAP | 132 | 521 | — | 607 | 19,640 | 5694 |
| 68.0036 | NPILLWQPIPVHTVP | 13154 | 15 | Human | PAP | 133 | 41 | 12,999 | 575 | 599 | 612 |
| 68.0037 | PILLWQPIPVHTVPL | 13155 | 15 | Human | PAP | 134 | 46 | — | 168 | 4041 | 2370 |
| 68,0038 | ILLWQPIPVHTVPLS | 13156 | 15 | Human | PAP | 135 | 19 | 13,091 | 131 | 2343 | 7289 |
| 68.0039 | WQPIPVHTVPLSEDQ | 13157 | 15 | Human | PAP | 138 | 159 | — | 17,518 | — | — |
| 68.0147 | TVPLSEDQLLYLPFR | 13158 | 15 | Human | PAP | 145 | 11,313 | — | — | — | 9694 |
| 68.0040 | LSGLHGQDLFGIWSK | 13159 | 15 | Human | PAP | 194 | — | — | — | — | 7891 |
| 68.0041 | YDPLYCESVHNFTLP | 13160 | 15 | Human | PAP | 210 | 838 | — | 643 | — | — |
| 68.0042 | LPSWATEDTMTKLRE | 13161 | 15 | Human | PAP | 223 | — | — | — | — | — |
| 68.0043 | LRELSELSLLSLYGI | 13162 | 15 | Human | PAP | 235 | 4010 | 9368 | 1614 | 6958 | 1169 |
| 68.0044 | LSELSLLSLYGIHKQ | 13163 | 15 | Human | PAP | 238 | — | 1186 | 1450 | 1657 | 262 |
| 68.0045 | LSLLSLYGIHKQKEK | 13164 | 15 | Human | PAP | 241 | — | 1637 | 4959 | 742 | 647 |
| 68.0046 | KSRLQGGVLVNEILN | 13165 | 15 | Human | PAP | 255 | 2838 | — | 5516 | — | 9605 |
| 68.0047 | GGVLVNEILNHMKRA | 13166 | 15 | Human | PAP | 260 | — | 3239 | — | 255 | 6694 |
| 68.0048 | IPSYKKLIMYSAHDT | 13167 | 15 | Human | PAP | 277 | 1946 | 60 | 351 | 53 | 669 |
| 68.0049 | YKKLIMYSAHDTTVS | 13168 | 15 | Human | PAP | 280 | 292 | 309 | 107 | 208 | 928 |
| 68.0050 | LIMYSAHDTTVSGLQ | 13169 | 15 | Human | PAP | 283 | 731 | — | 813 | — | — |
| 68.0051 | DTTVSGLQMALDVYN | 13170 | 15 | Human | PAP | 290 | 14,706 | — | 2876 | — | 712 |
| 68.0052 | ALDVYNGLLPPYASC | 13171 | 15 | Human | PAP | 299 | — | 588 | — | 182 | 7568 |
| 68.0053 | LDVYNGLLPPYASCH | 13172 | 15 | Human | PAP | 300 | — | 404 | — | 194 | 9754 |
| 68.0054 | YNGLLPPYASCHLTE | 13173 | 15 | Human | PAP | 303 | — | 14,027 | 8022 | 5300 | — |
| 68.0153 | LTELYFEKGEYFVEM | 13174 | 15 | Human | PAP | 315 | 13,062 | 18,841 | — | — | 12,690 |
| 68.0056 | FAELVGPVIPQDWST | 13175 | 15 | Human | PAP | 356 | — | — | — | — | 12,504 |
| 68.0156 | GPVIPQDWSTECMTT | 13176 | 15 | Human | PAP | 361 | | | | | — |
| K-09 | FLYGALLLAEGFYTTGAVRQ | 13177 | 20 | Human | PLP | 81 | | | | | |
| F025.05 | QKGRGYRGQHQAHSLERVCH | 13178 | 20 | Human | PLP | 121 | | | | — | |
| K-18 | SAVPVYIYFNTWTTCQSIAF | 13179 | 20 | Human | PLP | 171 | | | | | |
| F025.03 | WTTCQSIAFPSKTSASIGSL | 13180 | 20 | Human | PLP | 181 | | 3051 | 1717 | — | 827 |
| F025.08 | AATYNFAVLKLMGRGTKF | 13181 | 18 | Human | PLP | 260 | | | | 17 | |
| 68.0058 | TLSVTWIGAAPLILS | 13182 | 15 | Human | PSA | 5 | 16 | 840 | 5.4 | 6860 | 55 |
| 68.0059 | SVTWIGAAPLILSRI | 13183 | 15 | Human | PSA | 7 | 83 | 139 | 30 | 2196 | 512 |
| 68.0060 | VTWIGAAPLILSRIV | 13184 | 15 | Human | PSA | 8 | 195 | 731 | 82 | 1779 | 818 |
| 68.0061 | SQPWQVLVASRGRAV | 13185 | 15 | Human | PSA | 31 | 385 | 386 | 621 | 135 | 8775 |
| 68.0062 | GRAVCGGVLVHPQWV | 13186 | 15 | Human | PSA | 42 | 3582 | — | 8069 | — | 16,411 |
| 68.0063 | GVLVHPQWVLTAAHC | 13187 | 15 | Human | PSA | 48 | 153 | 1931 | 365 | 263 | 7487 |
| 68.0064 | HPQWVLTAAHCIRNK | 13188 | 15 | Human | PSA | 52 | 283 | 1305 | 107 | 785 | 5790 |
| 68.0065 | QWVLTAAHCIRNKSV | 13189 | 15 | Human | PSA | 54 | 214 | 2598 | 967 | 2169 | 4171 |
| 68.0066 | AHCIRNKSVILLGRH | 13190 | 15 | Human | PSA | 60 | 2573 | 104 | 715 | 93 | 160 |
| 68.0067 | SVILLGRHSLFHPED | 13191 | 15 | Human | PSA | 67 | — | 500 | 5216 | 96 | 91 |
| 68.0068 | VILLGRHSLFHPEDT | 13192 | 15 | Human | PSA | 68 | — | 737 | 18,520 | 344 | 56 |
| 68.0158 | HSLFHPEDTGQVFQV | 13193 | 15 | Human | PSA | 74 | | | | | — |

TABLE 186-continued

Binding affinity of HLA-DR supertype and DR3 motif-positive peptides

| | | | | | | | | | | | |
|---|---|---|---|---|---|---|---|---|---|---|---|
| 68.0069 | GQVFQVSHSFPHPLY | 13194 | 15 | Human | PSA | 83 | 27 | 548 | 33 | 103 | 557 |
| 68.0070 | VFQVSHSFPHPLYDM | 13195 | 15 | Human | PSA | 85 | 51 | 8751 | 17 | 881 | 2477 |
| 68.0071 | PHPLYDMSLLKNRFL | 13196 | 15 | Human | PSA | 93 | 10,699 | — | 12,836 | — | 487 |
| 68.0072 | SHDLMLLRLSEPAEL | 13197 | 15 | Human | PSA | 114 | 58 | 3538 | 64 | 4471 | 737 |
| 68.0073 | HDLMLLRLSEPAELT | 13198 | 15 | Human | PSA | 115 | 152 | 3914 | 22 | 2141 | 520 |
| 68.0074 | TDAVKVMDLPTQEPA | 13199 | 15 | Human | PSA | 129 | — | — | — | — | — |
| 68.0077 | LHVISNDVCAQVHPQ | 13200 | 15 | Human | PSA | 172 | 17,451 | — | — | — | — |
| 68.0078 | CAQVHPQKVTKFMLC | 13201 | 15 | Human | PSA | 180 | — | 8731 | — | 18,490 | 2698 |
| 68.0079 | GGPLVCNGVLQGITS | 13202 | 15 | Human | PSA | 210 | — | 9334 | 16,308 | 1828 | 3745 |
| 68.0080 | GPLVCNGVLQGITSW | 13203 | 15 | Human | PSA | 211 | 4893 | 4187 | — | 915 | 1876 |
| 68.0081 | NGVLQGITSWGSEPC | 13204 | 15 | Human | PSA | 216 | 485 | 5874 | 819 | 9724 | 2716 |
| 68.0082 | RPSLYTKVVHYRKWI | 13205 | 15 | Human | PSA | 235 | 652 | 39 | 5484 | 350 | 4160 |
| 68.0083 | PRWLCAGALVLAGGF | 13206 | 15 | Human | PSM | 18 | 766 | — | 1439 | — | 4596 |
| 68.0084 | LGFLFGWFIKSSNEA | 13207 | 15 | Human | PSM | 35 | 2261 | 1421 | 1701 | 7303 | 475 |
| 68.0085 | LDELKAENIKKFLYN | 13208 | 15 | Human | PSM | 62 | 7470 | 1248 | 12,778 | 324 | 368 |
| 68.0086 | IKKFLYNFTQIPHLA | 13209 | 15 | Human | PSM | 70 | 29 | 512 | 160 | 137 | 552 |
| 68.0087 | KFLYNFTQIPHLAGT | 13210 | 15 | Human | PSM | 72 | 30 | 415 | 54 | 91 | 1244 |
| 68.0088 | WKEFGLDSVELAHYD | 13211 | 15 | Human | PSM | 100 | 3511 | 19,971 | 7052 | 4935 | — |
| 68.0089 | LAHYDVLLSYPNKTH | 13212 | 15 | Human | PSM | 110 | 3617 | 415 | 1009 | 380 | 7286 |
| 68.0165 | YISIINEDGNEIFNT | 13213 | 15 | Human | PSM | 127 | — | — | — | — | — |
| 68.0166 | ISIINEDGNEIFNTS | 13214 | 15 | Human | PSM | 128 | — | — | — | — | 10,651 |
| 68.0090 | GNEIFNTSLFEPPPP | 13215 | 15 | Human | PSM | 135 | — | — | 10,415 | — | — |
| 68.0167 | EDFFKLERDMKINCS | 13216 | 15 | Human | PSM | 183 | 8550 | 1439 | — | 10,433 | — |
| 68.0168 | FFKLERDMKINCSGK | 13217 | 15 | Human | PSM | 185 | — | 8109 | — | 9687 | 6936 |
| 68.0096 | GKVFRGNKVKNAQLA | 13218 | 15 | Human | PSM | 206 | 2350 | 4121 | — | 894 | — |
| 68.0097 | GNKVKNAQLAGAKGV | 13219 | 15 | Human | PSM | 211 | — | — | 7882 | — | — |
| 68.0170 | GVILYSDPADYFAPG | 13220 | 15 | Human | PSM | 224 | 7848 | — | 2473 | — | 1078 |
| 68.0100 | EYAYRRGIAEAVGLP | 13221 | 15 | Human | PSM | 276 | 70 | 596 | 67 | 2590 | 12,280 |
| 68.0101 | AEAVGLPSIPVHPIG | 13222 | 15 | Human | PSM | 284 | 2015 | — | — | — | 700 |
| 68.0102 | AVGLPSIPVHPIGYY | 13223 | 15 | Human | PSM | 286 | 1080 | 4432 | 15,377 | — | 384 |
| 68.0103 | IGYYDAQKLLEKMGG | 13224 | 15 | Human | PSM | 297 | — | 8236 | — | — | — |
| 68.0105 | TGNFSTQKVKMHIHS | 13225 | 15 | Human | PSM | 334 | 9407 | 10,282 | 1450 | 11,856 | 11,638 |
| 68.0107 | TRIYNVIGTLRGAVE | 13226 | 15 | Human | PSM | 353 | 4806 | 70 | 2900 | 45 | 502 |
| 68.0173 | GAAVVHEIVRSFGTL | 13227 | 15 | Human | PSM | 391 | | | | | 517 |
| 68.0176 | NSRLLQERGVAYINA | 13228 | 15 | Human | PSM | 438 | 7997 | 3224 | 2616 | 12,812 | 620 |
| 68.0109 | ERGVAYINADSSIEG | 13229 | 15 | Human | PSM | 444 | — | — | — | — | — |
| 68.0110 | GVAYINADSSIEGNY | 13230 | 15 | Human | PSM | 446 | 6244 | — | 3048 | — | 5493 |
| 68.0177 | VAYINADSSIEGNYT | 13231 | 15 | Human | PSM | 447 | 9745 | — | 5467 | — | 8247 |
| 68.0111 | DSSIEGNYTLRVDCT | 13232 | 15 | Human | PSM | 453 | 14,458 | — | — | — | 8939 |
| 68.0112 | NYTLRVDCTPLMYSL | 13233 | 15 | Human | PSM | 459 | — | 6323 | — | 7116 | 594 |
| 68.0113 | CTPLMYSLVHNLTKE | 13234 | 15 | Human | PSM | 466 | 140 | 223 | 249 | 590 | 1728 |
| 68.0114 | DFEVFFQRLGIASGR | 13235 | 15 | Human | PSM | 520 | — | 122 | 2005 | 128 | 2005 |
| 68.0115 | EVFFQRLGIASGRAR | 13236 | 15 | Human | PSM | 522 | 5311 | 6.3 | 2976 | 31 | 2941 |
| 68.0116 | TNKFSGYPLYHSVYE | 13237 | 15 | Human | PSM | 543 | — | 614 | 741 | — | 4482 |
| 68.0117 | YDPMFKYHLTVAQVR | 13238 | 15 | Human | PSM | 566 | 158 | 172 | 179 | 252 | 240 |
| 68.0118 | DPMFKYHLTVAQVRG | 13239 | 15 | Human | PSM | 567 | 168 | 43 | 258 | 69 | 470 |
| 68.0119 | MFKYHLTVAQVRGGM | 13240 | 15 | Human | PSM | 569 | 72 | 70 | 266 | 147 | 482 |
| 68.0120 | KYHLTVAQVRGGMVF | 13241 | 15 | Human | PSM | 571 | 228 | 1519 | 5860 | 859 | 6376 |
| 68.0121 | VAQVRGGMVFELANS | 13242 | 15 | Human | PSM | 576 | 4449 | — | 499 | — | 7605 |
| 68.0122 | RGGMVFELANSIVLP | 13243 | 15 | Human | PSM | 580 | 41 | 8682 | 33 | — | 208 |
| 68.0123 | GMVFELANSIVLPFD | 13244 | 15 | Human | PSM | 582 | 30 | 4995 | 81 | — | 98 |

TABLE 186-continued

| Binding affinity of HLA-DR supertype and DR3 motif-positive peptides | | | | | | | | | | | | |
|---|---|---|---|---|---|---|---|---|---|---|---|---|
| 68.0124 | VFELANSIVLPFDCR | 13245 | 15 | Human | PSM | 584 | | 39 | — | 50 | 11,765 | 525 |
| 68.0125 | ADKIYSISMKHPQEM | 13246 | 15 | Human | PSM | 608 | | 4098 | 1136 | 3512 | 169 | 9246 |
| 68.0126 | IYSISMKHPQEMKTY | 13247 | 15 | Human | PSM | 611 | | 11,573 | 1357 | 12,293 | 213 | 11,436 |
| 68.0127 | PQEMKTYSVSFDSLF | 13248 | 15 | Human | PSM | 619 | | 1192 | — | 1981 | — | 5347 |
| 68.0128 | TYSVSFDSLFSAVKN | 13249 | 15 | Human | PSM | 624 | | 346 | 2256 | 526 | 5981 | 5277 |
| 68.0130 | VLRMMNDQLMFLERA | 13250 | 15 | Human | PSM | 660 | | 17,334 | 1700 | 10,684 | 2353 | 98 |
| 68.0131 | LRMMNDQLMFLERAF | 13251 | 15 | Human | PSM | 661 | | 17,507 | 2492 | 4601 | 1833 | 280 |
| 68.0181 | DQLMFLERAFIDPLG | 13252 | 15 | Human | PSM | 666 | | | | | | 146 |
| 68.0133 | RHVIYAPSSHNKYAG | 13253 | 15 | Human | PSM | 688 | | — | 11,667 | 481 | 13,363 | 7082 |
| 68.0134 | RQIYVAAFTVQAAAE | 13254 | 15 | Human | PSM | 730 | | 292 | 36 | 91 | 35 | 609 |
| 68.0135 | QIYVAAFTVQAAAET | 13255 | 15 | Human | PSM | 731 | | 324 | 102 | 65 | 34 | 934 |
| 68.0136 | VAAFTVQAAAETLSE | 13256 | 15 | Human | PSM | 734 | | 793 | 1420 | 127 | 2126 | 4461 |
| Peptide | Sequence | SEQ ID NO | AA | Organism | Protein | Position | Analog | DRB1 *1302 | DRB1 *1501 | DRB3 *0101 | DRB4 *0101 | DRB5 *0101 |
| F116.01 | MDIDPYKEFGATVELLSFLPSDFFP | 12669 | 25 | HBV | core | 1 | | 2415 | | | | |
| F209.01 | LETTMRSPVFTDNSSPPVVP | 12670 | 20 | HCV | | | | 125 | 16,646 | 2351 | 656 | — |
| F209.02 | AYAAQGYKVLVLNPSVAA | 12671 | 18 | HCV | | | | 9.1 | 873 | 1541 | 59 | 12,098 |
| F209.03 | TPAETTVRLRAYMNTPGLPV | 12672 | 20 | HCV | | | | 562 | 8.6 | 10,289 | 16 | 6815 |
| F209.04 | ENLPYLVAYQATVCARAQAP | 12673 | 20 | HCV | | | | 457 | 30 | — | 8.5 | 135 |
| F209.05 | GIQYLAGLSTLPGNPAIA | 12674 | 18 | HCV | | | | 5665 | 378 | — | 47 | 6785 |
| F209.06 | KGGRKPARLIVFPDLGVRVC | 12675 | 20 | HCV | | | | 33 | 50 | 3336 | 5.8 | 535 |
| F209.07 | CGKYLFNWAVRTKLKLTPIA | 12676 | 20 | HCV | | | | 118 | 122 | 8776 | 455 | 125 |
| 90.0062 | NGWFYVEAVIDRQTG | 12677 | 15 | HPV | E1 | 15 | | 4874 | — | | 14 | 558 |
| 90.0075 | TGWFEVEAVIERRTG | 12678 | 15 | HPV | E1 | 15 | | — | — | | — | 362 |
| 90.0029 | NGWFYVEAVVEKKTG | 12679 | 15 | HPV | E1 | 16 | | 5491 | — | | 4759 | 116 |
| 90.0126 | EDEIDTDLDGFIDDS | 12680 | 15 | HPV | E1 | 40 | | 67 | 270 | | 823 | 2127 |
| 90.0077 | LLEFIDDSMENSIQA | 12681 | 15 | HPV | E1 | 47 | | — | 6118 | | 734 | — |
| 89.0078 | VDFIDTQLSICEQAE | 12682 | 15 | HPV | E1 | 48 | | 1548 | 609 | | 471 | 1518 |
| 90.0031 | VDFIVNDNDYLTQAE | 12683 | 15 | HPV | E1 | 49 | | 204 | — | | 718 | — |
| 90.0078 | ENSIQADTEAARALF | 12684 | 15 | HPV | E1 | 56 | | — | — | | — | — |
| 89.0022 | QAELETAQALFHAQE | 12685 | 15 | HPV | E1 | 60 | | 2779 | — | | 72 | 1947 |
| 89.0114 | GQQLLQVQTAHADKQ | 12686 | 15 | HPV | E1 | 66 | | 62 | — | | 1178 | — |
| 89.0115 | QQLLQVQTAHADKQT | 12687 | 15 | HPV | E1 | 67 | | — | 10,458 | | 932 | 86 |
| 89.0001 | HALFTAQEAKQHRDA | 12688 | 15 | HPV | E1 | 68 | | — | — | | — | 7160 |
| 90.0047 | AQEVHNDAQVLHVLK | 12689 | 15 | HPV | E1 | 72 | | 597 | 2545 | | 143 | — |
| 89.0093 | EDDLHAVSAVICRICET | 12690 | 15 | HPV | E1 | 76 | | 8214 | 5157 | | 2302 | 35 |
| 90.0048 | GERLEVDTELSPRLQ | 12691 | 15 | HPV | E1 | 100 | | — | — | | — | — |
| 90.0129 | QQTVCREGVKRRLIL | 12692 | 15 | HPV | E1 | 100 | | — | — | | 11 | — |
| 90.0064 | LKAICIENNSKTAKR | 12693 | 15 | HPV | E1 | 109 | | 144 | 359 | | 85 | 1029 |
| 90.0032 | LKAICIEKQSRAAKR | 12694 | 15 | HPV | E1 | 110 | | 2129 | 2057 | | 29 | 2425 |
| 89.0039 | NTEVETQQMVQVEEQ | 12695 | 15 | HPV | E1 | 135 | | — | — | | 676 | — |
| 89.0059 | NTEVETQQMVQQVES | 12696 | 15 | HPV | E1 | 135 | | 8334 | — | | 296 | — |
| 89.0002 | NTEVETQQMLQVEGR | 12697 | 15 | HPV | E1 | 136 | | 2327 | 15,460 | | 658 | — |
| 89.0040 | MVQVEEQQTTLSCNG | 12698 | 15 | HPV | E1 | 143 | | — | — | | 129 | — |
| 89.0041 | LYGVSFMELIRPFQS | 12699 | 15 | HPV | E1 | 194 | | — | 1553 | | 2.2 | 6040 |
| 89.0003 | LNVLKTSNAKAAMLA | 12700 | 15 | HPV | E1 | 195 | | 8.9 | 145 | | 509 | 768 |
| 89.0140 | TLLYKFKEAYGVSFM | 12701 | 15 | HPV | E1 | 199 | | 192 | — | | 2306 | — |
| 89.0094 | TVLFKFKETYGVSFM | 12702 | 15 | HPV | E1 | 202 | | 846 | 11,089 | | 3087 | 431 |
| 89.0060 | AYGISFMELVRPFKS | 12703 | 15 | HPV | E1 | 207 | | 4488 | 1824 | | 31 | 3028 |

TABLE 186-continued

Binding affinity of HLA-DR supertype and DR3 motif-positive peptides

| | | | | | | | | | | |
|---|---|---|---|---|---|---|---|---|---|---|
| 89.0095 | TYGVSFMELVRPFKS | 12704 | 15 | HPV | E1 | 210 | 598 | 592 | 389 | 9070 |
| 90.0050 | MLAVFKDTYGLSFTD | 12705 | 15 | HPV | E1 | 214 | 1245 | 316 | — | 18,269 |
| 89.0042 | DWCVAAFGVTGTVAE | 12706 | 15 | HPV | E1 | 215 | — | 64 | 601 | 8655 |
| 89.0079 | DWVMAIFGVNPTVAE | 12707 | 15 | HPV | E1 | 228 | 60 | 26 | 6.5 | 247 |
| 89.0080 | VMAIFGVNPTVAEGF | 12708 | 15 | HPV | E1 | 230 | 33 | 118 | 80 | 19,417 |
| 90.0051 | VRNFKSDKTTCTDWV | 12709 | 15 | HPV | E1 | 230 | 394 | 249 | — | — |
| 89.0081 | MAIFGVNPTVAEGFK | 12710 | 15 | HPV | E1 | 231 | 35 | 1047 | 426 | 9516 |
| 89.0096 | DWCIIGMGVTPSVAE | 12711 | 15 | HPV | E1 | 231 | 4343 | 8308 | 190 | — |
| 89.0097 | WCIIGMGVTPSVAEG | 12712 | 15 | HPV | E1 | 232 | 2090 | — | 296 | — |
| 89.0119 | LKTIIKPHCMYYHMQ | 12713 | 15 | HPV | E1 | 238 | 104 | 17,411 | 1682 | — |
| 89.0023 | VTAIFGVNPTIAEGF | 12714 | 15 | HPV | E1 | 244 | 193 | 5699 | 544 | — |
| 89.0061 | LKVLIKQHSLYTHLQ | 12715 | 15 | HPV | E1 | 244 | 30 | 18 | 11 | 1942 |
| 89.0082 | FKTLIKPATLYAHIQ | 12716 | 15 | HPV | E1 | 244 | 45 | 1611 | 20 | 2431 |
| 89.0142 | LKVLIKQHSIYTHLQ | 12717 | 15 | HPV | E1 | 244 | 448 | — | — | — |
| 89.0024 | TAIFGVNPTIAEGFK | 12718 | 15 | HPV | E1 | 245 | 118 | 11,454 | 592 | 17,868 |
| 89.0083 | KTLIKPATLYAHIQC | 12719 | 15 | HPV | E1 | 245 | 132 | 654 | 51 | 5230 |
| 89.0098 | LKVLIQPYSIYAHLQ | 12720 | 15 | HPV | E1 | 247 | 677 | 79 | 1133 | 993 |
| 89.0043 | ACSWGMVMLMLVRFK | 12721 | 15 | HPV | E1 | 248 | 244 | 5088 | 467 | 5633 |
| 89.0044 | SWGMVMLMLVRFKCA | 12722 | 15 | HPV | E1 | 250 | 975 | 12,502 | 1438 | 5057 |
| 89.0025 | FKTLIQPFILYAHIQ | 12723 | 15 | HPV | E1 | 258 | 1151 | 20 | 9.6 | 8428 |
| 89.0062 | DRGIIILLLIRFRCS | 12724 | 15 | HPV | E1 | 263 | — | 14,410 | 7561 | — |
| 89.0063 | RGIIILLLIRFRCSK | 12725 | 15 | HPV | E1 | 264 | 352 | 431 | 283 | — |
| 89.0099 | DRGVLILLLIRFKCG | 12726 | 15 | HPV | E1 | 266 | 3644 | 426 | 169 | 83 |
| 89.0004 | ACSWGMVVLLLVRYK | 12727 | 15 | HPV | E1 | 268 | 355 | 870 | 1520 | — |
| 89.0005 | SWGMVVLLLVRYKCG | 12728 | 15 | HPV | E1 | 270 | 727 | 4149 | 4203 | — |
| 89.0045 | EKLLEKLLCISTNCM | 12729 | 15 | HPV | E1 | 271 | 823 | 6124 | 1060 | — |
| 89.0123 | RKTIAKALSSILNVP | 12730 | 15 | HPV | E1 | 274 | — | — | 746 | 6637 |
| 89.0026 | DCKWGVLILALLRYK | 12731 | 15 | HPV | E1 | 275 | 786 | 410 | 213 | 1124 |
| 89.0027 | KWGVLILALLRYKCG | 12732 | 15 | HPV | E1 | 277 | 571 | 3743 | 889 | 569 |
| 89.0064 | KNRLTVAKLMSNLLS | 12733 | 15 | HPV | E1 | 278 | 14 | 172 | 25 | 3462 |
| 89.0065 | RLTVAKLMSNLLSIP | 12734 | 15 | HPV | E1 | 280 | 7.2 | 9.5 | 4.0 | 498 |
| 89.0046 | TNCMLIQPPKLRSTA | 12735 | 15 | HPV | E1 | 282 | 5099 | 5121 | 479 | 111 |
| 89.0100 | RLTVSKLMSQLLNIP | 12736 | 15 | HPV | E1 | 283 | 7.3 | — | 4819 | — |
| 89.0047 | CMLIQPPKLRSTAAA | 12737 | 15 | HPV | E1 | 284 | 3613 | 2645 | 567 | 904 |
| 89.0066 | AKLMSNLLSIPETCM | 12738 | 15 | HPV | E1 | 284 | 12 | 3432 | 421 | — |
| 89.0101 | VSKLMSQLLNIPETH | 12739 | 15 | HPV | E1 | 286 | 9527 | — | — | — |
| 89.0006 | RETIEKLLSKLLCVS | 12740 | 15 | HPV | E1 | 287 | 600 | 232 | 1048 | 7068 |
| 89.0067 | SNLLSIPETCMVIEP | 12741 | 15 | HPV | E1 | 288 | 350 | 510 | 963 | — |
| 89.0124 | QEQMLIQPPKIRSPA | 12742 | 15 | HPV | E1 | 289 | — | — | 1640 | 441 |
| 89.0007 | EKLLSKLLCVSPMCM | 12743 | 15 | HPV | E1 | 291 | 124 | 12,139 | 720 | — |
| 89.0102 | SQLLNIPETHMVIEP | 12744 | 15 | HPV | E1 | 291 | — | — | 807 | — |
| 89.0028 | RLTVAKGLSTLLHVP | 12745 | 15 | HPV | E1 | 294 | 675 | 145 | 406 | 1708 |
| 89.0084 | ETCMLIEPPKLRSSV | 12746 | 15 | HPV | E1 | 295 | 481 | 227 | 48 | 588 |
| 90.0083 | ETCMVIEPPKLRSQT | 12747 | 15 | HPV | E1 | 295 | — | 670 | 16 | 124 |
| 89.0103 | ETHMVIEPPKLRSAT | 12748 | 15 | HPV | E1 | 298 | 1460 | 4143 | 3913 | 2870 |
| 90.0034 | PMCMMIEPPKLRSTA | 12749 | 15 | HPV | E1 | 302 | 1576 | 3341 | 196 | 271 |
| 89.0029 | ETCMLIQPPKLRSSV | 12750 | 15 | HPV | E1 | 309 | 3053 | 1703 | 81 | 115 |
| 89.0048 | TPEWIERQTVLQHSF | 12751 | 15 | HPV | E1 | 316 | 5477 | 6064 | 19 | — |
| 89.0049 | PEWIERQTVLQHSFN | 12752 | 15 | HPV | E1 | 317 | 938 | 12,125 | 2.0 | — |
| 89.0009 | LYWYKTGISNISEVY | 12753 | 15 | HPV | E1 | 319 | 319 | 5772 | 317 | 634 |
| 89.0069 | TPEWIDRLTVLQHSF | 12754 | 15 | HPV | E1 | 329 | 8860 | 3835 | 122 | — |

TABLE 186-continued

| Binding affinity of HLA-DR supertype and DR3 motif-positive peptides | | | | | | | | | | |
|---|---|---|---|---|---|---|---|---|---|---|
| 90.0035 | ISEVYGDTPEWIQRQ | 12755 | 15 | HPV | E1 | 329 | 6.9 | — | 1070 | — |
| 89.0070 | PEWIDRLTVLQHSFN | 12756 | 15 | HPV | E1 | 330 | 1190 | 982 | 13 | — |
| 89.0050 | DTTFDLSQMVQWAYD | 12757 | 15 | HPV | E1 | 332 | — | 918 | 154 | — |
| 89.0104 | TPEWIEQQTVLQHSF | 12758 | 15 | HPV | E1 | 332 | — | 13,043 | — | 5460 |
| 89.0105 | PEWIEQQTVLQHSFD | 12759 | 15 | HPV | E1 | 333 | 1314 | 11,305 | 980 | — |
| 89.0010 | TPEWIQRQTVLQHSF | 12760 | 15 | HPV | E1 | 336 | 2102 | — | 33 | 4118 |
| 90.0052 | ISEVMGDTPEWIQRL | 12761 | 15 | HPV | E1 | 336 | 9.0 | 6834 | 2042 | — |
| 89.0011 | PEWIQRQTVLQHSFN | 12762 | 15 | HPV | E1 | 337 | 473 | 8858 | 4.5 | 11,808 |
| 90.0152 | QHSFNDDIFDLSEMI | 12763 | 15 | HPV | E1 | 340 | 17 | 688 | 2.1 | — |
| 89.0030 | TPEWIQRLTIIQHGI | 12764 | 15 | HPV | E1 | 343 | 413 | 17,631 | 6.8 | 5893 |
| 89.0031 | PEWIQRLTIIQHGID | 12765 | 15 | HPV | E1 | 344 | 558 | 3425 | 3.3 | 240 |
| 90.0069 | DNDVMDDSEIAYKYA | 12766 | 15 | HPV | E1 | 346 | — | 8224 | — | — |
| 89.0106 | NSIFDFGEMVQWAYD | 12767 | 15 | HPV | E1 | 348 | 532 | 9975 | 3951 | — |
| 89.0051 | DSEIAYKYAQLADSD | 12768 | 15 | HPV | E1 | 352 | — | 1091 | 1343 | — |
| 89.0130 | DSQIAFQYAQLADVD | 12769 | 15 | HPV | E1 | 359 | — | — | 14 | 17,083 |
| 90.0085 | DNELTDDSDIAYYYA | 12770 | 15 | HPV | E1 | 359 | — | 1060 | — | — |
| 90.0036 | QWAYDNDIVDDSEIA | 12771 | 15 | HPV | E1 | 362 | — | — | — | — |
| 90.0117 | DHDITDDSDIAYKYA | 12772 | 15 | HPV | E1 | 362 | 535 | — | 577 | 6834 |
| 89.0071 | DSDIAYYYAQLADSN | 12773 | 15 | HPV | E1 | 365 | — | 13 | 978 | — |
| 89.0085 | ESDMAFQYAQLADCN | 12774 | 15 | HPV | E1 | 365 | 224 | 7421 | 48 | 7686 |
| 90.0037 | DNDIVDDSEIAYKYA | 12775 | 15 | HPV | E1 | 366 | — | 10,359 | — | — |
| 89.0072 | IAYYYAQLADSNSNA | 12776 | 15 | HPV | E1 | 368 | — | 97 | 2392 | — |
| 89.0108 | DIAYKYAQLADVNSN | 12777 | 15 | HPV | E1 | 370 | — | — | 295 | 150 |
| 89.0012 | DSEIAYKYAQLADTN | 12778 | 15 | HPV | E1 | 372 | — | 3439 | 275 | 19,647 |
| 90.0070 | QAKIVKDCGTMCRHY | 12779 | 15 | HPV | E1 | 378 | — | 8632 | — | 6630 |
| 90.0055 | ESDMAFEYALLADSN | 12780 | 15 | HPV | E1 | 379 | 1851 | 428 | 165 | 13,102 |
| 90.0139 | QAKYVKDCGIMCRHY | 12781 | 15 | HPV | E1 | 385 | 0.44 | 976 | 7.3 | — |
| 90.0086 | QAKIVKDCGIMCRHY | 12782 | 15 | HPV | E1 | 391 | 719 | 2502 | 5415 | — |
| 90.0103 | QAKYLKDCAVMCRHY | 12783 | 15 | HPV | E1 | 391 | 2482 | 978 | 315 | 499 |
| 90.0038 | QAKIVKDCATMCRHY | 12784 | 15 | HPV | E1 | 398 | — | — | — | 8388 |
| 89.0052 | VKFLRYQQIEFVSFL | 12785 | 15 | HPV | E1 | 423 | 24 | 535 | 2.0 | 11,212 |
| 89.0053 | VSFLSALKLFLKGVP | 12786 | 15 | HPV | E1 | 434 | 1320 | 1451 | 23 | 1293 |
| 89.0013 | GGDWKQIVMFLRYQG | 12787 | 15 | HPV | E1 | 436 | 899 | 176 | 7.9 | 14 |
| 89.0054 | LKLFLKGVPKKNCIL | 12788 | 15 | HPV | E1 | 440 | 3385 | 3355 | 619 | 385 |
| 89.0014 | VMFLRYQGVEFMSFL | 12789 | 15 | HPV | E1 | 443 | 278 | 30 | 13 | 701 |
| 89.0132 | FLSYFKLFLQGTPKH | 12790 | 15 | HPV | E1 | 443 | 1298 | — | 8.7 | — |
| 89.0133 | YFKLFLQGTPKHNCL | 12791 | 15 | HPV | E1 | 446 | 193 | — | 81 | — |
| 89.0134 | FKLFLQGTPICHNCLV | 12792 | 15 | HPV | E1 | 447 | 262 | 564 | 1636 | — |
| 89.0055 | KNCILIHGAPNTGKS | 12793 | 15 | HPV | E1 | 450 | 8907 | 1400 | 577 | — |
| 89.0015 | VEFMSFLTALKRFLQ | 12794 | 15 | HPV | E1 | 451 | 9817 | 1836 | 42 | 19 |
| 89.0073 | FKKFLKGIPKKSCML | 12795 | 15 | HPV | E1 | 453 | 2658 | 508 | 2218 | 66 |
| 89.0086 | LKEFLKGTPKKNCIL | 12796 | 15 | HPV | E1 | 453 | 6610 | 7808 | 2415 | 4661 |
| 89.0033 | IEFITFLGALKSFLK | 12797 | 15 | HPV | E1 | 458 | — | 77 | 44 | 34 |
| 89.0016 | LKRFLQGIPKKNCIL | 12798 | 15 | HPV | E1 | 460 | — | 3621 | 1702 | 5.5 |
| 89.0034 | ITFLGALKSFLKGTP | 12799 | 15 | HPV | E1 | 461 | — | 128 | 1497 | 19 |
| 89.0056 | GKSYFGMSLISFLQG | 12800 | 15 | HPV | E1 | 462 | 1343 | 4785 | 1958 | — |
| 89.0074 | SCMLICGPANTGKSY | 12801 | 15 | HPV | E1 | 464 | 2434 | 3344 | 1258 | 16,006 |
| 89.0087 | NCILLYGPANTGKSY | 12802 | 15 | HPV | E1 | 464 | 1378 | 66 | 676 | 6465 |
| 89.0035 | LKSFLKGTPKKNCLV | 12803 | 15 | HPV | E1 | 467 | 430 | 5187 | 4738 | 664 |
| 89.0017 | NCILLYGAANTGKSL | 12804 | 15 | HPV | E1 | 471 | 2117 | 526 | 525 | 442 |
| 89.0018 | ILLYGAANTGKSLFG | 12805 | 15 | HPV | E1 | 473 | 2694 | 167 | 5056 | 1578 |

TABLE 186-continued

Binding affinity of HLA-DR supertype and DR3 motif-positive peptides

| | | | | | | | | | | | |
|---|---|---|---|---|---|---|---|---|---|---|---|
| 89.0075 | GKSYFGMSLIQFLKG | 12806 | 15 | HPV | E1 | 475 | 1032 | 1050 | | 372 | 411 |
| 89.0146 | GKSYFGMSLIHFLKG | 12807 | 15 | HPV | E1 | 475 | — | — | | 2080 | — |
| 89.0135 | LIKFFQGSVISFVNS | 12808 | 15 | HPV | E1 | 477 | 71 | — | | 3731 | — |
| 89.0136 | IKFFQGSVISFVNSQ | 12809 | 15 | HPV | E1 | 478 | 11 | — | | 745 | 5504 |
| 89.0019 | GKSLFGMSLMKFLQG | 12810 | 15 | HPV | E1 | 482 | 2033 | 2775 | | 369 | 513 |
| 89.0020 | KSLFGMSLMKFLQGS | 12811 | 15 | HPV | E1 | 483 | 4674 | 2106 | | 449 | 1192 |
| 89.0088 | FIHFLQGAIISFVNS | 12812 | 15 | HPV | E1 | 483 | 1590 | 843 | | 1682 | — |
| 89.0076 | IQFLKGCVISCVNSK | 12813 | 15 | HPV | E1 | 484 | 609 | 403 | | 1021 | 2460 |
| 89.0089 | IHFLQGAIISFVNSN | 12814 | 15 | HPV | E1 | 484 | 442 | 54 | | 272 | — |
| 89.0147 | IHFLKGCIISYVNSK | 12815 | 15 | HPV | E1 | 484 | — | — | | 1357 | — |
| 89.0036 | FIHFIQGAVISFVNS | 12816 | 15 | HPV | E1 | 497 | 97 | 677 | | 130 | 6018 |
| 89.0037 | IHFIQGAVISFVNST | 12817 | 15 | HPV | E1 | 498 | 296 | 6976 | | 155 | — |
| 90.0087 | KIGMIDDVTPISWTY | 12818 | 15 | HPV | E1 | 510 | 9.8 | 4465 | | 3115 | — |
| 90.0105 | KVAMLDDATHTCWTY | 12819 | 15 | HPV | E1 | 510 | — | 2231 | | 21 | — |
| 90.0040 | KIGMLDDATVPCWNY | 12820 | 15 | HPV | E1 | 517 | — | — | | 2079 | — |
| 89.0090 | CWTYFDNYMRNALDG | 12821 | 15 | HPV | E1 | 521 | — | 2178 | | 2040 | 7274 |
| 89.0137 | RNLVDGNPISLDRKH | 12822 | 15 | HPV | E1 | 524 | — | — | | 992 | — |
| 90.0059 | KVAMLDDATTCWTY | 12823 | 15 | HPV | E1 | 524 | 2930 | 10,714 | | 477 | — |
| 90.0041 | CWNYIDDNLRNALDG | 12824 | 15 | HPV | E1 | 528 | — | — | | — | — |
| 89.0057 | LMQLKCPPLLITSNI | 12825 | 15 | HPV | E1 | 534 | 123 | 160 | | 68 | — |
| 89.0138 | LVQIKCPPLLITTNI | 12826 | 15 | HPV | E1 | 541 | — | — | | 18 | — |
| 89.0077 | LVQLKCPPLLLTSNT | 12827 | 15 | HPV | E1 | 547 | 2005 | 774 | | 307 | 4485 |
| 89.0091 | LLQLKCPPILLTSNI | 12828 | 15 | HPV | E1 | 547 | 3085 | 1081 | | 122 | — |
| 89.0139 | PPLLITTNINPMLDA | 12829 | 15 | HPV | E1 | 547 | — | 4780 | | 313 | 5021 |
| 89.0058 | DDRWPYLHSRLVVFT | 12830 | 15 | HPV | E1 | 553 | 2189 | 284 | | 297 | — |
| 89.0021 | LVQLKCPPLLITSNI | 12831 | 15 | HPV | E1 | 554 | 423 | 1533 | | 234 | — |
| 89.0038 | LIQLKCPPILLTTNI | 12832 | 15 | HPV | E1 | 561 | — | 6801 | | 158 | — |
| 89.0113 | DPRWPYLHSRLVVFH | 12833 | 15 | HPV | E1 | 569 | 13 | 2949 | | 98 | 1789 |
| 89.0092 | VTVFTFPHAFPFDKN | 12834 | 15 | HPV | E1 | 576 | — | 63 | | 1496 | 226 |
| 90.0106 | PHAFPFDKNGNPVYE | 12835 | 15 | HPV | E1 | 582 | 1392 | 2786 | | 1645 | — |
| 90.0144 | RLNLDNDEDKENNGD | 12836 | 15 | HPV | E1 | 606 | 1391 | 581 | | 25 | 745 |
| 1601.21 | LSQRLNVCQDKILEH | 12837 | 15 | HPV | E2 | 4 | — | — | — | 5030 | — |
| 90.0160 | RLNVCQDKILTHYEN | 12838 | 15 | HPV | E2 | 7 | 96 | 3800 | | 0.61 | 1639 |
| 1601.01 | YENDSTDLRDHIDYW | 12839 | 15 | HPV | E2 | 19 | — | — | 8545 | 425 | — |
| 1601.29 | LDHYENDSKDINSQI | 12840 | 15 | HPV | E2 | 22 | — | — | 2049 | 554 | — |
| 90.0021 | HWKLIRMECAIMYTA | 12841 | 15 | HPV | E2 | 32 | 54 | 3840 | | 161 | 3072 |
| 90.0199 | WKLIRMECALLYTAK | 12842 | 15 | HPV | E2 | 33 | 98 | 509 | | 62 | 3628 |
| 90.0230 | WKAVRHENVLYYKAR | 12843 | 15 | HPV | E2 | 33 | 264 | 129 | | 189 | 762 |
| 90.0245 | WKLIRMECAIMYTAR | 12844 | 15 | HPV | E2 | 33 | 116 | 2111 | | 27 | 1243 |
| 1601.44 | KHIRLLECVLMYKARE | 12845 | 16 | HPV | E2 | 34 | 418 | 74 | 1077 | 39 | 1632 |
| 89.0179 | LIRMECALLYTAKQM | 12846 | 15 | HPV | E2 | 35 | — | — | | — | — |
| 90.0022 | LIRMECAIMYTARQM | 12847 | 15 | HPV | E2 | 35 | 241 | 1482 | | 158 | 6468 |
| 90.0211 | WQLIRLENAILFTAR | 12848 | 15 | HPV | E2 | 39 | 2.7 | 44 | | 20 | 445 |
| 90.0002 | LIRLENAILFTAREH | 12849 | 15 | HPV | E2 | 41 | 51 | 2069 | | 339 | 4272 |
| 90.0010 | ITHIGHQVVPPMAVS | 12850 | 15 | HPV | E2 | 51 | 1049 | 10,067 | | 1218 | — |
| 89.0168 | NHQVVPALSVSKAKA | 12851 | 15 | HPV | E2 | 55 | 900 | 7342 | | — | — |
| 90.0011 | GHQVVPPMAVSKAKA | 12852 | 15 | HPV | E2 | 55 | 2582 | 10,923 | | 66 | 5316 |
| 89.0169 | HQVVPALSVSKAKAL | 12853 | 15 | HPV | E2 | 56 | 881 | — | | — | — |
| 90.0012 | HQVVPPMAVSKAKAC | 12854 | 15 | HPV | E2 | 56 | 908 | — | | 645 | 5787 |
| 90.0023 | HQVVPSLVASKTKAF | 12855 | 15 | HPV | E2 | 56 | 365 | — | | — | — |
| 89.0150 | TLAVSKNKALQAIEL | 12856 | 15 | HPV | E2 | 61 | 1286 | — | | 36 | — |

TABLE 186-continued

Binding affinity of HLA-DR supertype and DR3 motif-positive peptides

| | | | | | | | | | | |
|---|---|---|---|---|---|---|---|---|---|---|
| 89.0170 | ALSVSKAKALQAIEL | 12857 | 15 | HPV | E2 | 61 | 1626 | — | | — | — |
| 90.0013 | PMAVSKAKACQAIEL | 12858 | 15 | HPV | E2 | 61 | 535 | 16,593 | | 1590 | 12,785 |
| 89.0159 | AYNISKSKAHKAIEL | 12859 | 15 | HPV | E2 | 65 | — | — | | — | — |
| 89.0151 | NKALQAIELQLTLET | 12860 | 15 | HPV | E2 | 67 | 1801 | — | | 32 | 462 |
| 89.0171 | AKALQAIELQMMLET | 12861 | 15 | HPV | E2 | 67 | 506 | 8485 | | 2550 | 284 |
| 1601.30 | PINISKSKAHKAIEL | 12862 | 15 | HPV | E2 | 67 | 309 | 231 | — | 1724 | 452 |
| 89.0181 | AFQVIELQMALETLS | 12863 | 15 | HPV | E2 | 69 | 142 | — | | 349 | 1690 |
| 90.0024 | AFQVIELQMALETLN | 12864 | 15 | HPV | E2 | 69 | 89 | 378 | | 11 | — |
| 89.0182 | FQVIELQMALETLSK | 12865 | 15 | HPV | E2 | 70 | — | 13,991 | | — | 3511 |
| 90.0014 | CQAIELQLALEALNK | 12866 | 15 | HPV | E2 | 70 | 214 | 200 | | 14 | 1905 |
| 90.0018 | CSAIEVQIALESLST | 12867 | 15 | HPV | E2 | 70 | 617 | — | | 29 | — |
| 90.0025 | FQVIELQMALETLNA | 12868 | 15 | HPV | E2 | 70 | 187 | 449 | | 15 | — |
| 89.0160 | HKAIELQMALQGLAQ | 12869 | 15 | HPV | E2 | 74 | 3956 | 1285 | | 3473 | — |
| 89.0183 | ELQMALETLSKSQYS | 12870 | 15 | HPV | E2 | 74 | 4300 | 1379 | | — | 10,600 |
| 90.0231 | EVQIALESLSTTIYN | 12871 | 15 | HPV | E2 | 74 | 4.3 | 1152 | | 39 | — |
| 90.0004 | HKAIELQMALKGLAQ | 12872 | 15 | HPV | E2 | 76 | 337 | 6582 | | 1.0 | 57 |
| 1601.22 | QMMLETLNNTEYKNE | 12873 | 15 | HPV | E2 | 76 | 14,655 | — | — | 555 | — |
| 1601.03 | LETIYNSQYSNEKWT | 12874 | 15 | HPV | E2 | 79 | 6796 | 563 | — | 17,739 | 208 |
| 90.0005 | ELQMALKGLAQSKYN | 12875 | 15 | HPV | E2 | 80 | 10,028 | — | | 192 | 475 |
| 90.0232 | TTIYNNEEWTLRDTC | 12876 | 15 | HPV | E2 | 84 | 1011 | 10,197 | | — | — |
| 90.0179 | QSRYKTEDWTLQDTC | 12877 | 15 | HPV | E2 | 88 | 71 | 345 | | 133 | — |
| 1601.23 | PTGCLKKHGYTVEVQ | 12878 | 15 | HPV | E2 | 106 | 82 | 1714 | — | 7471 | — |
| 90.0026 | QKCFKKKGITVTVQY | 12879 | 15 | HPV | E2 | 107 | 837 | — | | 1308 | — |
| 90.0167 | TVEVQFDGDICNTMH | 12880 | 15 | HPV | E2 | 116 | 39 | 5077 | | 235 | — |
| 1601.04 | DICNTMHYTNWTHIY | 12881 | 15 | HPV | E2 | 124 | 1039 | 2132 | 7200 | 6054 | — |
| 1601.09 | GNKDNCMTYVAWDSV | 12882 | 15 | HPV | E2 | 127 | — | 461 | — | 41 | — |
| 90.0202 | GEIYIIEEDTCTMVT | 12883 | 15 | HPV | E2 | 135 | 426 | — | | 322 | — |
| 90.0214 | MNYVVWDSIYYITET | 12884 | 15 | HPV | E2 | 135 | 17 | 3086 | | 769 | 18,262 |
| 90.0250 | SEIYIIEETTCTLVA | 12885 | 15 | HPV | E2 | 135 | 399 | 5267 | | 231 | — |
| 90.0203 | EIYIIEEDTCTMVTG | 12886 | 15 | HPV | E2 | 136 | 577 | 6503 | | 1738 | — |
| 90.0251 | EIYIIEETTCTLVAG | 12887 | 15 | HPV | E2 | 136 | 1115 | 15,184 | | 1095 | — |
| 1601.10 | VAWDSVYYMTDAGTW | 12888 | 15 | HPV | E2 | 136 | — | — | 344 | 2178 | — |
| 90.0204 | IYIIEEDTCTMVTGK | 12889 | 15 | HPV | E2 | 137 | 994 | 18,667 | | 1262 | — |
| 90.0182 | SVYYMTDAGTWDKTA | 12890 | 15 | HPV | E2 | 140 | 14 | 43 | | 7.0 | — |
| 90.0252 | CTLVAGEVDYVGLYY | 12891 | 15 | HPV | E2 | 145 | 714 | — | | 20 | — |
| 90.0171 | GLYYVHEGIRTYFVQ | 12892 | 15 | HPV | E2 | 156 | 532 | 1624 | | 1.9 | — |
| 90.0226 | GLYYWCDGEKIYFVK | 12893 | 15 | HPV | E2 | 156 | 3282 | 1296 | | — | — |
| 1601.05 | VHEGIRTYFVQFKDD | 12894 | 15 | HPV | E2 | 160 | 16,900 | 38 | 9916 | 1803 | — |
| 90.0216 | GVYYIKDGDTTYYVQ | 12895 | 15 | HPV | E2 | 163 | 269 | — | | — | — |
| 90.0205 | YFKYFKEDAAKYSKT | 12896 | 15 | HPV | E2 | 167 | — | 3906 | | — | 4663 |
| 90.0253 | YFKYFKEDAKKYSKT | 12897 | 15 | HPV | E2 | 167 | — | — | | — | 289 |
| 90.0206 | FKYFKEDAAKYSKTQ | 12898 | 15 | HPV | E2 | 168 | 1704 | 865 | | — | 314 |
| 1601.11 | EKYGNTGTWEVHFGN | 12899 | 15 | HPV | E2 | 181 | — | — | — | — | — |
| 90.0237 | IWEVHMENESIYCPD | 12900 | 15 | HPV | E2 | 183 | 1962 | — | | 1263 | — |
| 89.0184 | EVHVGGQVIVCPTSI | 12901 | 15 | HPV | E2 | 185 | — | — | | — | — |
| 90.0015 | EVHVGGQVIVCPASV | 12902 | 15 | HPV | E2 | 185 | 152 | — | | 389 | — |
| 90.0238 | EVHMENESIYCPDSV | 12903 | 15 | HPV | E2 | 185 | 2374 | 516 | | — | — |
| 89.0173 | GQVIVFPESVFSSDE | 12904 | 15 | HPV | E2 | 190 | — | — | | — | — |
| 89.0185 | GQVIVCPTSISSNQI | 12905 | 15 | HPV | E2 | 190 | 1328 | 3765 | | 1753 | 2484 |
| 90.0016 | GQVIVCPASVSSNEV | 12906 | 15 | HPV | E2 | 190 | 94 | 461 | | 197 | 8644 |
| 90.0027 | SRVIVCPTSIPSDQI | 12907 | 15 | HPV | E2 | 190 | 1999 | — | | — | — |

TABLE 186-continued

Binding affinity of HLA-DR supertype and DR3 motif-positive peptides

| | | | | | | | | | | | |
|---|---|---|---|---|---|---|---|---|---|---|---|
| 90.0195 | ESVFSSDEISFAGIV | 12908 | 15 | HPV | E2 | 197 | 235 | 1979 | | 1316 | — |
| 1601.06 | SNEVSSPEIIRQHLA | 12909 | 15 | HPV | E2 | 202 | 6877 | 5364 | — | 13 | — |
| 1601.45 | SDEISFAGIVTKLPT | 12910 | 15 | HPV | E2 | 202 | 1062 | 791 | — | 14,194 | 408 |
| 89.0174 | EISFAGIVTKLPTAN | 12911 | 15 | HPV | E2 | 204 | 2508 | 8142 | 70 | — | |
| 89.0175 | FAGIVTKLPTANNTT | 12912 | 15 | HPV | E2 | 207 | 129 | 2551 | 1792 | 1204 | |
| 1601.13 | SDDTVSATQLVKQLQ | 12913 | 15 | HPV | E2 | 208 | 16,469 | — | — | 26 | — |
| 1601.31 | STSDDTVSATQIVRQ | 12914 | 15 | HPV | E2 | 208 | — | — | — | 446 | — |
| 89.0162 | DDTVSATQLVKQLQH | 12915 | 15 | HPV | E2 | 209 | 73 | 601 | | 128 | 578 |
| 89.0155 | RQHLANHPAATHTKA | 12916 | 15 | HPV | E2 | 212 | 878 | 8661 | | — | — |
| 89.0163 | TVSVGTAKTYGQTSA | 12917 | 15 | HPV | E2 | 231 | — | 8709 | | 229 | — |
| 90.0208 | TKLFCADPALDNRTA | 12918 | 15 | HPV | E2 | 241 | — | — | | — | — |
| 89,0186 | DPALDNRTARTATNC | 12919 | 15 | HPV | E2 | 247 | 1405 | — | | — | 385 |
| 1601.07 | PCHTTKLLHRDSVDS | 12920 | 15 | HPV | E2 | 250 | — | — | — | 672 | — |
| 89.0156 | RDSVDSAPILTAFNS | 12921 | 15 | HPV | E2 | 259 | 25 | 4838 | | 1306 | — |
| 1601.34 | GRVNTHVHNPLLCSS | 12922 | 15 | HPV | E2 | 262 | 865 | 625 | — | 5985 | — |
| 89.0165 | NPLLGAATPTGNNKR | 12923 | 15 | HPV | E2 | 264 | — | 414 | | 10,358 | — |
| 1601.24 | DSVDSVNCGVISAAA | 12924 | 15 | HPV | E2 | 265 | 736 | — | — | 8706 | — |
| 1601.16 | KRRKLCSGNTTPIIH | 12925 | 15 | HPV | E2 | 277 | 7.6 | 9334 | — | — | 4978 |
| 1601.08 | NCNSNTTPIVHLKGD | 12926 | 15 | HPV | E2 | 280 | 353 | — | — | 2637 | — |
| 1601.35 | NKRRKVCSGNTTPII | 12927 | 15 | HPV | E2 | 280 | 9.0 | — | — | — | — |
| 90.0255 | IVHLKGDPNSLKCLR | 12928 | 15 | HPV | E2 | 281 | 574 | 7826 | | 1586 | 2557 |
| 1601.43 | RKVCSGNTTPIIHLK | 12929 | 15 | HPV | E2 | 283 | 11 | 8050 | — | 2103 | 18,019 |
| 1601.17 | TTPIIHKLGDRNSLK | 12930 | 15 | HPV | E2 | 286 | 1484 | 382 | 10,978 | 19 | 5566 |
| 1601.37 | NTTPIIHLKGDKNSL | 12931 | 15 | HPV | E2 | 289 | 5443 | 11,362 | — | 75 | — |
| 90.0228 | IIHLKGDPNSLKCLR | 12932 | 15 | HPV | E2 | 290 | 163 | 497 | | 1903 | 1334 |
| 1601.25 | TTPIIHLKGDANILK | 12933 | 15 | HPV | E2 | 292 | 527 | 205 | 4755 | 49 | — |
| 90.0218 | IIHLKGDKNSLKCLR | 12934 | 15 | HPV | E2 | 293 | 1330 | 137 | | 1441 | 9924 |
| 90.0197 | IIHLKGDANILKCLR | 12935 | 15 | HPV | E2 | 295 | 66 | 476 | | 713 | 2463 |
| 1601.26 | LKGDANILKCLRYRL | 12936 | 15 | HPV | E2 | 298 | 6898 | 609 | 3193 | 6222 | — |
| 89.0157 | HCTLYTAVSSTWHWT | 12937 | 15 | HPV | E2 | 308 | 867 | — | | — | — |
| 90.0019 | RYRFQKYKTLFVDVT | 12938 | 15 | HPV | E2 | 308 | 2166 | 590 | | 4112 | 385 |
| 90.0241 | YKTLFVDVTSTYHWT | 12939 | 15 | HPV | E2 | 314 | 71 | 3531 | | — | 5498 |
| 90.0210 | TVTFVTEQQQQMFLG | 12940 | 15 | HPV | E2 | 322 | — | — | | 845 | — |
| 1601.38 | STWHWTGCNKNTGIL | 12941 | 15 | HPV | E2 | 322 | 487 | — | — | — | 16,519 |
| 1601.18 | AGNEKTGILTVTYHS | 12942 | 15 | HPV | E2 | 325 | — | 2810 | — | 932 | — |
| 89.0187 | QQQMFLGTVKIPPTV | 12943 | 15 | HPV | E2 | 330 | 3338 | 1001 | | 1585 | — |
| 89.0188 | QMFLGTVKIPPTVQI | 12944 | 15 | HPV | E2 | 332 | 129 | 208 | | 13 | 4494 |
| 90.0028 | LNTVKIPPTVQISTG | 12945 | 15 | HPV | E2 | 340 | 778 | 12,061 | | — | — |
| 1601.19 | EKQRTKFLNTVAIPD | 12946 | 15 | HPV | E2 | 340 | 257 | — | — | 6454 | — |
| 1601.27 | TYISTSQRDDFLNTV | 12947 | 15 | HPV | E2 | 343 | 16,651 | — | 6619 | 480 | — |
| 1601.20 | FLNTVAIPDSVQILV | 12948 | 15 | HPV | E2 | 346 | 90 | 8957 | 91 | 446 | — |
| 1601.39 | RNTFLDVVTIPNSVQ | 12949 | 15 | HPV | E2 | 346 | 214 | 17,014 | 12,009 | 136 | — |
| 89.0158 | LSQVKIPKTITVSTG | 12950 | 15 | HPV | E2 | 347 | — | 1908 | | — | — |
| 1601.40 | FLDVVTIPNSVQISV | 12951 | 15 | HPV | E2 | 349 | 53 | 2156 | 17,646 | 2211 | — |
| 90.0017 | LKTVKIPNTVQVIQG | 12952 | 15 | HPV | E2 | 350 | 33 | — | | — | — |
| 90.0020 | LSHVKIPVVYRLVWD | 12953 | 15 | HPV | E2 | 352 | 329 | 1529 | | 22 | 1344 |
| 1601.28 | DFLNTVKIPNTVSVS | 12954 | 15 | HPV | E2 | 352 | 131 | 2188 | — | 3526 | — |
| 1601.41 | VVTIPNSVQISVGYM | 12955 | 15 | HPV | E2 | 352 | 139 | 3438 | — | 294 | — |
| 89.0178 | LNTVKIPNTVSVSTG | 12956 | 15 | HPV | E2 | 354 | 103 | 12,730 | 245 | 2578 | |
| 1601.42 | TIPNSVQISVGYMTI | 12957 | 15 | HPV | E2 | 354 | 14 | 10 | 10,775 | 16 | 8328 |
| 85.0001 | ECVYCKQQLLRREVY | 12958 | 15 | HPV | E6 | 36 | — | 3832 | | 1365 | 2416 |

TABLE 186-continued

Binding affinity of HLA-DR supertype and DR3 motif-positive peptides

| | | | | | | | | | | | |
|---|---|---|---|---|---|---|---|---|---|---|---|
| 85.0024 | SEVYDFAFADLTVVY | 12959 | 15 | HPV | E6 | 40 | — | 1149 | | 1325 | 11,802 |
| 85.0138 | YDFVFADLRIVYRDG | 12960 | 15 | HPV | E6 | 43 | 8173 | — | | 10,907 | 11,161 |
| 85.0054 | DFVFADLRIVYRDGN | 12961 | 15 | HPV | E6 | 44 | 162 | 1253 | | 6709 | 8433 |
| 85.0041 | RIVYRDNNPYGVCIM | 12962 | 15 | HPV | E6 | 51 | 119 | 821 | | 1403 | — |
| 85.0002 | CIVYRDGNPYAVCDK | 12963 | 15 | HPV | E6 | 58 | 1646 | 650 | | — | — |
| 85.0022 | CDLLIRCITCQRPLC | 12964 | 15 | HPV | E6 | 97 | — | 9567 | | 1390 | — |
| 85.0031 | NEILIRCIICQRPLC | 12965 | 15 | HPV | E6 | 97 | 7174 | 18,927 | | 883 | — |
| 85.0032 | IRCIICQRPLCPQEK | 12966 | 15 | HPV | E6 | 101 | 7295 | — | | 510 | 15,154 |
| 85.0013 | IRCLRCQKPLNPAEK | 12967 | 15 | HPV | E6 | 103 | — | 6928 | | 611 | — |
| 1543.22 | QERPRKLPQLCTELQ | 12968 | 15 | HPV | E6 | | — | — | — | 81 | — |
| 1543.23 | RGRWTGRCMSCCRSS | 12969 | 15 | HPV | E6 | | — | — | — | 14,231 | — |
| 1543.24 | LCTELQTTIHDIILE | 12970 | 15 | HPV | E6 | | 5529 | — | — | 1044 | — |
| 1543.25 | RREVYDFAFRDLCIV | 12971 | 15 | HPV | E6 | | — | — | — | 2460 | 19,793 |
| 1543.26 | RHLDKKQRFHNIRGR | 12972 | 15 | HPV | E6 | | — | — | — | — | 5759 |
| 1543.27 | QRFHNIRGRWTGRCM | 12973 | 15 | HPV | E6 | | 5308 | 17,214 | — | 4553 | 919 |
| 1543.28 | HNIRGRWTGRCMSCC | 12974 | 15 | HPV | E6 | | 2841 | 1410 | — | 1835 | 8982 |
| 1543.29 | WTGRCMSCCRSSRTR | 12975 | 15 | HPV | E6 | | 1909 | — | — | 12,260 | 18,771 |
| 1543.30 | RCMSCCRSSRTRRET | 12976 | 15 | HPV | E6 | | — | — | — | — | 2225 |
| 1543.31 | MSCCRSSRTRRETQL | 12977 | 15 | HPV | E6 | | — | — | — | — | 4734 |
| 1543.32 | TNTGLYNLLIRCLRC | 12978 | 15 | HPV | E6 | | 719 | 36 | 19,877 | 366 | 3656 |
| 1543.34 | TELNTSLQDIEITCV | 12979 | 15 | HPV | E6 | | 7074 | — | — | 922 | — |
| 1543.35 | EVFEFAFKDLFVVYR | 12980 | 15 | HPV | E6 | | 165 | 1522 | — | 316 | — |
| 1543.37 | TGRCIACWRRPRTET | 12981 | 15 | HPV | E6 | | 2771 | 84 | 5961 | 225 | 6047 |
| 1543.39 | CQALETTIHNIELQC | 12982 | 15 | HPV | E6 | | — | — | — | 15 | 3430 |
| 1543.40 | FHSIAGQYRGQCNTC | 12983 | 15 | HPV | E6 | | — | 574 | — | 1296 | 43 |
| 1543.41 | QYRGQCNTCCDQARQ | 12984 | 15 | HPV | E6 | | — | — | — | 17,824 | 5440 |
| 1543.42 | TRPRTLHELCEVLEE | 12985 | 15 | HPV | E6 | | — | — | — | 2591 | — |
| 1543.46 | GCWRQTSREPRESTV | 12986 | 15 | HPV | E6 | | — | — | — | — | 4269 |
| 1543.48 | SEVYDFVFADLRIVY | 12987 | 15 | HPV | E6 | | 46 | 15,336 | 558 | 1420 | 2347 |
| 1543.54 | RVCLLFYSKVRKYRY | 12988 | 15 | HPV | E6 | | 89 | 717 | 868 | 7745 | 3852 |
| 1543.55 | HGWTGSCLGCWRQTS | 12989 | 15 | HPV | E6 | | 7422 | — | — | 13,949 | — |
| 1543.56 | CLGCWRQTSREPRES | 12990 | 15 | HPV | E6 | | — | — | — | — | 8505 |
| 1543.57 | IMCLRELSKISEYRH | 12991 | 15 | HPV | E6 | | 311 | 67 | 603 | 116 | 292 |
| 1543.58 | YRHYQYSLYGKTLEE | 12992 | 15 | HPV | E6 | | 26 | 2903 | — | 2544 | 640 |
| 1543.59 | KERHVNANKRFHNIM | 12993 | 15 | HPV | E6 | | 5.2 | 12,902 | — | 8483 | 502 |
| 1543.60 | RFHNIMGRWTGRCSE | 12994 | 15 | HPV | E6 | | 309 | 123 | 7835 | 1123 | 374 |
| 85.0092 | DLRVVQQLLMGALTV | 12995 | 15 | HPV | E7 | 82 | | 57 | 132 | 9.5 | 10,879 |
| 85.0101 | QLLMGTCTIVCPSCA | 12996 | 15 | HPV | E7 | 82 | | 5447 | 11,291 | 13,377 | — |
| 1543.03 | EPDRAHYNIVTFCCK | 12997 | 15 | HPV | E7 | | 411 | 5861 | 15,977 | — | 16,052 |
| 1543.04 | LDLQPETTDLYCYEQ | 12998 | 15 | HPV | E7 | | — | — | — | 17 | — |
| 1543.05 | GVNHQHLPARRAEPQ | 12999 | 15 | HPV | E7 | | — | — | — | 14,560 | — |
| 1543.07 | SADDLRAFQQLFLNT | 13000 | 15 | HPV | E7 | | 3135 | 129 | — | 270 | — |
| 1543.10 | DYVLDLQPEATDLHC | 13001 | 15 | HPV | E7 | | — | — | 245 | 69 | — |
| 1543.11 | QSTQVDIRILQELLM | 13002 | 15 | HPV | E7 | | 607 | — | — | 180 | — |
| 1543.12 | EYVLDLYPEPTDLYC | 13003 | 15 | HPV | E7 | | — | 13,012 | 734 | 159 | — |
| 1543.13 | LYCYEQLSDSSDEDE | 13004 | 15 | HPV | E7 | | — | — | — | 12,712 | — |
| 1543.14 | YYIVTCCHTCNTTVR | 13005 | 15 | HPV | E7 | | 434 | 2193 | 3209 | 379 | — |
| 1543.15 | LCVNSTASDLRTIQQ | 13006 | 15 | HPV | E7 | | 248 | — | — | 2111 | — |
| 1543.16 | LLMGTVNIVCPTCAQ | 13007 | 15 | HPV | E7 | | 249 | — | — | 2049 | — |
| 1543.17 | LMGTVNIVCPTCAQQ | 13008 | 15 | HPV | E7 | | 302 | 18,083 | — | 696 | 461 |
| 1543.18 | DGVSHAQLPARRAEP | 13009 | 15 | HPV | E7 | | — | — | — | 1929 | 392 |

TABLE 186-continued

Binding affinity of HLA-DR supertype and DR3 motif-positive peptides

| | | | | | | | | | | | | |
|---|---|---|---|---|---|---|---|---|---|---|---|---|
| 1543.19 | FLSTLSFVCPWCATN | 13010 | 15 | HPV | E7 | | | 4744 | 7003 | — | 140 | 6987 |
| 1543.20 | EIVLHLEPQNELDPV | 13011 | 15 | HPV | E7 | | | 5352 | — | — | 713 | — |
| 1543.21 | EDLRTLQQLFLSTLS | 13012 | 15 | HPV | E7 | | | 7.5 | 141 | — | 17 | — |
| 1543.43 | PDGQAEQATSNYYIV | 13013 | 15 | HPV | E7 | | | — | — | — | — | — |
| 1543.44 | TYCHSCDSTLRLCIH | 13014 | 15 | HPV | E7 | | | 8857 | — | 13,772 | 853 | — |
| 1543.45 | CIHSTATDLRTLQQM | 13015 | 15 | HPV | E7 | | | 2988 | 15,020 | — | 159 | 2446 |
| 1543.51 | EYILDLHPEPTDLFC | 13016 | 15 | HPV | E7 | | | 4746 | — | 83 | 8.2 | — |
| 1543.52 | TCGTTVRLCINSTTT | 13017 | 15 | HPV | E7 | | | 406 | 3047 | 17,886 | 1377 | — |
| 1543.53 | LMGTCTIVCPSCAQQ | 13018 | 15 | HPV | E7 | | | 4199 | — | — | 6774 | — |
| 9014.0015 | NASLLIQNSIQNDTG | 13019 | 15 | Human | CEA | 104 | A | | | | | |
| 9014.0071 | QNFIQNDTGFYTLHV | 13020 | 15 | Human | CEA | 110 | A | | | | | |
| 9014.0076 | QNWIQNDTGFYTLHV | 13021 | 15 | Human | CEA | 110 | A | | | | | |
| 9014.0077 | QNYIQNDTGFYTLHV | 13022 | 15 | Human | CEA | 110 | A | | | | | |
| 9014.0085 | QNIIQNDVGFYTLHV | 13023 | 15 | Human | CEA | 110 | A | | | | | |
| 9014.0037 | KPSFSSNNSKPVEDK | 13024 | 15 | Human | CEA | 146 | A | | | | | |
| 9014.0040 | KPSLSSNNSKPVEDK | 13025 | 15 | Human | CEA | 146 | A | | | | | |
| 9014.0041 | KPSVSSNNSKPVEDK | 13026 | 15 | Human | CEA | 146 | A | | | | | |
| 9014,0042 | KPSWSSNNSKPVEDK | 13027 | 15 | Human | CEA | 146 | A | | | | | |
| 9014.0043 | KPSYSSNNSKPVEDK | 13028 | 15 | Human | CEA | 146 | A | | | | | |
| 9014.0044 | KPSISSNNAKPVEDK | 13029 | 15 | Human | CEA | 146 | A | | | | | |
| 58.0015 | LWWVNNESLPVSPRL | 13030 | 15 | Human | CEA | 177 | A | | | | | |
| 9014.0054 | RTTFKTITVSAELPK | 13031 | 15 | Human | CEA | 488 | A | | | | | |
| 9014.0058 | RTTLKTITVSAELPK | 13032 | 15 | Human | CEA | 488 | A | | | | | |
| 9014.0059 | RTTWKTITVSAELPK | 13033 | 15 | Human | CEA | 488 | A | | | | | |
| 9014.0060 | RTTYKTITVSAELPK | 13034 | 15 | Human | CEA | 488 | A | | | | | |
| 9014.0065 | RTTVKTITLSAELPK | 13035 | 15 | Human | CEA | 488 | A | | | | | |
| 9014.0088 | GTDFKLRLPASPETH | 13036 | 15 | Human | Her2/neu | 28 | A | | | | | |
| 9014.0090 | GTDIKLRLPASPETH | 13037 | 15 | Human | Her2/neu | 28 | A | | | | | |
| 9014.0094 | GTDWKLRLPASPETH | 13038 | 15 | Human | Her2/neu | 28 | A | | | | | |
| 9014.0095 | GTDYKLRLPASPETH | 13039 | 15 | Human | Her2/neu | 28 | A | | | | | |
| 9014.0096 | GTDMKLRLAASPETH | 13040 | 15 | Human | Her2/neu | 28 | A | | | | | |
| 9014.0097 | GTDMKLRLFASPETH | 13041 | 15 | Human | Her2/neu | 28 | A | | | | | |
| 9014.0098 | GTDMKLRLHASPETH | 13042 | 15 | Human | Her2/neu | 28 | A | | | | | |
| 9014.0099 | GTDMKLRLIASPETH | 13043 | 15 | Human | Her2/neu | 28 | A | | | | | |
| 9014.0100 | GTDMKLRLLASPETH | 13044 | 15 | Human | Her2/neu | 28 | A | | | | | |
| 9014.0101 | GTDMKLRLNASPETH | 13045 | 15 | Human | Her2/neu | 28 | A | | | | | |
| 9014.0102 | GTDMKLRLSASPETH | 13046 | 15 | Human | Her2/neu | 28 | A | | | | | |
| 9014.0103 | GTDMKLRLTASPETH | 13047 | 15 | Human | Her2/neu | 28 | A | | | | | |
| 9014.0104 | GTDMKLRLVASPETH | 13048 | 15 | Human | Her2/neu | 28 | A | | | | | |
| 9014.0115 | DMKLRLAASPETHLD | 13049 | 15 | Human | Her2/neu | 30 | A | | | | | |
| 9014.0116 | DMKLRLFASPETHLD | 13050 | 15 | Human | Her2/neu | 30 | A | | | | | |
| 9014.0118 | DMKLRLIASPETHLD | 13051 | 15 | Human | Her2/neu | 30 | A | | | | | |
| 9014.0119 | DMKLRLLASPETHLD | 13052 | 15 | Human | Her2/neu | 30 | A | | | | | |
| 9014.0120 | DMKLRLNASPETHLD | 13053 | 15 | Human | Her2/neu | 30 | A | | | | | |
| 9014.0121 | DMKLRLSASPETHLD | 13054 | 15 | Human | Her2/neu | 30 | A | | | | | |
| 9014.0123 | DMKLRLVASPETHLD | 13055 | 15 | Human | Her2/neu | 30 | A | | | | | |
| 9014.0131 | DMKYRLPASPETHLD | 13056 | 15 | Human | Her2/neu | 30 | A | | | | | |
| 9014.0135 | DMKLRLPAIPETHLD | 13057 | 15 | Human | Her2/neu | 30 | A | | | | | |
| 1533.07 | KIFGSLAFLPESFDGDPA | 13058 | 18 | Human | Her2/neu | 369 | | 1073 | 2264 | — | 10,020 | 8008 |
| 9014.0230 | KAFGSLAFLPESFDGDPA | 13059 | 18 | Human | Her2/neu | 369 | A | | | | | |
| 9014.0231 | KFFGSLAFLPESFDGDPA | 13060 | 18 | Human | Her2/neu | 369 | A | | | | | |

TABLE 186-continued

Binding affinity of HLA-DR supertype and DR3 motif-positive peptides

| | | | | | | | | | | |
|---|---|---|---|---|---|---|---|---|---|---|
| 9014.0232 | KHFGSLAFLPESFDGDPA | 13061 | 18 | Human | Her2/neu | 369 | A | | | |
| 9014.0233 | KKFGSLAFLPESFDGDPA | 13062 | 18 | Human | Her2/neu | 369 | A | | | |
| 9014.0234 | KLFGSLAFLPESFDGDPA | 13063 | 18 | Human | Her2/neu | 369 | A | | | |
| 9014.0235 | KVFGSLAFLPESFDGDPA | 13064 | 18 | Human | Her2/neu | 369 | A | | | |
| 9014.0236 | KWFGSLAFLPESFDGDPA | 13065 | 18 | Human | Her2/neu | 369 | A | | | |
| 9014.0237 | KYFGSLAFLPESFDGDPA | 13066 | 18 | Human | Her2/neu | 369 | A | | | |
| 9014.0240 | KIFGSLIFLPESFDGDPA | 13067 | 18 | Human | Her2/neu | 369 | A | | | |
| 9014.0241 | KIFGSLLFLPESFDGDPA | 13068 | 18 | Human | Her2/neu | 369 | A | | | |
| 9014.0242 | KIFGSLNFLPESFDGDPA | 13069 | 18 | Human | Her2/neu | 369 | A | | | |
| 9014.0243 | KIFGSLSFLPESFDGDPA | 13070 | 18 | Human | Her2/neu | 369 | A | | | |
| 9014.0244 | KIFGSLTFLPESFDGDPA | 13071 | 18 | Human | Her2/neu | 369 | A | | | |
| 9014.0245 | KIFGSLVFLPESFDGDPA | 13072 | 18 | Human | Her2/neu | 369 | A | | | |
| 9014.0246 | KIFGSLAHLPESFDGDPA | 13073 | 18 | Human | Her2/neu | 369 | A | | | |
| 9014.0247 | KIFGSLAHLPESFDGDPA | 13074 | 18 | Human | Her2/neu | 369 | A | | | |
| 9014.0248 | KIFGSLAILPESFDGDPA | 13075 | 18 | Human | Her2/neu | 369 | A | | | |
| 9014.0250 | KIFGSLALLPESFDGDPA | 13076 | 18 | Human | Her2/neu | 369 | A | | | |
| 9014.0251 | KIFGSLAVLPESFDGDPA | 13077 | 18 | Human | Her2/neu | 369 | A | | | |
| 9014.0252 | KIFGSLAWLPESFDGDPA | 13078 | 18 | Human | Her2/neu | 369 | A | | | |
| 9014.0253 | KIFGSLAYLPESFDGDPA | 13079 | 18 | Human | Her2/neu | 369 | A | | | |
| 9014.0255 | KIFGSLAFLPESHDGDPA | 13080 | 18 | Human | Her2/neu | 369 | A | | | |
| 9014.0257 | KIFGSLAFLPESLDGDPA | 13081 | 18 | Human | Her2/neu | 369 | A | | | |
| 1385.01 | QIQVFETLEET | 13082 | 11 | Human | Her2/neu | 396 | | — | — | — |
| 9014.0141 | ETEAVEPLTPSGAMP | 13083 | 15 | Human | Her2/neu | 693 | A | | | |
| 9014.0142 | ETEFVEPLTPSGAMP | 13084 | 15 | Human | Her2/neu | 693 | A | | | |
| 9014.0143 | ETEHVEPLTPSGAMP | 13085 | 15 | Human | Her2/neu | 693 | A | | | |
| 9014.0144 | ETEIVEPLTPSGAMP | 13086 | 15 | Human | Her2/neu | 693 | A | | | |
| 9014.0145 | ETEKVEPLTPSGAMP | 13087 | 15 | Human | Her2/neu | 693 | A | | | |
| 9014.0146 | ETEVVEPLTPSGAMP | 13088 | 15 | Human | Her2/neu | 693 | A | | | |
| 9014.0147 | ETEWVEPLTPSGAMP | 13089 | 15 | Human | Her2/neu | 693 | A | | | |
| 9014.0148 | ETEYVEPLTPSGAMP | 13090 | 15 | Human | Her2/neu | 693 | A | | | |
| 9014.0149 | ETELVEPLAPSGAMP | 13091 | 15 | Human | Her2/neu | 693 | A | | | |
| 9014.0150 | ETELVEPLFPSGAMP | 13092 | 15 | Human | Her2/neu | 693 | A | | | |
| 9014.0151 | ETELVEPLHPSGAMP | 13093 | 15 | Human | Her2/neu | 693 | A | | | |
| 9014.0152 | ETELVEPLIPSGAMP | 13094 | 15 | Human | Her2/neu | 693 | A | | | |
| 9014.0153 | ETELVEPLLPSGAMP | 13095 | 15 | Human | Her2/neu | 693 | A | | | |
| 9014.0154 | ETELVEPLAPSGAMP | 13096 | 15 | Human | Her2/neu | 693 | A | | | |
| 9014.0155 | ETELVEPLSPSGAMP | 13097 | 15 | Human | Her2/neu | 693 | A | | | |
| 9014.0156 | ETELVEPLVPSGAMP | 13098 | 15 | Human | Her2/neu | 693 | A | | | |
| 9014.0169 | KEILDEAYIMAGVGS | 13099 | 15 | Human | Her2/neu | 765 | A | | | |
| 9014.0170 | KEILDEAYLMAGVGS | 13100 | 15 | Human | Her2/neu | 765 | A | | | |
| 9014.0177 | ITDIGLARLLDIDET | 13101 | 15 | Human | Her2/neu | 861 | A | | | |
| 9014.0183 | ITDFGLARALDIDET | 13102 | 15 | Human | Her2/neu | 861 | A | | | |
| 9014.0187 | ITDFGLARNLDIDET | 13103 | 15 | Human | Her2/neu | 861 | A | | | |
| 9014.0188 | ITDFGLARSLDIDET | 13104 | 15 | Human | Her2/neu | 861 | A | | | |
| 9014.0210 | CWAIDSECRPRFREL | 13105 | 15 | Human | Her2/neu | 958 | A | | | |
| 9014.0211 | CWFIDSECRPRFREL | 13106 | 15 | Human | Her2/neu | 958 | A | | | |
| 9014.0212 | CWHIDSECRPRFREL | 13107 | 15 | Human | Her2/neu | 958 | A | | | |
| 9014.0213 | CWIIDSECRPRFREL | 13108 | 15 | Human | Her2/neu | 958 | A | | | |
| 9014.0214 | CWKIDSECRPRFREL | 13109 | 15 | Human | Her2/neu | 958 | A | | | |
| 9014.0215 | CWLIDSECRPRFREL | 13110 | 15 | Human | Her2/neu | 958 | A | | | |
| 9014.0218 | CWYIDSECRPRFREL | 13111 | 15 | Human | Her2/neu | 958 | A | | | |

TABLE 186-continued

Binding affinity of HLA-DR supertype and DR3 motif-positive peptides

| | | | | | | | | | | | | |
|---|---|---|---|---|---|---|---|---|---|---|---|---|
| 9014.0219 | CWMIDSEARPRFREL | 13112 | 15 | Human | Her2/neu | 958 | A | | | | | |
| 9014.0220 | CWMIDSEFRPRFREL | 13113 | 15 | Human | Her2/neu | 958 | A | | | | | |
| 9014.0221 | CWMIDSEHRPRFREL | 13114 | 15 | Human | Her2/neu | 958 | A | | | | | |
| 9014.0222 | CWMIDSEFRPRFREL | 13115 | 15 | Human | Her2/neu | 958 | A | | | | | |
| 9014.0223 | CWMIDSELRPRFREL | 13116 | 15 | Human | Her2/neu | 958 | A | | | | | |
| 9014.0224 | CWMIDSENRPRFREL | 13117 | 15 | Human | Her2/neu | 958 | A | | | | | |
| 9014.0225 | CWMIDSESRPRFREL | 13118 | 15 | Human | Her2/neu | 958 | A | | | | | |
| 9014.0226 | CWMIDSETRPRFREL | 13119 | 15 | Human | Her2/neu | 958 | A | | | | | |
| 9014.0227 | CWMIDSEVRPRFREL | 13120 | 15 | Human | Her2/neu | 958 | A | | | | | |
| 68.0001 | MWDLVLSIALSVGCT | 13121 | 15 | Human | Kallikrein2 | 1 | | 108 | 11,375 | 15,205 | 158 | — |
| 68.0002 | DLVLSIALSVGCTGA | 13122 | 15 | Human | Kallikrein2 | 3 | | 98 | 18,200 | — | 459 | — |
| 68.0003 | HPQWVLTAAHCLKKN | 13123 | 15 | Human | Kallikrein2 | 56 | | 483 | 1219 | 8114 | 1106 | 11 |
| 68.0004 | QWVLTAAHCLKKNSQ | 13124 | 15 | Human | Kallikrein2 | 58 | | — | — | — | 14,395 | 382 |
| 68.0005 | GQRVPVSHSFPHPLY | 13125 | 15 | Human | Kallikrein2 | 87 | | 703 | 3960 | — | 9860 | — |
| 68.0006 | RVPVSHSFPHPLYNM | 13126 | 15 | Human | Kallikrein2 | 89 | | 377 | 5518 | — | 9213 | 11,650 |
| 68.0007 | PHPLYNMSLLKHQSL | 13127 | 15 | Human | Kallikrein2 | 97 | | 3307 | 3873 | — | 49 | 1901 |
| 68.0008 | HPLYNMSLLKHQSLR | 13128 | 15 | Human | Kallikrein2 | 98 | | 546 | 472 | — | 8.4 | 219 |
| 68.0009 | NMSLLKHQSLRPDED | 13129 | 15 | Human | Kallikrein2 | 102 | | — | — | — | 105 | — |
| 68.0010 | SHDLMLLRLSEPAKI | 13130 | 15 | Human | Kallikrein2 | 118 | | 1.8 | 365 | 5361 | 10 | 2031 |
| 68.0011 | HDLMLLRLSEPAKIT | 13131 | 15 | Human | Kallikrein2 | 119 | | 0.83 | 115 | 488 | 12 | 211 |
| 68.0015 | PEEFLRPRSLQCVSL | 13132 | 15 | Human | Kallikrein2 | 162 | | 11,667 | 3193 | — | 117 | — |
| 68.0016 | PRSLQCVSLHLLSND | 13133 | 15 | Human | Kallikrein2 | 168 | | 3731 | 1597 | 11,650 | 544 | — |
| 68.0140 | LHLLSNDMCARAYSE | 13134 | 15 | Human | Kallikrein2 | 176 | | 1876 | — | 1308 | 324 | — |
| 68.0017 | NGVLQGITSWGPEPC | 13135 | 15 | Human | Kallikrein2 | 220 | | — | 835 | — | 5761 | — |
| 68.0018 | KPAVYTKVVHYRKWI | 13136 | 15 | Human | Kallikrein2 | 239 | | 1947 | 401 | 7186 | 4581 | 23 |
| 58.0114 | VGNWQYFFPVIFSKA | 13137 | 15 | Human | MAGE3 | 140 | | | | | | |
| F160.17 | LVEVTLGEVPAAESPD | 13138 | 16 | Human | MAGE3/6 | 45 | | | | | | |
| 68.0019 | AAPLLLARAASLSLG | 13139 | 15 | Human | PAP | 3 | | 3.2 | 35 | 10,470 | 79 | 79 |
| 68.0020 | APLLLARAASLSLGF | 13140 | 15 | Human | PAP | 4 | | 12 | 91 | 13,359 | 59 | 114 |
| 68.0021 | PLLLARAASLSLGFL | 13141 | 15 | Human | PAP | 5 | | 12 | 118 | — | 52 | 151 |
| 68.0022 | SLSLGFLFLLFFWLD | 13142 | 15 | Human | PAP | 13 | | 639 | 11,375 | 3710 | — | — |
| 68.0023 | LLFFWLDRSVLAKEL | 13143 | 15 | Human | PAP | 21 | | 24 | 34 | 86 | 7.5 | 134 |
| 68.0024 | DRSVLAKELKFVTLV | 13144 | 15 | Human | PAP | 27 | | 4410 | 1359 | — | 53 | 2217 |
| 68.0025 | AKELKFVTLVFRHGD | 13145 | 15 | Human | PAP | 32 | | 824 | 1529 | 8563 | 51 | 24 |
| 68.0026 | RSPIDTFPTDPIKES | 13146 | 15 | Human | PAP | 47 | | — | 2373 | — | 469 | — |
| 68.0028 | FGQLTQLGMEQHYEL | 13147 | 15 | Human | PAP | 67 | | — | — | — | 543 | — |
| 68.0030 | DRTLMSAMTNLAALF | 13148 | 15 | Human | PAP | 110 | | 114 | 871 | 3927 | 57 | — |
| 68.0031 | MSAMTNLAALFPPEG | 13149 | 15 | Human | PAP | 114 | | 249 | 12,384 | 7158 | 1072 | — |
| 68.0032 | MTNLAALFPPEGVSI | 13150 | 15 | Human | PAP | 117 | | 1310 | 10,370 | — | 4606 | — |
| 68.0033 | PEGVSIWNPILLWQP | 13151 | 15 | Human | PAP | 126 | | 444 | 7.2 | 4624 | 107 | — |
| 68.0034 | GVSIWNPILLWQPIP | 13152 | 15 | Human | PAP | 128 | | 207 | 5.0 | 4428 | 492 | 523 |
| 68.0035 | WNPILLWQPIPVHTV | 13153 | 15 | Human | PAP | 132 | | 2259 | 14 | — | 81 | — |
| 68.0036 | NPILLWQPIPVHTVP | 13154 | 15 | Human | PAP | 133 | | 250 | 4.6 | — | 67 | — |
| 68.0037 | PILLWQPIPVHTVPL | 13155 | 15 | Human | PAP | 134 | | 567 | 6.9 | — | 106 | — |
| 68.0038 | ILLWQPIPVHTVPLS | 13156 | 15 | Human | PAP | 135 | | 1111 | 65 | — | 712 | — |
| 68.0039 | WQPIPVHTVPLSEDQ | 13157 | 15 | Human | PAP | 138 | | 2692 | — | — | 1228 | — |
| 68.0147 | TVPLSEDQLLYLPFR | 13158 | 15 | Human | PAP | 145 | | 5300 | — | 4323 | 872 | — |
| 68.0040 | LSGLHGQDLFGIWSK | 13159 | 15 | Human | PAP | 194 | | — | — | — | 135 | — |
| 68.0041 | YDPLYCESVHNFTLP | 13160 | 15 | Human | PAP | 210 | | — | 2136 | — | 6901 | — |
| 68.0042 | LPSWATEDTMTKLRE | 13161 | 15 | Human | PAP | 223 | | — | — | 5973 | — | 343 |
| 68.0043 | LRELSELSLLSLYGI | 13162 | 15 | Human | PAP | 235 | | 3218 | 235 | — | 544 | 5185 |

TABLE 186-continued

Binding affinity of HLA-DR supertype and DR3 motif-positive peptides

| | | | | | | | | | | | |
|---|---|---|---|---|---|---|---|---|---|---|---|
| 68.0044 | LSELSLLSLYGIHKQ | 13163 | 15 | Human | PAP | 238 | 1253 | 45 | — | 79 | 7.3 |
| 68.0045 | LSLLSLYGIHKQKEK | 13164 | 15 | Human | PAP | 241 | — | 58 | — | 772 | 3.4 |
| 68.0046 | KSRLQGGVLVNEILN | 13165 | 15 | Human | PAP | 255 | 318 | — | — | 713 | — |
| 68.0047 | GGVLVNEILNHMKRA | 13166 | 15 | Human | PAP | 260 | 49 | 576 | 8124 | 5.8 | 8.7 |
| 68.0048 | IPSYKKLIMYSAHDT | 13167 | 15 | Human | PAP | 277 | 2122 | 17 | 9982 | 12 | 191 |
| 68.0049 | YKKLIMYSAHDTTVS | 13168 | 15 | Human | PAP | 280 | 37 | 15 | 13,224 | 5.8 | 5482 |
| 68.0050 | LIMYSAHDTTVSGLQ | 13169 | 15 | Human | PAP | 283 | 1752 | 184 | 6828 | 4381 | — |
| 68.0051 | DTTVSGLQMALDVYN | 13170 | 15 | Human | PAP | 290 | 3500 | 1042 | 10,843 | 961 | — |
| 68.0052 | ALDVYNGLLPPYASC | 13171 | 15 | Human | PAP | 299 | — | 1091 | — | — | — |
| 68.0053 | LDVYNGLLPPYASCH | 13172 | 15 | Human | PAP | 300 | — | 3035 | — | — | — |
| 68.0054 | YNGLLPPYASCHLTE | 13173 | 15 | Human | PAP | 303 | 11,667 | 252 | — | — | — |
| 68.0153 | LTELYFEKGEYFVEM | 13174 | 15 | Human | PAP | 315 | 3157 | — | 124 | 601 | 6655 |
| 68.0056 | FAELVGPVIPQDWST | 13175 | 15 | Human | PAP | 356 | — | — | — | 983 | — |
| 68.0156 | GPVIPQDWSTECMTT | 13176 | 15 | Human | PAP | 361 | | | — | 961 | |
| K-09 | FLYGALLLAEGFYTTGAVRQ | 13177 | 20 | Human | PLP | 81 | | 45 | | | 256 |
| F025.05 | QKGRGYRGQHQAHSLERVCH | 13178 | 20 | Human | PLP | 121 | | — | — | 17,951 | 9759 |
| K-18 | SAVPVYIYFNTWITCQSIAF | 13179 | 20 | Human | PLP | 171 | | 92 | | | — |
| F025.03 | WTTCQSIAFPSKTSASIGSL | 13180 | 20 | Human | PLP | 181 | 74 | 556 | — | 336 | 400 |
| F025.08 | AATYNFAVLKLMGRGTKF | 13181 | 18 | Human | PLP | 260 | | 239 | — | 1218 | 18 |
| 68.0058 | TLSVTWIGAAPLILS | 13182 | 15 | Human | PSA | 5 | 642 | 97 | 6031 | 3506 | 31 |
| 68.0059 | SVTWIGAAPLILSRI | 13183 | 15 | Human | PSA | 7 | 420 | 147 | 13,676 | 42 | 104 |
| 68.0060 | VTWIGAAPLILSRIV | 13184 | 15 | Human | PSA | 8 | 2339 | 552 | — | 88 | 147 |
| 68.0061 | SQPWQVLVASRGRAV | 13185 | 15 | Human | PSA | 31 | 32 | 11,259 | — | 7562 | 84 |
| 68.0062 | GRAVCGGVLVHPQWV | 13186 | 15 | Human | PSA | 42 | 5456 | 12,888 | — | 62 | — |
| 68.0063 | GVLVHPQWVLTAAHC | 13187 | 15 | Human | PSA | 48 | 2427 | 66 | — | 6.2 | 1062 |
| 68.0064 | HPQWVLTAAHCIRNK | 13188 | 15 | Human | PSA | 52 | 1170 | 6500 | 1324 | 5518 | 40 |
| 68.0065 | QWVLTAAHCIRNKSV | 13189 | 15 | Human | PSA | 54 | 2062 | 13,565 | 7342 | 3802 | 35 |
| 68.0066 | AHCIRNKSVILLGRH | 13190 | 15 | Human | PSA | 60 | 75 | 88 | 4752 | 8.7 | 3630 |
| 68.0067 | SVILLGRHSLFHPED | 13191 | 15 | Human | PSA | 67 | 96 | 106 | 13,045 | 4411 | 16,116 |
| 68.0068 | VILLGRHSLFHPEDT | 13192 | 15 | Human | PSA | 68 | 543 | 426 | — | 10,696 | — |
| 68.0158 | HSLFHPEDTGQVFQV | 13193 | 15 | Human | PSA | 74 | | | 553 | 11,503 | |
| 68.0069 | GQVFQVSHSFPHPLY | 13194 | 15 | Human | PSA | 83 | 146 | 2172 | 1071 | 416 | 128 |
| 68.0070 | VFQVSHSFPHPLYDM | 13195 | 15 | Human | PSA | 85 | 83 | 2396 | — | — | 897 |
| 68.0071 | PHPLYDMSLLKNRFL | 13196 | 15 | Human | PSA | 93 | 11,667 | 712 | — | 7486 | 3104 |
| 68.0072 | SHDLMLLRLSEPAEL | 13197 | 15 | Human | PSA | 114 | 5.8 | 1099 | 13,577 | 12 | — |
| 68.0073 | HDLMLLRLSEPAELT | 13198 | 15 | Human | PSA | 115 | 2.3 | 662 | 5305 | 45 | 10,541 |
| 68.0074 | TDAVKVMDLPTQEPA | 13199 | 15 | Human | PSA | 129 | — | — | — | 747 | — |
| 68.0077 | LHVISNDVCAQVHPQ | 13200 | 15 | Human | PSA | 172 | 239 | — | 1887 | 1087 | — |
| 68.0078 | CAQVHPQKVTKFMLC | 13201 | 15 | Human | PSA | 180 | 2192 | 809 | — | 604 | 1229 |
| 68.0079 | GGPLVCNGVLQGITS | 13202 | 15 | Human | PSA | 210 | 36 | — | — | 815 | 13,417 |
| 68.0080 | GPLVCNGVLQGITSW | 13203 | 15 | Human | PSA | 211 | 49 | 6310 | 11,615 | 646 | 6537 |
| 68.0081 | NGVLQGITSWGSEPC | 13204 | 15 | Human | PSA | 216 | 775 | 258 | 8038 | 4487 | 11,619 |
| 68.0082 | RPSLYTKVVHYRKWI | 13205 | 15 | Human | PSA | 235 | 4183 | 717 | 2982 | 4897 | 13 |
| 68.0083 | PRWLCAGALVLAGGF | 13206 | 15 | Human | PSM | 18 | — | 15,167 | 13,150 | 883 | — |
| 68.0084 | LGFLFGWFIKSSNEA | 13207 | 15 | Human | PSM | 35 | 10,104 | 355 | 681 | 9285 | 461 |
| 68.0085 | LDELKAENIKKFLYN | 13208 | 15 | Human | PSM | 62 | 597 | 414 | 548 | 788 | 150 |
| 68.0086 | IKKFLYNFTQIPHLA | 13209 | 15 | Human | PSM | 70 | 27 | 305 | 477 | 96 | 658 |
| 68.0087 | KFLYNFTQIPHLAGT | 13210 | 15 | Human | PSM | 72 | 221 | 227 | 10,212 | 256 | 1600 |
| 68.0088 | WKEFGLDSVELAHYD | 13211 | 15 | Human | PSM | 100 | 8413 | — | 829 | 5925 | — |
| 68.0089 | LAHYDVLLSYPNKTH | 13212 | 15 | Human | PSM | 110 | 268 | 82 | 1406 | 589 | 172 |
| 68.0165 | YISIINEDGNEIFNT | 13213 | 15 | Human | PSM | 127 | 346 | 2713 | 30 | 3705 | — |

TABLE 186-continued

Binding affinity of HLA-DR supertype and DR3 motif-positive peptides

| | | | | | | | | | | | |
|---|---|---|---|---|---|---|---|---|---|---|---|
| 68.0166 | ISIINEDGNEIFNTS | 13214 | 15 | Human | PSM | 128 | 343 | 3006 | 35 | 6394 | — |
| 68.0090 | GNEIFNTSLFEPPPP | 13215 | 15 | Human | PSM | 135 | 2804 | — | — | 835 | — |
| 68.0167 | EDFFKLERDMKINCS | 13216 | 15 | Human | PSM | 183 | 3188 | — | 4036 | 7886 | 3494 |
| 68.0168 | FFKLERDMKINCSGK | 13217 | 15 | Human | PSM | 185 | 382 | — | 4918 | 98 | 3796 |
| 68.0096 | GKVFRGNKVKNAQLA | 13218 | 15 | Human | PSM | 206 | 46 | 3373 | 7591 | 7884 | 1385 |
| 68.0097 | GNKVKNAQLAGAKGV | 13219 | 15 | Human | PSM | 211 | — | — | — | 1065 | 1218 |
| 68.0170 | GVILYSDPADYFAPG | 13220 | 15 | Human | PSM | 224 | 39 | 965 | 8.8 | 64 | 14,168 |
| 68.0100 | EYAYRRGIAEAVGLP | 13221 | 15 | Human | PSM | 276 | 5217 | — | 8773 | 6325 | 1204 |
| 68.0101 | AEAVGLPSIPVHPIG | 13222 | 15 | Human | PSM | 284 | 5456 | 56 | — | 12,394 | — |
| 68.0102 | AVGLPSIPVHPIGYY | 13223 | 15 | Human | PSM | 286 | 1191 | 518 | — | 5387 | — |
| 68.0103 | IGYYDAQKLLEKMGG | 13224 | 15 | Human | PSM | 297 | 5729 | 1978 | 17,305 | 13,588 | 506 |
| 68.0105 | TGNFSTQKVKMHIHS | 13225 | 15 | Human | PSM | 334 | 6187 | 3745 | — | 508 | 1927 |
| 68.0107 | TRIYNVIGTLRGAVE | 13226 | 15 | Human | PSM | 353 | 1460 | 1605 | 17,550 | 447 | 32 |
| 68.0173 | GAAVVHEIVRSFGTL | 13227 | 15 | Human | PSM | 391 | | | 788 | 89 | |
| 68.0176 | NSRLLQERGVAYINA | 13228 | 15 | Human | PSM | 438 | 327 | 1229 | 3366 | 699 | 3473 |
| 68.0109 | ERGVAYINADSSIEG | 13229 | 15 | Human | PSM | 444 | 3689 | — | 6846 | 87 | — |
| 68.0110 | GVAYINADSSIEGNY | 13230 | 15 | Human | PSM | 446 | 497 | 7610 | 1420 | 477 | — |
| 68.0177 | VAYINADSSIEGNYT | 13231 | 15 | Human | PSM | 447 | 2147 | — | 471 | 841 | — |
| 68.0111 | DSSIEGNYTLRVDCT | 13232 | 15 | Human | PSM | 453 | 7.6 | 1202 | 576 | 1262 | 16,824 |
| 68.0112 | NYTLRVDCTPLMYSL | 13233 | 15 | Human | PSM | 459 | 9.0 | 5056 | 25 | 404 | — |
| 68.0113 | CTPLMYSLVHNLTKE | 13234 | 15 | Human | PSM | 466 | 260 | 426 | 18,348 | 58 | 36 |
| 68.0114 | DFEVFFQRLGIASGR | 13235 | 15 | Human | PSM | 520 | 10,069 | 10,249 | — | 4.2 | 3559 |
| 68.0115 | EVFFQRLGIASGRAR | 13236 | 15 | Human | PSM | 522 | 17,500 | 4556 | — | 51 | 7.9 |
| 68.0116 | TNKFSGYPLYHSVYE | 13237 | 15 | Human | PSM | 543 | — | 489 | — | 12,466 | 2942 |
| 68.0117 | YDPMFKYHLTVAQVR | 13238 | 15 | Human | PSM | 566 | 1014 | 1348 | 8137 | 553 | 62 |
| 68.0118 | DPMFKYHLTVAQVRG | 13239 | 15 | Human | PSM | 567 | 699 | 230 | 7297 | 467 | 11 |
| 68.0119 | MFKYHLTVAQVRGGM | 13240 | 15 | Human | PSM | 569 | 1615 | 1198 | 3648 | 1062 | 5.8 |
| 68.0120 | KYHLTVAQVRGGMVF | 13241 | 15 | Human | PSM | 571 | 193 | 1222 | — | 3446 | 86 |
| 68.0121 | VAQVRGGMVFELANS | 13242 | 15 | Human | PSM | 576 | 2802 | 117 | — | 100 | — |
| 68.0122 | RGGMVFELANSIVLP | 13243 | 15 | Human | PSM | 580 | 4.4 | 94 | 132 | 411 | 413 |
| 68.0123 | GMVFELANSIVLPFD | 13244 | 15 | Human | PSM | 582 | 12 | 83 | 234 | 4154 | 903 |
| 68.0124 | VFELANSIVLPFDCR | 13245 | 15 | Human | PSM | 584 | 24 | 477 | 128 | 1215 | 10,815 |
| 68.0125 | ADKIYSISMKHPQEM | 13246 | 15 | Human | PSM | 608 | 4957 | 8273 | — | 3550 | — |
| 68.0126 | IYSISMKHPQEMKTY | 13247 | 15 | Human | PSM | 611 | — | 5025 | — | 5356 | 2588 |
| 68.0127 | PQEMKTYSVSFDSLF | 13248 | 15 | Human | PSM | 619 | — | 919 | 14,564 | 579 | — |
| 68.0128 | TYSVSFDSLFSAVKN | 13249 | 15 | Human | PSM | 624 | 5888 | 3223 | 8547 | 10,461 | 61 |
| 68.0130 | VLRMMNDQLMFLERA | 13250 | 15 | Human | PSM | 660 | 130 | 127 | 98 | 88 | 85 |
| 68.0131 | LRMMNDQLMFLERAF | 13251 | 15 | Human | PSM | 661 | 1314 | 1411 | 1570 | 50 | 758 |
| 68.0181 | DQLMFLERAFIDPLG | 13252 | 15 | Human | PSM | 666 | | | 17,115 | 6.6 | |
| 68.0133 | RHVIYAPSSHNKYAG | 13253 | 15 | Human | PSM | 688 | 8750 | 1291 | — | 5293 | 88 |
| 68.0134 | RQIYVAAFTVQAAAE | 13254 | 15 | Human | PSM | 730 | 524 | 166 | 6808 | 47 | 143 |
| 68.0135 | QIYVAAFTVQAAAET | 13255 | 15 | Human | PSM | 731 | 344 | 252 | 1324 | 50 | 216 |
| 68.0136 | VAAFTVQAAAETLSE | 13256 | 15 | Human | PSM | 734 | 446 | 18,200 | 2116 | 464 | 378 |

| Peptide | Sequence | SEQ NO ID | AA | Organism | Protein | Position | Analog | Degeneracy |
|---|---|---|---|---|---|---|---|---|
| F116.01 | MDIDPYKEFGATVELLSFLPSDFFP | 12669 | 25 | HBV | core | 1 | | 1 |
| F209.01 | LETTMRSPVFTDNSSPPVVP | 12670 | 20 | HCV | | | | 7 |
| F209.02 | AYAAQGYKVLVLNPSVAA | 12671 | 18 | HCV | | | | 11 |
| F209.03 | TPAETTVRLRAYMNTPGLPV | 12672 | 20 | HCV | | | | 11 |
| F209.04 | ENLPYLVAYQATVCARAQAP | 12673 | 20 | HCV | | | | 12 |

TABLE 186-continued

Binding affinity of HLA-DR supertype and DR3 motif-positive peptides

| | | | | | | | |
|---|---|---|---|---|---|---|---|
| F209.05 | GIQYLAGLSTLPGNPAIA | 12674 | 18 | HCV | | | 9 |
| F209.06 | KGGRKPARLIVFPDLGVRVC | 12675 | 20 | HCV | | | 10 |
| F209.07 | CGKYLFNWAVRTKLKLTPIA | 12676 | 20 | HCV | | | 13 |
| 90.0062 | NGWFYVEAVIDRQTG | 12677 | 15 | HPV | E1 | 15 | 8 |
| 90.0075 | TGWFEVEAVIERRTG | 12678 | 15 | HPV | E1 | 15 | 3 |
| 90.0029 | NGWFYVEAVVEKKTG | 12679 | 15 | HPV | E1 | 16 | 7 |
| 90.0126 | EDEIDTDLDGFIDDS | 12680 | 15 | HPV | E1 | 40 | 8 |
| 90.0077 | LLEFIDDSMENSIQA | 12681 | 15 | HPV | E1 | 47 | 6 |
| 89.0078 | VDFIDTQLSICEQAE | 12682 | 15 | HPV | E1 | 48 | 5 |
| 90.0031 | VDFIVNDNDYLTQAE | 12683 | 15 | HPV | E1 | 49 | 4 |
| 90.0078 | ENSIQADTEAARALF | 12684 | 15 | HPV | E1 | 56 | 1 |
| 89.0022 | QAELETAQALFHAQE | 12685 | 15 | HPV | E1 | 60 | 4 |
| 89.0114 | GQQLLQVQTAFIADKQ | 12686 | 15 | HPV | E1 | 66 | 1 |
| 89.0115 | QQLLQVQTAHADKQT | 12687 | 15 | HPV | E1 | 67 | 2 |
| 89.0001 | HALFTAQEAKQHRDA | 12688 | 15 | HPV | E1 | 68 | 1 |
| 90.0047 | AQEVHNDAQVLHVLK | 12689 | 15 | HPV | E1 | 72 | 4 |
| 89.0093 | EDDLHAVSAVKRKFT | 12690 | 15 | HPV | E1 | 76 | 4 |
| 90.0048 | GERLEVDTELSPRLQ | 12691 | 15 | HPV | E1 | 100 | 1 |
| 90.0129 | QQTVCREGVKRRLIL | 12692 | 15 | HPV | E1 | 100 | 3 |
| 90.0064 | LKAICIENNSKTAKR | 12693 | 15 | HPV | E1 | 109 | 7 |
| 90.0032 | LKAICIEKQSRAAKR | 12694 | 15 | HPV | E1 | 110 | 7 |
| 89.0039 | NTEVETQQMVQVEEQ | 12695 | 15 | HPV | E1 | 135 | 1 |
| 89.0059 | NTEVETQQMVQQVES | 12696 | 15 | HPV | E1 | 135 | 1 |
| 89.0002 | NTEVETQQMLQVEGR | 12697 | 15 | HPV | E1 | 136 | 1 |
| 89.0040 | MVQVEEQQTTLSCNG | 12698 | 15 | HPV | E1 | 143 | 2 |
| 89.0041 | LYGVSFMELIRPFQS | 12699 | 15 | HPV | E1 | 194 | 8 |
| 89.0003 | LNVLKTSNAKAAMLA | 12700 | 15 | HPV | E1 | 195 | 12 |
| 89.0140 | ILLYKFKEAYGVSFM | 12701 | 15 | HPV | E1 | 199 | 1 |
| 89.0094 | TVLFKFKETYGVSFM | 12702 | 15 | HPV | E1 | 202 | 8 |
| 89.0060 | AYGISFMELVRPFKS | 12703 | 15 | HPV | E1 | 207 | 6 |
| 89.0095 | TYGVSFMELVRPFKS | 12704 | 15 | HPV | E1 | 210 | 4 |
| 90.0050 | MLAVFKDTYGLSFTD | 12705 | 15 | HPV | E1 | 214 | 4 |
| 89.0042 | DWCVAAFGVTGTVAE | 12706 | 15 | HPV | E1 | 215 | 8 |
| 89.0079 | DWVMAIFGVNPTVAE | 12707 | 15 | HPV | E1 | 228 | 11 |
| 89.0080 | VMAIFGVNPTVAEGF | 12708 | 15 | HPV | E1 | 230 | 10 |
| 90.0051 | VRNFKSDKTTCTDWV | 12709 | 15 | HPV | E1 | 230 | 6 |
| 89.0081 | MAIFGVNPTVAEGFK | 12710 | 15 | HPV | E1 | 231 | 9 |
| 89.0096 | DWCIIGMGVTPSVAE | 12711 | 15 | HPV | E1 | 231 | 1 |
| 89.0097 | WCIIGMGVTPSVAEG | 12712 | 15 | HPV | E1 | 232 | 1 |
| 89.0119 | LKTIIKPHCMYYHMQ | 12713 | 15 | HPV | E1 | 238 | 1 |
| 89.0023 | VTAIFGVNPTIAEGF | 12714 | 15 | HPV | E1 | 244 | 5 |
| 89.0061 | LKVLIKQHSLYTHLQ | 12715 | 15 | HPV | E1 | 244 | 12 |
| 89.0082 | FKTLIKPATLYAHIQ | 12716 | 15 | HPV | E1 | 244 | 11 |
| 89.0142 | LKVLIKQHSIYTHLQ | 12717 | 15 | HPV | E1 | 244 | 1 |
| 89.0024 | TAIFGVNPTIAEGFK | 12718 | 15 | HPV | E1 | 245 | 7 |
| 89.0083 | KTLIKPATLYAHIQC | 12719 | 15 | HPV | E1 | 245 | 10 |
| 89.0098 | LKVLIQPYSIYAHLQ | 12720 | 15 | HPV | E1 | 247 | 10 |
| 89.0043 | ACSWGMVMLMLVRFK | 12721 | 15 | HPV | E1 | 248 | 4 |
| 89.0044 | SWGMVMLMLVRFKCA | 12722 | 15 | HPV | E1 | 250 | 3 |
| 89.0025 | FKTLIQPFILYAHIQ | 12723 | 15 | HPV | E1 | 258 | 11 |
| 89.0062 | DRGIIILLLIRFRCS | 12724 | 15 | HPV | E1 | 263 | 1 |

TABLE 186-continued

Binding affinity of HLA-DR supertype and DR3 motif-positive peptides

| | | | | | | | |
|---|---|---|---|---|---|---|---|
| 89.0063 | RGIIILLLIRFRCSK | 12725 | 15 | HPV | E1 | 264 | 8 |
| 89.0099 | DRGVLILLLIRFKCG | 12726 | 15 | HPV | E1 | 266 | 8 |
| 89.0004 | ACSWGMVVLLLVRYK | 12727 | 15 | HPV | E1 | 268 | 4 |
| 89.0005 | SWGMVVLLLVRYKCG | 12728 | 15 | HPV | E1 | 270 | 3 |
| 89.0045 | EKLLEKLLCISTNCM | 12729 | 15 | HPV | E1 | 271 | 3 |
| 89.0123 | RKTIAKALSSILNVP | 12730 | 15 | HPV | E1 | 274 | 1 |
| 89.0026 | DCKWGVLILALLRYK | 12731 | 15 | HPV | E1 | 275 | 5 |
| 89.0027 | KWGVLILALLRYKCG | 12732 | 15 | HPV | E1 | 277 | 10 |
| 89.0064 | KNRLTVAKLMSNLLS | 12733 | 15 | HPV | E1 | 278 | 10 |
| 89.0065 | RLTVAKLMSNLLSIP | 12734 | 15 | HPV | E1 | 280 | 13 |
| 89.0046 | TNCMLIQPPKLRSTA | 12735 | 15 | HPV | E1 | 282 | 3 |
| 89.0100 | RLTVSKLMSQLLNIP | 12736 | 15 | HPV | E1 | 283 | 1 |
| 89.0047 | CMLIQPPKLRSTAAA | 12737 | 15 | HPV | E1 | 284 | 5 |
| 89.0066 | AKLMSNLLSIPETCM | 12738 | 15 | HPV | E1 | 284 | 8 |
| 89.0101 | VSKLMSQLLNIPETH | 12739 | 15 | HPV | E1 | 286 | 1 |
| 89.0006 | RETIEKLLSKLLCVS | 12740 | 15 | HPV | E1 | 287 | 8 |
| 89.0067 | SNLLSIPETCMVIEP | 12741 | 15 | HPV | E1 | 288 | 8 |
| 89.0124 | QEQMLIQPPKIRSPA | 12742 | 15 | HPV | E1 | 289 | 2 |
| 89.0007 | EKLLSKLLCVSPMCM | 12743 | 15 | HPV | E1 | 291 | 5 |
| 89.0102 | SQLLNIPETHMVIEP | 12744 | 15 | HPV | E1 | 291 | 1 |
| 89.0028 | RLTVAKGLSTLLHVP | 12745 | 15 | HPV | E1 | 294 | 12 |
| 89.0084 | ETCMLIEPPKLRSSV | 12746 | 15 | HPV | E1 | 295 | 11 |
| 90.0083 | ETCMVIEPPKLRSQT | 12747 | 15 | HPV | E1 | 295 | 8 |
| 89.0103 | ETHMVIEPPKLRSAT | 12748 | 15 | HPV | E1 | 298 | 2 |
| 90.0034 | PMCMMIEPPKLRSTA | 12749 | 15 | HPV | E1 | 302 | 6 |
| 89.0029 | ETCMLIQPPKLRSSV | 12750 | 15 | HPV | E1 | 309 | 7 |
| 89.0048 | TPEWIERQTVLQHSF | 12751 | 15 | HPV | E1 | 316 | 4 |
| 89.0049 | PEWIERQTVLQHSFN | 12752 | 15 | HPV | E1 | 317 | 8 |
| 89.0009 | LYWYKTGISNISEVY | 12753 | 15 | HPV | E1 | 319 | 9 |
| 89.0069 | TPEWIDRLTVLQHSF | 12754 | 15 | HPV | E1 | 329 | 4 |
| 90.0035 | ISEVYGDTPEWIQRQ | 12755 | 15 | HPV | E1 | 329 | 2 |
| 89.0070 | PEWIDRLTVLQHSFN | 12756 | 15 | HPV | E1 | 330 | 6 |
| 89.0050 | DTTFDLSQMVQWAYD | 12757 | 15 | HPV | E1 | 332 | 6 |
| 89.0104 | TPEWIEQQTVLQHSF | 12758 | 15 | HPV | E1 | 332 | 3 |
| 89.0105 | PEWIEQQTVLQHSFD | 12759 | 15 | HPV | E1 | 333 | 1 |
| 89.0010 | TPEWIQRQTVLQHSF | 12760 | 15 | HPV | E1 | 336 | 6 |
| 90.0052 | ISEVMGDTPEWIQRL | 12761 | 15 | HPV | E1 | 336 | 2 |
| 89.0011 | PEWIQRQTVLQHSFN | 12762 | 15 | HPV | E1 | 337 | 8 |
| 90.0152 | QHSFNDDIFDLSEMI | 12763 | 15 | HPV | E1 | 340 | 9 |
| 89.0030 | TPEWIQRLTIIQHGI | 12764 | 15 | HPV | E1 | 343 | 9 |
| 89.0031 | PEWIQRLTIIQHGID | 12765 | 15 | HPV | E1 | 344 | 10 |
| 90.0069 | DNDVMDDSEIAYKYA | 12766 | 15 | HPV | E1 | 346 | 1 |
| 89.0106 | NSIFDFGEMVQWAYD | 12767 | 15 | HPV | E1 | 348 | 1 |
| 89.0051 | DSEIAYKYAQLADSD | 12768 | 15 | HPV | E1 | 352 | 2 |
| 89.0130 | DSQIAFQYAQLADVD | 12769 | 15 | HPV | E1 | 359 | 1 |
| 90.0085 | DNELTDDSDIAYYYA | 12770 | 15 | HPV | E1 | 359 | 1 |
| 90.0036 | QWAYDNDIVDDSEIA | 12771 | 15 | HPV | E1 | 362 | 1 |
| 90.0117 | DHDITDDSDIAYKYA | 12772 | 15 | HPV | E1 | 362 | 4 |
| 89.0071 | DSDIAYYYAQLADSN | 12773 | 15 | HPV | E1 | 365 | 3 |
| 89.0085 | ESDMAFQYAQLADCN | 12774 | 15 | HPV | E1 | 365 | 4 |
| 90.0037 | DNDIVDDSEIAYKYA | 12775 | 15 | HPV | E1 | 366 | 1 |

TABLE 186-continued

Binding affinity of HLA-DR supertype and DR3 motif-positive peptides

| | | | | | | | |
|---|---|---|---|---|---|---|---|
| 89.0072 | IAYYYAQLADSNSNA | 12776 | 15 | HPV | E1 | 368 | 3 |
| 89.0108 | DIAYKYAQLADVNSN | 12777 | 15 | HPV | E1 | 370 | 3 |
| 89.0012 | DSEIAYKYAQLADTN | 12778 | 15 | HPV | E1 | 372 | 2 |
| 90.0070 | QAKIVKDCGTMCRHY | 12779 | 15 | HPV | E1 | 378 | 1 |
| 90.0055 | ESDMAFEYALLADSN | 12780 | 15 | HPV | E1 | 379 | 8 |
| 90.0139 | QAKYVKDCGIMCRHY | 12781 | 15 | HPV | E1 | 385 | 9 |
| 90.0086 | QAKIVKDCGIMCRHY | 12782 | 15 | HPV | E1 | 391 | 2 |
| 90.0103 | QAKYLKDCAVMCRHY | 12783 | 15 | HPV | E1 | 391 | 5 |
| 90.0038 | QAKIVKDCATMCRHY | 12784 | 15 | HPV | E1 | 398 | 1 |
| 89.0052 | VKFLRYQQIEFVSFL | 12785 | 15 | HPV | E1 | 423 | 5 |
| 89.0053 | VSFLSALKLFLKGVP | 12786 | 15 | HPV | E1 | 434 | 8 |
| 89.0013 | GGDWKQIVMFLRYQG | 12787 | 15 | HPV | E1 | 436 | 8 |
| 89.0054 | LKLFLKGVPKKNCIL | 12788 | 15 | HPV | E1 | 440 | 6 |
| 89.0014 | VMFLRYQGVEFMSFL | 12789 | 15 | HPV | E1 | 443 | 7 |
| 89.0132 | FLSYFKLFLQGTPKH | 12790 | 15 | HPV | E1 | 443 | 1 |
| 89.0133 | YFKLFLQGTPKHNCL | 12791 | 15 | HPV | E1 | 446 | 3 |
| 89.0134 | FKLFLQGTPKHNCLV | 12792 | 15 | HPV | E1 | 447 | 6 |
| 89.0055 | KNCILIHGAPNTGKS | 12793 | 15 | HPV | E1 | 450 | 1 |
| 89.0015 | VEFMSFLTALKRFLQ | 12794 | 15 | HPV | E1 | 451 | 11 |
| 89.0073 | FKKFLKGIPKKSCML | 12795 | 15 | HPV | E1 | 453 | 8 |
| 89.0086 | LKEFLKGTPKKNCIL | 12796 | 15 | HPV | E1 | 453 | 1 |
| 89.0033 | IEFITFLGALKSFLK | 12797 | 15 | HPV | E1 | 458 | 10 |
| 89.0016 | LKRFLQGIPKKNCIL | 12798 | 15 | HPV | E1 | 460 | 4 |
| 89.0034 | ITFLGALKSFLKGTP | 12799 | 15 | HPV | E1 | 461 | 8 |
| 89.0056 | GKSYFGMSLISFLQG | 12800 | 15 | HPV | E1 | 462 | 5 |
| 89.0074 | SCMLICGPANTGKSY | 12801 | 15 | HPV | E1 | 464 | 2 |
| 89.0087 | NCILLYGPANTGKSY | 12802 | 15 | HPV | E1 | 464 | 4 |
| 89.0035 | LKSFLKGTPKKNCLV | 12803 | 15 | HPV | E1 | 467 | 8 |
| 89.0017 | NCILLYGAANTGKSL | 12804 | 15 | HPV | E1 | 471 | 5 |
| 89.0018 | ILLYGAANTGKSLFG | 12805 | 15 | HPV | E1 | 473 | 3 |
| 89.0075 | GKSYFGMSLIQFLKG | 12806 | 15 | HPV | E1 | 475 | 8 |
| 89.0146 | GKSYFGMSLIHFLKG | 12807 | 15 | HPV | E1 | 475 | 2 |
| 89.0135 | LIKFFQGSVISFVNS | 12808 | 15 | HPV | E1 | 477 | 1 |
| 89.0136 | IKFFQGSVISFVNSQ | 12809 | 15 | HPV | E1 | 478 | 2 |
| 89.0019 | GKSLFGMSLMKFLQG | 12810 | 15 | HPV | E1 | 482 | 9 |
| 89.0020 | KSLFGMSLMKFLQGS | 12811 | 15 | HPV | E1 | 483 | 7 |
| 89.0088 | FIHFLQGAIISFVNS | 12812 | 15 | HPV | E1 | 483 | 3 |
| 89.0076 | IQFLKGCVISCVNSK | 12813 | 15 | HPV | E1 | 484 | 7 |
| 89.0089 | IHFLQGAIISFVNSN | 12814 | 15 | HPV | E1 | 484 | 8 |
| 89.0147 | IHFLKGCIISYVNSK | 12815 | 15 | HPV | E1 | 484 | 1 |
| 89.0036 | FIHFIQGAVISFVNS | 12816 | 15 | HPV | E1 | 497 | 7 |
| 89.0037 | IHFIQGAVISFVNST | 12817 | 15 | HPV | E1 | 498 | 6 |
| 90.0087 | KIGMIDDVTPISWTY | 12818 | 15 | HPV | E1 | 510 | 3 |
| 90.0105 | KVAMLDDATHTCWTY | 12819 | 15 | HPV | E1 | 510 | 6 |
| 90.0040 | KIGMLDDATVPCWNY | 12820 | 15 | HPV | E1 | 517 | 2 |
| 89.0090 | CWTYFDNYMRNALDG | 12821 | 15 | HPV | E1 | 521 | 1 |
| 89.0137 | RNLVDGNPISLDRKH | 12822 | 15 | HPV | E1 | 524 | 1 |
| 90.0059 | KVAMLDDATHTCWTY | 12823 | 15 | HPV | E1 | 524 | 4 |
| 90.0041 | CWNYIDDNLRNALDG | 12824 | 15 | HPV | E1 | 528 | 1 |
| 89.0057 | LMQLKCPPLLITSNI | 12825 | 15 | HPV | E1 | 534 | 5 |
| 89.0138 | LVQIKCPPLLITTNI | 12826 | 15 | HPV | E1 | 541 | 1 |

TABLE 186-continued

Binding affinity of HLA-DR supertype and DR3 motif-positive peptides

| | | | | | | | |
|---|---|---|---|---|---|---|---|
| 89.0077 | LVQLKCPPLLLTSNT | 12827 | 15 | HPV | E1 | 547 | 3 |
| 89.0091 | LLQLKCPPILLTSNI | 12828 | 15 | HPV | E1 | 547 | 3 |
| 89.0139 | PPLLITTNINPMLDA | 12829 | 15 | HPV | E1 | 547 | 2 |
| 89.0058 | DDRWPYLHSRLVVFT | 12830 | 15 | HPV | E1 | 553 | 7 |
| 89.0021 | LVQLKCPPLLITSNI | 12831 | 15 | HPV | E1 | 554 | 4 |
| 89.0038 | LIQLKCPPILLTTNI | 12832 | 15 | HPV | E1 | 561 | 3 |
| 89.0113 | DPRWPYLHSRLVVFH | 12833 | 15 | HPV | E1 | 569 | 6 |
| 89.0092 | VTVFTFPHAFPFDKN | 12834 | 15 | HPV | E1 | 576 | 7 |
| 90.0106 | PHAFPFDKNGNPVYE | 12835 | 15 | HPV | E1 | 582 | 5 |
| 90.0144 | RLNLDNDEDKENNGD | 12836 | 15 | HPV | E1 | 606 | 7 |
| 1601.21 | LSQRLNVCQDKILEH | 12837 | 15 | HPV | E2 | 4 | 1 |
| 90.0160 | RLNVCQDKILTHYEN | 12838 | 15 | HPV | E2 | 7 | 9 |
| 1601.01 | YENDSTDLRDHIDYW | 12839 | 15 | HPV | E2 | 19 | 1 |
| 1601.29 | LDHYENDSKDINSQI | 12840 | 15 | HPV | E2 | 22 | 1 |
| 90.0021 | HWKLIRMECAIMYTA | 12841 | 15 | HPV | E2 | 32 | 7 |
| 90.0199 | WKLIRMECALLYTAK | 12842 | 15 | HPV | E2 | 33 | 7 |
| 90.0230 | WKAVRHENVLYYKAR | 12843 | 15 | HPV | E2 | 33 | 11 |
| 90.0245 | WKLIRMECAIMYTAR | 12844 | 15 | HPV | E2 | 33 | 8 |
| 1601.44 | KHIRLLECVLMYKARE | 12845 | 16 | HPV | E2 | 34 | 9 |
| 89.0179 | LIRMECALLYTAKQM | 12846 | 15 | HPV | E2 | 35 | 1 |
| 90.0022 | LIRMECAIMYTARQM | 12847 | 15 | HPV | E2 | 35 | 9 |
| 90.0211 | WQLIRLENAILFTAR | 12848 | 15 | HPV | E2 | 39 | 12 |
| 90.0002 | LIRLENAILFTAREH | 12849 | 15 | HPV | E2 | 41 | 4 |
| 90.0010 | ITHIGHQVVPPMAVS | 12850 | 15 | HPV | E2 | 51 | 2 |
| 89.0168 | NHQVVPALSVSKAKA | 12851 | 15 | HPV | E2 | 55 | 2 |
| 90.0011 | GHQVVPPMAVSKAKA | 12852 | 15 | HPV | E2 | 55 | 3 |
| 89.0169 | HQVVPALSVSKAKAL | 12853 | 15 | HPV | E2 | 56 | 3 |
| 90.0012 | HQVVPPMAVSKAKAC | 12854 | 15 | HPV | E2 | 56 | 4 |
| 90.0023 | HQVVPSLVASKTKAF | 12855 | 15 | HPV | E2 | 56 | 1 |
| 89.0150 | TLAVSKNKALQAIEL | 12856 | 15 | HPV | E2 | 61 | 2 |
| 89.0170 | ALSVSKAKALQAIEL | 12857 | 15 | HPV | E2 | 61 | 2 |
| 90.0013 | PMAVSKAKACQAIEL | 12858 | 15 | HPV | E2 | 61 | 4 |
| 89.0159 | AYNISKSKAHKAIEL | 12859 | 15 | HPV | E2 | 65 | 1 |
| 89.0151 | NKALQAIELQLTLET | 12860 | 15 | HPV | E2 | 67 | 3 |
| 89.0171 | AKALQAIELQMMLET | 12861 | 15 | HPV | E2 | 67 | 9 |
| 1601.30 | PINISKSKAHKAIEL | 12862 | 15 | HPV | E2 | 67 | 9 |
| 89.0181 | AFQVIELQMALETLS | 12863 | 15 | HPV | E2 | 69 | 7 |
| 90.0024 | AFQVIELQMALETLN | 12864 | 15 | HPV | E2 | 69 | 7 |
| 89.0182 | FQVIELQMALETLSK | 12865 | 15 | HPV | E2 | 70 | 4 |
| 90.0014 | CQAIELQLALEALNK | 12866 | 15 | HPV | E2 | 70 | 6 |
| 90.0018 | CSAIEVQIALESLST | 12867 | 15 | HPV | E2 | 70 | 4 |
| 90.0025 | FQVIELQMALETLNA | 12868 | 15 | HPV | E2 | 70 | 7 |
| 89.0160 | HKAIELQMALQGLAQ | 12869 | 15 | HPV | E2 | 74 | 1 |
| 89.0183 | ELQMALETLSKSQYS | 12870 | 15 | HPV | E2 | 74 | 3 |
| 90.0231 | EVQIALESLSTTIYN | 12871 | 15 | HPV | E2 | 74 | 7 |
| 90.0004 | HKAIELQMALKGLAQ | 12872 | 15 | HPV | E2 | 76 | 11 |
| 1601.22 | QMMLETLNNTEYKNE | 12873 | 15 | HPV | E2 | 76 | 3 |
| 1601.03 | LETIYNSQYSNEKWT | 12874 | 15 | HPV | E2 | 79 | 3 |
| 90.0005 | ELQMALKGLAQSKYN | 12875 | 15 | HPV | E2 | 80 | 8 |
| 90.0232 | TTIYNNEEWTLRDTC | 12876 | 15 | HPV | E2 | 84 | 1 |
| 90.0179 | QSRYKTEDWTLQDTC | 12877 | 15 | HPV | E2 | 88 | 9 |

TABLE 186-continued

Binding affinity of HLA-DR supertype and DR3 motif-positive peptides

| | | | | | | | |
|---|---|---|---|---|---|---|---|
| 1601.23 | PTGCLKKHGYTVEVQ | 12878 | 15 | HPV | E2 | 106 | 1 |
| 90.0026 | QKCFKKKGITVTVQY | 12879 | 15 | HPV | E2 | 107 | 4 |
| 90.0167 | TVEVQFDGDICNTMH | 12880 | 15 | HPV | E2 | 116 | 6 |
| 1601.04 | DICNTMHYTNWTHIY | 12881 | 15 | HPV | E2 | 124 | 2 |
| 1601.09 | GNKDNCMTYVAWDSV | 12882 | 15 | HPV | E2 | 127 | 3 |
| 90.0202 | GEIYIIEEDTCTMVT | 12883 | 15 | HPV | E2 | 135 | 4 |
| 90.0214 | MNYVVWDSIYYITET | 12884 | 15 | HPV | E2 | 135 | 7 |
| 90.0250 | SEIYIIEETTCTLVA | 12885 | 15 | HPV | E2 | 135 | 5 |
| 90.0203 | EIYIIEEDTCTMVTG | 12886 | 15 | HPV | E2 | 136 | 3 |
| 90.0251 | EIYIIEETTCTLVAG | 12887 | 15 | HPV | E2 | 136 | 3 |
| 1601.10 | VAWDSVYYMTDAGTW | 12888 | 15 | HPV | E2 | 136 | 5 |
| 90.0204 | IYIIEEDTCTMVTGK | 12889 | 15 | HPV | E2 | 137 | 3 |
| 90.0182 | SVYYMTDAGTWDKTA | 12890 | 15 | HPV | E2 | 140 | 8 |
| 90.0252 | CTLVAGEVDYVGLYY | 12891 | 15 | HPV | E2 | 145 | 6 |
| 90.0171 | GLYYVHEGIRTYFVQ | 12892 | 15 | HPV | E2 | 156 | 7 |
| 90.0226 | GLYYWCDGEKIYFVK | 12893 | 15 | HPV | E2 | 156 | 2 |
| 1601.05 | VHEGIRTYFVQFKDD | 12894 | 15 | HPV | E2 | 160 | 1 |
| 90.0216 | GVYYIKDGDTTYYVQ | 12895 | 15 | HPV | E2 | 163 | 2 |
| 90.0205 | YFKYFKEDAAKYSKT | 12896 | 15 | HPV | E2 | 167 | 3 |
| 90.0253 | YFKYFKEDAKKYSKT | 12897 | 15 | HPV | E2 | 167 | 4 |
| 90.0206 | FKYFKEDAAKYSKTQ | 12898 | 15 | HPV | E2 | 168 | 9 |
| 1601.11 | EKYGNTGTWEVHFGN | 12899 | 15 | HPV | E2 | 181 | 2 |
| 90.0237 | IWEVHMENESIYCPD | 12900 | 15 | HPV | E2 | 183 | 1 |
| 89.0184 | EVHVGGQVIVCPTSI | 12901 | 15 | HPV | E2 | 185 | 1 |
| 90.0015 | EVHVGGQVIVCPASV | 12902 | 15 | HPV | E2 | 185 | 3 |
| 90.0238 | EVHMENESIYCPDSV | 12903 | 15 | HPV | E2 | 185 | 3 |
| 89.0173 | GQVIVFPESVFSSDE | 12904 | 15 | HPV | E2 | 190 | 1 |
| 89.0185 | GQVIVCPTSISSNQI | 12905 | 15 | HPV | E2 | 190 | 3 |
| 90.0016 | GQVIVCPASVSSNEV | 12906 | 15 | HPV | E2 | 190 | 8 |
| 90.0027 | SRVIVCPTSIPSDQI | 12907 | 15 | HPV | E2 | 190 | 1 |
| 90.0195 | ESVFSSDEISFAGIV | 12908 | 15 | HPV | E2 | 197 | 5 |
| 1601.06 | SNEVSSPEIIRQHLA | 12909 | 15 | HPV | E2 | 202 | 1 |
| 1601.45 | SDEISFAGIVTKLPT | 12910 | 15 | HPV | E2 | 202 | 5 |
| 89.0174 | EISFAGIVTKLPTAN | 12911 | 15 | HPV | E2 | 204 | 1 |
| 89.0175 | FAGIVTKLPTANNTT | 12912 | 15 | HPV | E2 | 207 | 4 |
| 1601.13 | SDDTVSATQLVKQLQ | 12913 | 15 | HPV | E2 | 208 | 1 |
| 1601.31 | STSDDTVSATQIVRQ | 12914 | 15 | HPV | E2 | 208 | 2 |
| 89.0162 | DDTVSATQLVKQLQH | 12915 | 15 | HPV | E2 | 209 | 12 |
| 89.0155 | RQHLANHPAATHTKA | 12916 | 15 | HPV | E2 | 212 | 1 |
| 89,0163 | TVSVGTAKTYGQTSA | 12917 | 15 | HPV | E2 | 231 | 2 |
| 90.0208 | TKLFCADPALDNRTA | 12918 | 15 | HPV | E2 | 241 | 1 |
| 89.0186 | DPALDNRTARTATNC | 12919 | 15 | HPV | E2 | 247 | 2 |
| 1601.07 | PCHTTKLLHRDSVDS | 12920 | 15 | HPV | E2 | 250 | 1 |
| 89.0156 | RDSVDSAPILTAFNS | 12921 | 15 | HPV | E2 | 259 | 4 |
| 1601.34 | GRVNTHVHNPLLCSS | 12922 | 15 | HPV | E2 | 262 | 3 |
| 89.0165 | NPLLGAATPTGNNKR | 12923 | 15 | HPV | E2 | 264 | 2 |
| 1601.24 | DSVDSVNCGVISAAA | 12924 | 15 | HPV | E2 | 265 | 3 |
| 1601.16 | KRRKLCSGNTTPIIH | 12925 | 15 | HPV | E2 | 277 | 6 |
| 1601.08 | NCNSNTTPIVHLKGD | 12926 | 15 | HPV | E2 | 280 | 2 |
| 1601.35 | NKRRKVCSGNTTPIIH | 12927 | 15 | HPV | E2 | 280 | 2 |
| 90.0255 | IVHLKGDPNSLKCLR | 12928 | 15 | HPV | E2 | 281 | 4 |

TABLE 186-continued

Binding affinity of HLA-DR supertype and DR3 motif-positive peptides

| | | | | | | | |
|---|---|---|---|---|---|---|---|
| 1601.43 | RKVCSGNTTPIIHLK | 12929 | 15 | HPV | E2 | 283 | 3 |
| 1601.17 | TTPIIHKLGDRNSLK | 12930 | 15 | HPV | E2 | 286 | 7 |
| 1601.37 | NTTPIIHLKGDKNSL | 12931 | 15 | HPV | E2 | 289 | 2 |
| 90.0228 | IIHLKGDPNSLKCLR | 12932 | 15 | HPV | E2 | 290 | 6 |
| 1601.25 | TTPIIHLKGDANILK | 12933 | 15 | HPV | E2 | 292 | 6 |
| 90.0218 | IIHLKGDKNSLKCLR | 12934 | 15 | HPV | E2 | 293 | 5 |
| 90.0197 | IIHLKGDANILKCLR | 12935 | 15 | HPV | E2 | 295 | 7 |
| 1601.26 | LKGDANILKCLRYRL | 12936 | 15 | HPV | E2 | 298 | 2 |
| 89.0157 | HCTLYTAVSSTWHWT | 12937 | 15 | HPV | E2 | 308 | 1 |
| 90.0019 | RYRFQKYKTLFVDVT | 12938 | 15 | HPV | E2 | 308 | 10 |
| 90.0241 | YKTLFVDVTSTYHWT | 12939 | 15 | HPV | E2 | 314 | 6 |
| 90.0210 | TVTFVTEQQQQMFLG | 12940 | 15 | HPV | E2 | 322 | 4 |
| 1601.38 | STWHWTGCNKNTGIL | 12941 | 15 | HPV | E2 | 322 | 3 |
| 1601.18 | AGNEKTGILTVTYHS | 12942 | 15 | HPV | E2 | 325 | 2 |
| 89.0187 | QQQMFLGTVKIPPTV | 12943 | 15 | HPV | E2 | 330 | 3 |
| 89.0188 | QMFLGTVKIPPTVQI | 12944 | 15 | HPV | E2 | 332 | 11 |
| 90.0028 | LNTVKIPPTVQISTG | 12945 | 15 | HPV | E2 | 340 | 1 |
| 1601.19 | EKQRTKFLNTVAIPD | 12946 | 15 | HPV | E2 | 340 | 6 |
| 1601.27 | TYISTSQRDDFLNTV | 12947 | 15 | HPV | E2 | 343 | 2 |
| 1601.20 | FLNTVAIPDSVQILV | 12948 | 15 | HPV | E2 | 346 | 10 |
| 1601.39 | RNTFLDVVTIPNSVQ | 12949 | 15 | HPV | E2 | 346 | 9 |
| 89.0158 | LSQVKIPKTITVSTG | 12950 | 15 | HPV | E2 | 347 | 1 |
| 1601.40 | FLDVVTIPNSVQISV | 12951 | 15 | HPV | E2 | 349 | 5 |
| 90,0017 | LKTVKIPNTVQVIQG | 12952 | 15 | HPV | E2 | 350 | 2 |
| 90.0020 | LSHVKIPVVYRLVWD | 12953 | 15 | HPV | E2 | 352 | 8 |
| 1601.28 | DFLNTVKIPNTVSVS | 12954 | 15 | HPV | E2 | 352 | 7 |
| 1601.41 | VVTIPNSVQISVGYM | 12955 | 15 | HPV | E2 | 352 | 6 |
| 89.0178 | LNTVKIPNTVSVSTG | 12956 | 15 | HPV | E2 | 354 | 8 |
| 1601.42 | TIPNSVQISVGYMTI | 12957 | 15 | HPV | E2 | 354 | 11 |
| 85.0001 | ECVYCKQQLLRREVY | 12958 | 15 | HPV | E6 | 36 | 1 |
| 85.0024 | SEVYDFAFADLTVVY | 12959 | 15 | HPV | E6 | 40 | 5 |
| 85.0138 | YDFVFADLRIVYRDG | 12960 | 15 | HPV | E6 | 43 | 2 |
| 85.0054 | DFVFADLRIVYRDGN | 12961 | 15 | HPV | E6 | 44 | 3 |
| 85.0041 | RIVYRDNNPYGVCIM | 12962 | 15 | HPV | E6 | 51 | 6 |
| 85.0002 | CIVYRDGNPYAVCDK | 12963 | 15 | HPV | E6 | 58 | 3 |
| 85.0022 | CDLLIRCITCQRPLC | 12964 | 15 | HPV | E6 | 97 | 1 |
| 85.0031 | NEILIRCIICQRPLC | 12965 | 15 | HPV | E6 | 97 | 1 |
| 85.0032 | IRCIICQRPLCPQEK | 12966 | 15 | HPV | E6 | 101 | 1 |
| 85.0013 | IRCLRCQKPLNPAEK | 12967 | 15 | HPV | E6 | 103 | 1 |
| 1543.22 | QERPRKLPQLCTELQ | 12968 | 15 | HPV | E6 | | 2 |
| 1543.23 | RGRWTGRCMSCCRSS | 12969 | 15 | HPV | E6 | | 1 |
| 1543.24 | LCTELQTTIHDIILE | 12970 | 15 | HPV | E6 | | 1 |
| 1543.25 | RREVYDFAFRDLCIV | 12971 | 15 | HPV | E6 | | 1 |
| 1543.26 | RHLDKKQRFHNIRGR | 12972 | 15 | HPV | E6 | | 2 |
| 1543.27 | QRFHNIRGRWTGRCM | 12973 | 15 | HPV | E6 | | 5 |
| 1543.28 | HNIRGRWTGRCMSCC | 12974 | 15 | HPV | E6 | | 3 |
| 1543.29 | WTGRCMSCCRSSRTR | 12975 | 15 | HPV | E6 | | 2 |
| 1543.30 | RCMSCCRSSRTRRET | 12976 | 15 | HPV | E6 | | 4 |
| 1543.31 | MSCCRSSRTRRETQL | 12977 | 15 | HPV | E6 | | 3 |
| 1543.32 | TNTGLYNLLIRCLRC | 12978 | 15 | HPV | E6 | | 8 |
| 1543.34 | TELNTSLQDIEITCV | 12979 | 15 | HPV | E6 | | 1 |

TABLE 186-continued

Binding affinity of HLA-DR supertype and DR3 motif-positive peptides

| | | | | | | | | |
|---|---|---|---|---|---|---|---|---|
| 1543.35 | EVFEFAFKDLFVVYR | 12980 | 15 | HPV | E6 | | | 6 |
| 1543.37 | TGRCIACWRRPRTET | 12981 | 15 | HPV | E6 | | | 6 |
| 1543.39 | CQALETTIHNIELQC | 12982 | 15 | HPV | E6 | | | 3 |
| 1543.40 | FHSIAGQYRGQCNTC | 12983 | 15 | HPV | E6 | | | 6 |
| 1543.41 | QYRGQCNTCCDQARQ | 12984 | 15 | HPV | E6 | | | 1 |
| 1543.42 | TRPRTLHELCEVLEE | 12985 | 15 | HPV | E6 | | | 1 |
| 1543.46 | GCWRQTSREPRESTV | 12986 | 15 | HPV | E6 | | | 4 |
| 1543.48 | SEVYDFVFADLRIVY | 12987 | 15 | HPV | E6 | | | 8 |
| 1543.54 | RVCLLFYSKVRKYRY | 12988 | 15 | HPV | E6 | | | 11 |
| 1543.55 | HGWTGSCLGCWRQTS | 12989 | 15 | HPV | E6 | | | 2 |
| 1543.56 | CLGCWRQTSREPRES | 12990 | 15 | HPV | E6 | | | 2 |
| 1543.57 | IMCLRFLSKISEYRH | 12991 | 15 | HPV | E6 | | | 13 |
| 1543.58 | YRHYQYSLYGKTLEE | 12992 | 15 | HPV | E6 | | | 9 |
| 1543.59 | KERHVNANKRFHNIM | 12993 | 15 | HPV | E6 | | | 7 |
| 1543.60 | RFHNIMGRWTGRCSE | 12994 | 15 | HPV | E6 | | | 8 |
| 85.0092 | DLRVVQQLLMGALTV | 12995 | 15 | HPV | E7 | 82 | | 9 |
| 85.0101 | QLLMGTCTIVCPSCA | 12996 | 15 | HPV | E7 | 82 | | 1 |
| 1543.03 | EPDRAHYNIVTFCCK | 12997 | 15 | HPV | E7 | | | 1 |
| 1543.04 | LDLQPETTDLYCYEQ | 12998 | 15 | HPV | E7 | | | 2 |
| 1543.05 | GVNHQHLPARRAEPQ | 12999 | 15 | HPV | E7 | | | 1 |
| 1543.07 | SADDLRAFQQLFLNT | 13000 | 15 | HPV | E7 | | | 7 |
| 1543.10 | DYVLDLQPEATDLHC | 13001 | 15 | HPV | E7 | | | 5 |
| 1543.11 | QSTQVDIRILQELLM | 13002 | 15 | HPV | E7 | | | 4 |
| 1543.12 | EYVLDLYPEPTDLYC | 13003 | 15 | HPV | E7 | | | 4 |
| 1543.13 | LYCYEQLSDSSDEDE | 13004 | 15 | HPV | E7 | | | 1 |
| 1543.14 | YYIVTCCHTCNTIVR | 13005 | 15 | HPV | E7 | | | 6 |
| 1543.15 | LCVNSTASDLRTIQQ | 13006 | 15 | HPV | E7 | | | 5 |
| 1543.16 | LLMGTVNIVCPTCAQ | 13007 | 15 | HPV | E7 | | | 2 |
| 1543.17 | LMGTVNIVCPTCAQQ | 13008 | 15 | HPV | E7 | | | 7 |
| 1543.18 | DGVSHAQLPARRAEP | 13009 | 15 | HPV | E7 | | | 1 |
| 1543.19 | FLSTLSFVCPWCATN | 13010 | 15 | HPV | E7 | | | 6 |
| 1543.20 | EIVLHLEPQNELDPV | 13011 | 15 | HPV | E7 | | | 5 |
| 1543.21 | EDLRTLQQLFLSTLS | 13012 | 15 | HPV | E7 | | | 10 |
| 1543.43 | PDGQAEQATSNYYIV | 13013 | 15 | HPV | E7 | | | 1 |
| 1543.44 | TYCHSCDSTLRLCIH | 13014 | 15 | HPV | E7 | | | 3 |
| 1543.45 | CIHSTATDLRTLQQM | 13015 | 15 | HPV | E7 | | | 9 |
| 1543.51 | EYILDLHPEPTDLFC | 13016 | 15 | HPV | E7 | | | 6 |
| 1543.52 | TCGTTVRLCINSTTT | 13017 | 15 | HPV | E7 | | | 3 |
| 1543.53 | LMGTCTIVCPSCAQQ | 13018 | 15 | HPV | E7 | | | 3 |
| 9014.0015 | NASLLIQNSIQNDTG | 13019 | 15 | Human | CEA | 104 | A | 1 |
| 9014.0071 | QNFIQNDTGFYTLHV | 13020 | 15 | Human | CEA | 110 | A | 1 |
| 9014.0076 | QNWIQNDTGFYTLHV | 13021 | 15 | Human | CEA | 110 | A | 1 |
| 9014.0077 | QNYIQNDTGFYTLHV | 13022 | 15 | Human | CEA | 110 | A | 1 |
| 9014.0085 | QNIIQNDVGFYTLHV | 13023 | 15 | Human | CEA | 110 | A | 1 |
| 9014.0037 | KPSFSSNNSKPVEDK | 13024 | 15 | Human | CEA | 146 | A | 1 |
| 9014.0040 | KPSLSSNNSKPVEDK | 13025 | 15 | Human | CEA | 146 | A | 1 |
| 9014.0041 | KPSVSSNNSKPVEDK | 13026 | 15 | Human | CEA | 146 | A | 1 |
| 9014.0042 | KPSWSSNNSKPVEDK | 13027 | 15 | Human | CEA | 146 | A | 1 |
| 9014.0043 | KPSYSSNNSKPVEDK | 13028 | 15 | Human | CEA | 146 | A | 1 |
| 9014.0044 | KPSISSNNAKPVEDK | 13029 | 15 | Human | CEA | 146 | A | 1 |
| 58.0015 | LWWVNNESLPVSPRL | 13030 | 15 | Human | CEA | 177 | A | 1 |

TABLE 186-continued

Binding affinity of HLA-DR supertype and DR3 motif-positive peptides

| | | | | | | | | |
|---|---|---|---|---|---|---|---|---|
| 9014.0054 | RTTFKTITVSAELPK | 13031 | 15 | Human | CEA | 488 | A | 1 |
| 9014.0058 | RTTLKTITVSAELPK | 13032 | 15 | Human | CEA | 488 | A | 1 |
| 9014.0059 | RTTWKTITVSAELPK | 13033 | 15 | Human | CEA | 488 | A | 1 |
| 9014.0060 | RTTYKTITVSAELPK | 13034 | 15 | Human | CEA | 488 | A | 1 |
| 9014.0065 | RTTVKTITLSAELPK | 13035 | 15 | Human | CEA | 488 | A | 1 |
| 9014.0088 | GTDFKLRLPASPETH | 13036 | 15 | Human | Her2/neu | 28 | A | 1 |
| 9014.0090 | GTDIKLRLPASPETH | 13037 | 15 | Human | Her2/neu | 28 | A | 1 |
| 9014.0094 | GTDWKLRLPASPETH | 13038 | 15 | Human | Her2/neu | 28 | A | 1 |
| 9014.0095 | GTDYKLRLPASPETH | 13039 | 15 | Human | Her2/neu | 28 | A | 1 |
| 9014.0096 | GTDMKLRLAASPETH | 13040 | 15 | Human | Her2/neu | 28 | A | 1 |
| 9014.0097 | GTDMKLRLFASPETH | 13041 | 15 | Human | Her2/neu | 28 | A | 1 |
| 9014.0098 | GTDMKLRLHASPETH | 13042 | 15 | Human | Her2/neu | 28 | A | 1 |
| 9014.0099 | GTDMKLRLIASPETH | 13043 | 15 | Human | Her2/neu | 28 | A | 1 |
| 9014.0100 | GTDMKLRLLASPETH | 13044 | 15 | Human | Her2/neu | 28 | A | 1 |
| 9014.0101 | GTDMKLRLNASPETH | 13045 | 15 | Human | Her2/neu | 28 | A | 1 |
| 9014.0102 | GTDMKLRLSASPETH | 13046 | 15 | Human | Her2/neu | 28 | A | 1 |
| 9014.0103 | GTDMKLRLTASPETH | 13047 | 15 | Human | Her2/neu | 28 | A | 1 |
| 9014.0104 | GTDMKLRLVASPETH | 13048 | 15 | Human | Her2/neu | 28 | A | 1 |
| 9014.0115 | DMKLRLAASPETHLD | 13049 | 15 | Human | Her2/neu | 30 | A | 1 |
| 9014.0116 | DMKLRLFASPETHLD | 13050 | 15 | Human | Her2/neu | 30 | A | 1 |
| 9014.0118 | DMKLRLIASPETHLD | 13051 | 15 | Human | Her2/neu | 30 | A | 1 |
| 9014.0119 | DMKLRLLASPETHLD | 13052 | 15 | Human | Her2/neu | 30 | A | 1 |
| 9014.0120 | DMKLRLNASPETHLD | 13053 | 15 | Human | Her2/neu | 30 | A | 1 |
| 9014.0121 | DMKLRLSASPETHLD | 13054 | 15 | Human | Her2/neu | 30 | A | 1 |
| 9014.0123 | DMKLRLVASPETHLD | 13055 | 15 | Human | Her2/neu | 30 | A | 1 |
| 9014.0131 | DMKYRLPASPETHLD | 13056 | 15 | Human | Her2/neu | 30 | A | 1 |
| 9014.0135 | DMKLRLPAIPETHLD | 13057 | 15 | Human | Her2/neu | 30 | A | 1 |
| 1533.07 | KIFGSLAFLPESFDGDPA | 13058 | 18 | Human | Her2/neu | 369 | | 5 |
| 9014.0230 | KAFGSLAFLPESFDGDPA | 13059 | 18 | Human | Her2/neu | 369 | A | 1 |
| 9014.0231 | KFFGSLAFLPESFDGDPA | 13060 | 18 | Human | Her2/neu | 369 | A | 1 |
| 9014.0232 | KHFGSLAFLPESFDGDPA | 13061 | 18 | Human | Her2/neu | 369 | A | 1 |
| 9014.0233 | KKFGSLAFLPESFDGDPA | 13062 | 18 | Human | Her2/neu | 369 | A | 1 |
| 9014.0234 | KLFGSLAFLPESFDGDPA | 13063 | 18 | Human | Her2/neu | 369 | A | 1 |
| 9014.0235 | KVFGSLAFLPESFDGDPA | 13064 | 18 | Human | Her2/neu | 369 | A | 1 |
| 9014.0236 | KWFGSLAFLPESFDGDPA | 13065 | 18 | Human | Her2/neu | 369 | A | 1 |
| 9014.0237 | KYFGSLAFLPESFDGDPA | 13066 | 18 | Human | Her2/neu | 369 | A | 1 |
| 9014.0240 | KIFGSLIFLPESFDGDPA | 13067 | 18 | Human | Her2/neu | 369 | A | 1 |
| 9014.0241 | KIFGSLLFLPESFDGDPA | 13068 | 18 | Human | Her2/neu | 369 | A | 1 |
| 9014.0242 | KIFGSLNFLPESFDGDPA | 13069 | 18 | Human | Her2/neu | 369 | A | 1 |
| 9014.0243 | KIFGSLSFLPESFDGDPA | 13070 | 18 | Human | Her2/neu | 369 | A | 1 |
| 9014.0244 | KIFGSLTFLPESFDGDPA | 13071 | 18 | Human | Her2/neu | 369 | A | 1 |
| 9014.0245 | KIFGSLVFLPESFDGDPA | 13072 | 18 | Human | Her2/neu | 369 | A | 1 |
| 9014.0246 | KIFGSLAALPESFDGDPA | 13073 | 18 | Human | Her2/neu | 369 | A | 1 |
| 9014.0247 | KIFGSLAHLPESFDGDPA | 13074 | 18 | Human | Her2/neu | 369 | A | 1 |
| 9014.0248 | KIFGSLAILPESFDGDPA | 13075 | 18 | Human | Her2/neu | 369 | A | 1 |
| 9014.0250 | KIFGSLALLPESFDGDPA | 13076 | 18 | Human | Her2/neu | 369 | A | 1 |
| 9014.0251 | KIFGSLAVLPESFDGDPA | 13077 | 18 | Human | Her2/neu | 369 | A | 1 |
| 9014.0252 | KIFGSLAWLPESFDGDPA | 13078 | 18 | Human | Her2/neu | 369 | A | 1 |
| 9014.0253 | KIFGSLAYLPESFDGDPA | 13079 | 18 | Human | Her2/neu | 369 | A | 1 |
| 9014.0255 | KIFGSLAFLPESHDGDPA | 13080 | 18 | Human | Her2/neu | 369 | A | 1 |
| 9014.0257 | KIFGSLAFLPESLDGDPA | 13081 | 18 | Human | Her2/neu | 369 | A | 1 |

TABLE 186-continued

Binding affinity of HLA-DR supertype and DR3 motif-positive peptides

| | | | | | | | | |
|---|---|---|---|---|---|---|---|---|
| 1385.01 | QIQVFETLEET | 13082 | 11 | Human | Her2/neu | 396 | | 1 |
| 9014.0141 | ETEAVEPLTPSGAMP | 13083 | 15 | Human | Her2/neu | 693 | A | 1 |
| 9014.0142 | ETEFVEPLTPSGAMP | 13084 | 15 | Human | Her2/neu | 693 | A | 1 |
| 9014.0143 | ETEHVEPLTPSGAMP | 13085 | 15 | Human | Her2/neu | 693 | A | 1 |
| 9014.0144 | ETEIVEPLTPSGAMP | 13086 | 15 | Human | Her2/neu | 693 | A | 1 |
| 9014,0145 | ETEKVEPLTPSGAMP | 13087 | 15 | Human | Her2/neu | 693 | A | 1 |
| 9014.0146 | ETEVVEPLTPSGAMP | 13088 | 15 | Human | Her2/neu | 693 | A | 1 |
| 9014.0147 | ETEWVEPLTPSGAMP | 13089 | 15 | Human | Her2/neu | 693 | A | 1 |
| 9014.0148 | ETEYVEPLTPSGAMP | 13090 | 15 | Human | Her2/neu | 693 | A | 1 |
| 9014.0149 | ETELVEPLAPSGAMP | 13091 | 15 | Human | Her2/neu | 693 | A | 1 |
| 9014.0150 | ETELVEPLFPSGAMP | 13092 | 15 | Human | Her2/neu | 693 | A | 1 |
| 9014.0151 | ETELVEPLHPSGAMP | 13093 | 15 | Human | Her2/neu | 693 | A | 1 |
| 9014.0152 | ETELVEPLIPSGAMP | 13094 | 15 | Human | Her2/neu | 693 | A | 1 |
| 9014.0153 | ETELVEPLLPSGAMP | 13095 | 15 | Human | Her2/neu | 693 | A | 1 |
| 9014.0154 | ETELVEPLNPSGAMP | 13096 | 15 | Human | Her2/neu | 693 | A | 1 |
| 9014.0155 | ETELVEPLSPSGAMP | 13097 | 15 | Human | Her2/neu | 693 | A | 1 |
| 9014.0156 | ETELVEPLVPSGAMP | 13098 | 15 | Human | Her2/neu | 693 | A | 1 |
| 9014.0169 | KEILDEAYIMAGVGS | 13099 | 15 | Human | Her2/neu | 765 | A | 1 |
| 9014.0170 | KEILDEAYLMAGVGS | 13100 | 15 | Human | Her2/neu | 765 | A | 1 |
| 9014.0177 | ITDIGLARLLDIDET | 13101 | 15 | Human | Her2/neu | 861 | A | 1 |
| 9014.0183 | ITDFGLARALDIDET | 13102 | 15 | Human | Her2/neu | 861 | A | 1 |
| 9014.0187 | ITDFGLARSLDIDET | 13103 | 15 | Human | Her2/neu | 861 | A | 1 |
| 9014.0188 | ITDFGLARSLDIDET | 13104 | 15 | Human | Her2/neu | 861 | A | 1 |
| 9014.0210 | CWAIDSECRPRFREL | 13105 | 15 | Human | Her2/neu | 958 | A | 1 |
| 9014.0211 | CWFIDSECRPRFREL | 13106 | 15 | Human | Her2/neu | 958 | A | 1 |
| 9014.0212 | CWHIDSECRPRFREL | 13107 | 15 | Human | Her2/neu | 958 | A | 1 |
| 9014.0213 | CWIIDSECRPRFREL | 13108 | 15 | Human | Her2/neu | 958 | A | 1 |
| 9014.0214 | CWKIDSECRPRFREL | 13109 | 15 | Human | Her2/neu | 958 | A | 1 |
| 9014.0215 | CWLIDSECRPRFREL | 13110 | 15 | Human | Her2/neu | 958 | A | 1 |
| 9014.0218 | CWYIDSECRPRFREL | 13111 | 15 | Human | Her2/neu | 958 | A | 1 |
| 9014.0219 | CWMIDSEARPRFREL | 13112 | 15 | Human | Her2/neu | 958 | A | 1 |
| 9014.0220 | CWMIDSEFRPRFREL | 13113 | 15 | Human | Her2/neu | 958 | A | 1 |
| 9014.0221 | CWMIDSEHRPRFREL | 13114 | 15 | Human | Her2/neu | 958 | A | 1 |
| 9014.0222 | CWMIDSEIRPRFREL | 13115 | 15 | Human | Her2/neu | 958 | A | 1 |
| 9014.0223 | CWMIDSELRPRFREL | 13116 | 15 | Human | Her2/neu | 958 | A | 1 |
| 9014.0224 | CWMIDSENRPRFREL | 13117 | 15 | Human | Her2/neu | 958 | A | 1 |
| 9014.0225 | CWMIDSESRPRFREL | 13118 | 15 | Human | Her2/neu | 958 | A | 1 |
| 9014.0226 | CWMIDSETRPRFREL | 13119 | 15 | Human | Her2/neu | 958 | A | 1 |
| 9014.0227 | CWMIDSEVRPRFREL | 13120 | 15 | Human | Her2/neu | 958 | A | 1 |
| 68.0001 | MWDLVLSIALSVGCT | 13121 | 15 | Human | Kallikrein2 | 1 | | 3 |
| 68.0002 | DLVLSIALSVGCTGA | 13122 | 15 | Human | Kallikrein2 | 3 | | 2 |
| 68.0003 | HPQWVLTAAHCLKKN | 13123 | 15 | Human | Kallikrein2 | 56 | | 7 |
| 68.0004 | QWVLTAAHCLKKNSQ | 13124 | 15 | Human | Kallikrein2 | 58 | | 2 |
| 68.0005 | GQRVPVSHSFPHPLY | 13125 | 15 | Human | Kallikrein2 | 87 | | 3 |
| 68.0006 | RVPVSHSFPHPLYNM | 13126 | 15 | Human | Kallikrein2 | 89 | | 4 |
| 68.0007 | PHPLYNMSLLKHQSL | 13127 | 15 | Human | Kallikrein2 | 97 | | 3 |
| 68.0008 | HPLYNMSLLKHQSLR | 13128 | 15 | Human | Kallikrein2 | 98 | | 10 |
| 68.0009 | NMSLLKHQSLRPDED | 13129 | 15 | Human | Kallikrein2 | 102 | | 1 |
| 68.0010 | SHDLMLLRLSEPAKI | 13130 | 15 | Human | Kallikrein2 | 118 | | 7 |
| 68.0011 | HDLMLLRLSEPAKIT | 13131 | 15 | Human | Kallikrein2 | 119 | | 10 |
| 68.0015 | PEEFLRPRSLQCVSL | 13132 | 15 | Human | Kallikrein2 | 162 | | 1 |

TABLE 186-continued

Binding affinity of HLA-DR supertype and DR3 motif-positive peptides

| | | | | | | | |
|---|---|---|---|---|---|---|---|
| 68.0016 | PRSLQCVSLHLLSND | 13133 | 15 | Human | Kallikrein2 | 168 | 1 |
| 68.0140 | LHLLSNDMCARAYSE | 13134 | 15 | Human | Kallikrein2 | 176 | 2 |
| 68.0017 | NGVLQGITSWGPEPC | 13135 | 15 | Human | Kallikrein2 | 220 | 1 |
| 68.0018 | KPAVYTKVVHYRKWI | 13136 | 15 | Human | Kallikrein2 | 239 | 4 |
| 58.0114 | VGNWQYFFPVIFSKA | 13137 | 15 | Human | MAGE3 | 140 | 3 |
| F160.17 | LVEVTLGEVPAAESPD | 13138 | 16 | Human | MAGE3/6 | 45 | 1 |
| 68.0019 | AAPLLLARAASLSLG | 13139 | 15 | Human | PAP | 3 | 11 |
| 68.0020 | APLLLARAASLSLGF | 13140 | 15 | Human | PAP | 4 | 11 |
| 68.0021 | PLLLARAASLSLGFL | 13141 | 15 | Human | PAP | 5 | 9 |
| 68.0022 | SLSLGFLELLFFWLD | 13142 | 15 | Human | PAP | 13 | 1 |
| 68.0023 | LLFFWLDRSVLAKEL | 13143 | 15 | Human | PAP | 21 | 13 |
| 68.0024 | DRSVLAKELKFVTLV | 13144 | 15 | Human | PAP | 27 | 4 |
| 68.0025 | AKELKFVTLVFRHGD | 13145 | 15 | Human | PAP | 32 | 7 |
| 68.0026 | RSPIDTFPTDPIKES | 13146 | 15 | Human | PAP | 47 | 1 |
| 68.0028 | FGQLTQLGMEQHYEL | 13147 | 15 | Human | PAP | 67 | 2 |
| 68.0030 | DRTLMSAMTNLAALF | 13148 | 15 | Human | PAP | 110 | 8 |
| 68.0031 | MSAMTNLAALFPPEG | 13149 | 15 | Human | PAP | 114 | 2 |
| 68.0032 | MTNLAALFPPEGVSI | 13150 | 15 | Human | PAP | 117 | 1 |
| 68.0033 | PEGVSIWNPILLWQP | 13151 | 15 | Human | PAP | 126 | 4 |
| 68.0034 | GVSIWNPILLWQPIP | 13152 | 15 | Human | PAP | 128 | 5 |
| 68.0035 | WNPILLWQPIPVHTV | 13153 | 15 | Human | PAP | 132 | 6 |
| 68.0036 | NPILLWQPIPVHTVP | 13154 | 15 | Human | PAP | 133 | 9 |
| 68.0037 | PILLWQPIPVHTVPL | 13155 | 15 | Human | PAP | 134 | 7 |
| 68.0038 | ILLWQPIPVHTVPLS | 13156 | 15 | Human | PAP | 135 | 6 |
| 68.0039 | WQPIPVHTVPLSEDQ | 13157 | 15 | Human | PAP | 138 | 1 |
| 68.0147 | TVPLSEDQLLYLPFR | 13158 | 15 | Human | PAP | 145 | 2 |
| 68.0040 | LSGLHGQDLFGIWSK | 13159 | 15 | Human | PAP | 194 | 2 |
| 68.0041 | YDPLYCESVHNFTLP | 13160 | 15 | Human | PAP | 210 | 2 |
| 68.0042 | LPSWATEDTMTKLRE | 13161 | 15 | Human | PAP | 223 | 2 |
| 68.0043 | LRELSELSLLSLYGI | 13162 | 15 | Human | PAP | 235 | 4 |
| 68.0044 | LSELSLLSLYGIHKQ | 13163 | 15 | Human | PAP | 238 | 5 |
| 68.0045 | LSLLSLYGIHKQKEK | 13164 | 15 | Human | PAP | 241 | 6 |
| 68.0046 | KSRLQGGVLVNEILN | 13165 | 15 | Human | PAP | 255 | 3 |
| 68.0047 | GGVLVNEILNHMKRA | 13166 | 15 | Human | PAP | 260 | 7 |
| 68.0048 | IPSYKKLIMYSAHDT | 13167 | 15 | Human | PAP | 277 | 9 |
| 68.0049 | YKKLIMYSAHDTTVS | 13168 | 15 | Human | PAP | 280 | 10 |
| 68.0050 | LIMYSAHDTTVSGLQ | 13169 | 15 | Human | PAP | 283 | 4 |
| 68.0051 | DTTVSGLQMALDVYN | 13170 | 15 | Human | PAP | 290 | 3 |
| 68.0052 | ALDVYNGLLPPYASC | 13171 | 15 | Human | PAP | 299 | 4 |
| 68.0053 | LDVYNGLLPPYASCH | 13172 | 15 | Human | PAP | 300 | 4 |
| 68.0054 | YNGLLPPYASCHLTE | 13173 | 15 | Human | PAP | 303 | 2 |
| 68.0153 | LTELYFEKGEYFVEM | 13174 | 15 | Human | PAP | 315 | 3 |
| 68.0056 | FAELVGPVIPQDWST | 13175 | 15 | Human | PAP | 356 | 2 |
| 68.0156 | GPVIPQDWSTECMTT | 13176 | 15 | Human | PAP | 361 | 1 |
| K-09 | FLYGALLLAEGFYTTGAVRQ | 13177 | 20 | Human | PLP | 81 | 2 |
| F025.05 | QKGRGYRGQHQAHSLERVCH | 13178 | 20 | Human | PLP | 121 | 1 |
| K-18 | SAVPVYIYFNTWTTCQSIAF | 13179 | 20 | Human | PLP | 171 | 1 |
| F025.03 | WTTCQSIAFPSKTSASIGSL | 13180 | 20 | Human | PLP | 181 | 7 |
| F025.08 | AATYNFAVLKLMGRGTKF | 13181 | 18 | Human | PLP | 260 | 4 |
| 68.0058 | TLSVTWIGAAPLILS | 13182 | 15 | Human | PSA | 5 | 8 |
| 68.0059 | SVTWIGAAPLILSRI | 13183 | 15 | Human | PSA | 7 | 9 |

TABLE 186-continued

Binding affinity of HLA-DR supertype and DR3 motif-positive peptides

| | | | | | | | |
|---|---|---|---|---|---|---|---|
| 68.0060 | VTWIGAAPLILSRIV | 13184 | 15 | Human | PSA | 8 | 8 |
| 68.0061 | SQPWQVLVASRGRAV | 13185 | 15 | Human | PSA | 31 | 7 |
| 68.0062 | GRAVCGGVLVHPQWV | 13186 | 15 | Human | PSA | 42 | 2 |
| 68.0063 | GVLVHPQWVLTAAHC | 13187 | 15 | Human | PSA | 48 | 7 |
| 68.0064 | HPQWVLTAAHCIRNK | 13188 | 15 | Human | PSA | 52 | 5 |
| 68.0065 | QWVLTAAHCIRNKSV | 13189 | 15 | Human | PSA | 54 | 4 |
| 68.0066 | AHCIRNKSVILLGRH | 13190 | 15 | Human | PSA | 60 | 9 |
| 68.0067 | SVILLGRHSLFHPED | 13191 | 15 | Human | PSA | 67 | 6 |
| 68.0068 | VILLGRHSLFHPEDT | 13192 | 15 | Human | PSA | 68 | 6 |
| 68.0158 | HSLFHPEDTGQVFQV | 13193 | 15 | Human | PSA | 74 | 1 |
| 68.0069 | GQVFQVSHSFPHPLY | 13194 | 15 | Human | PSA | 83 | 10 |
| 68.0070 | VFQVSHSFPHPLYDM | 13195 | 15 | Human | PSA | 85 | 7 |
| 68.0071 | PHPLYDMSLLKNRFL | 13196 | 15 | Human | PSA | 93 | 2 |
| 68.0072 | SHDLMLLRLSEPAEL | 13197 | 15 | Human | PSA | 114 | 6 |
| 68.0073 | HDLMLLRLSEPAELT | 13198 | 15 | Human | PSA | 115 | 7 |
| 68.0074 | TDAVKVMDLPTQEPA | 13199 | 15 | Human | PSA | 129 | 1 |
| 68.0077 | LHVISNDVCAQVHPQ | 13200 | 15 | Human | PSA | 172 | 3 |
| 68.0078 | CAQVHPQKVTKFMLC | 13201 | 15 | Human | PSA | 180 | 2 |
| 68.0079 | GGPLVCNGVLQGITS | 13202 | 15 | Human | PSA | 210 | 3 |
| 68.0080 | GPLVCNGVLQGITSW | 13203 | 15 | Human | PSA | 211 | 4 |
| 68.0081 | NGVLQGITSWGSEPC | 13204 | 15 | Human | PSA | 216 | 6 |
| 68.0082 | RPSLYTKVVHYRKWI | 13205 | 15 | Human | PSA | 235 | 6 |
| 68.0083 | PRWLCAGALVLAGGF | 13206 | 15 | Human | PSM | 18 | 3 |
| 68.0084 | LGFLFGWFIKSSNEA | 13207 | 15 | Human | PSM | 35 | 5 |
| 68.0085 | LDELKAENIKKFLYN | 13208 | 15 | Human | PSM | 62 | 7 |
| 68.0086 | IKKFLYNFTQIPHLA | 13209 | 15 | Human | PSM | 70 | 12 |
| 68.0087 | KFLYNFTQIPHLAGT | 13210 | 15 | Human | PSM | 72 | 9 |
| 68.0088 | WKEFGLDSVELAHYD | 13211 | 15 | Human | PSM | 1011 | 3 |
| 68.0089 | LAHYDVLLSYPNKTH | 13212 | 15 | Human | PSM | 110 | 7 |
| 68.0165 | YISIINEDGNEIFNT | 13213 | 15 | Human | PSM | 127 | 5 |
| 68.0166 | ISIINEDGNEIFNTS | 13214 | 15 | Human | PSM | 128 | 4 |
| 68.0090 | GNEIFNTSLFEPPPP | 13215 | 15 | Human | PSM | 135 | 1 |
| 68.0167 | EDFFKLERDMKINCS | 13216 | 15 | Human | PSM | 183 | 2 |
| 68.0168 | FFKLERDMKINCSGK | 13217 | 15 | Human | PSM | 185 | 4 |
| 68.0096 | GKVFRGNKVKNAQLA | 13218 | 15 | Human | PSM | 206 | 3 |
| 68.0097 | GNKVKNAQLAGAKGV | 13219 | 15 | Human | PSM | 211 | 1 |
| 68.0170 | GVILYSDPADYFAPG | 13220 | 15 | Human | PSM | 224 | 5 |
| 68.0100 | EYAYRRGIAEAVGLP | 13221 | 15 | Human | PSM | 276 | 5 |
| 68.0101 | AEAVGLPSIPVHPIG | 13222 | 15 | Human | PSM | 284 | 3 |
| 68.0102 | AVGLPSIPVHPIGYY | 13223 | 15 | Human | PSM | 286 | 3 |
| 68.0103 | IGYYDAQKLLEKMGG | 13224 | 15 | Human | PSM | 297 | 1 |
| 68.0105 | TGNFSTQKVKMHIHS | 13225 | 15 | Human | PSM | 334 | 2 |
| 68.0107 | TRIYNVIGTLRGAVE | 13226 | 15 | Human | PSM | 353 | 7 |
| 68.0173 | GAAVVHEIVRSFGTL | 13227 | 15 | Human | PSM | 391 | 3 |

TABLE 186-continued

Binding affinity of HLA-DR supertype and DR3 motif-positive peptides

| | | | | | | | |
|---|---|---|---|---|---|---|---|
| 68.0176 | NSRLLQERGVAYINA | 13228 | 15 | Human | PSM | 438 | 5 |
| 68.0109 | ERGVAYINADSSIEG | 13229 | 15 | Human | PSM | 444 | 1 |
| 68.0110 | GVAYINADSSIEGNY | 13230 | 15 | Human | PSM | 446 | 3 |
| 68.0177 | VAYINADSSIEGNYT | 13231 | 15 | Human | PSM | 447 | 4 |
| 68.0111 | DSSIEGNYTLRVDCT | 13232 | 15 | Human | PSM | 453 | 2 |
| 68.0112 | NYTLRVDCTPLMYSL | 13233 | 15 | Human | PSM | 459 | 6 |
| 68.0113 | CTPLMYSLVHNLTKE | 13234 | 15 | Human | PSM | 466 | 10 |
| 68.0114 | DFEVFFQRLGIASGR | 13235 | 15 | Human | PSM | 520 | 5 |
| 68.0115 | EVFFQRLGIASGRAR | 13236 | 15 | Human | PSM | 522 | 6 |
| 68.0116 | TNKFSGYPLYHSVYE | 13237 | 15 | Human | PSM | 543 | 3 |
| 68.0117 | YDPMFKYHLTVAQVR | 13238 | 15 | Human | PSM | 566 | 9 |
| 68.0118 | DPMFKYHLTVAQVRG | 13239 | 15 | Human | PSM | 567 | 11 |
| 68.0119 | MFKYHLTVAQVRGGM | 13240 | 15 | Human | PSM | 569 | 8 |
| 68.0120 | KYHLTVAQVRGGMVF | 13241 | 15 | Human | PSM | 571 | 6 |
| 68.0121 | VAQVRGGMVFELANS | 13242 | 15 | Human | PSM | 576 | 5 |
| 68.0122 | RGGMVFELANSIVLP | 13243 | 15 | Human | PSM | 580 | 10 |
| 68.0123 | GMVFELANSIVLPFD | 13244 | 15 | Human | PSM | 582 | 9 |
| 68.0124 | VFELANSIVLPFDCR | 13245 | 15 | Human | PSM | 584 | 9 |
| 68.0125 | ADKIYSISMKHPQEM | 13246 | 15 | Human | PSM | 608 | 1 |
| 68.0126 | IYSISMKHPQEMKTY | 13247 | 15 | Human | PSM | 611 | 1 |
| 68.0127 | PQEMKTYSVSFDSLF | 13248 | 15 | Human | PSM | 619 | 2 |
| 68.0128 | TYSVSFDSLFSAVKN | 13249 | 15 | Human | PSM | 624 | 6 |
| 68.0130 | VLRMMNDQLMFLERA | 13250 | 15 | Human | PSM | 660 | 9 |
| 68.0131 | LRMMNDQLMFLERAF | 13251 | 15 | Human | PSM | 661 | 4 |
| 68.0181 | DQLMFLERAFIDPLG | 13252 | 15 | Human | PSM | 666 | 2 |
| 68.0133 | RHVIYAPSSHNKYAG | 13253 | 15 | Human | PSM | 688 | 3 |
| 68.0134 | RQIYVAAFTVQAAAE | 13254 | 15 | Human | PSM | 730 | 11 |
| 68.0135 | QIYVAAFTVQAAAET | 13255 | 15 | Human | PSM | 731 | 11 |
| 68.0136 | VAAFTVQAAAETLSE | 13256 | 15 | Human | PSM | 734 | 7 |

— indicates binding affinity >20,000 nM.

TABLE 187

| Binding affinity of A01 supertype peptides | | | | | | | | | | | | |
|---|---|---|---|---|---|---|---|---|---|---|---|---|
| Peptide | Sequence | SEQ ID NO | AA | Organism | Protein | Position | Analog | A*0101 | A*2601 | A*2902 | A*3002 | Degen-eracy |
| 1489.14 | CSMSYTWTGA | 13257 | 10 | HCV | II | 2453 | | — | | — | 309 | 1 |
| 9015.0153 | VTFDPIPIHY | 13258 | 10 | HIV | ENV | 264 | | 1029 | 134 | 619 | 380 | 2 |
| 9015.0001 | SFEPIPIHY | 13259 | 9 | HIV | ENV | 265 | | — | 953 | 9.4 | 191 | 2 |
| 9015.0002 | SFDPIPIHY | 13260 | 9 | HIV | ENV | 265 | | 315 | 2653 | 27 | 183 | 3 |
| 9015.0155 | MRDNWRSELY | 13261 | 10 | HIV | ENV | 559 | | — | — | 6795 | 73 | 1 |
| 9015.0156 | QTRVLAIERY | 13262 | 10 | HIV | ENV | 667 | | 6418 | 3306 | 4177 | 67 | 1 |
| 9015.0157 | EISNYTDTIY | 13263 | 10 | HIV | ENV | 730 | | 2342 | 32 | — | 7053 | 1 |
| 9015.0158 | EISNYTDIIY | 13264 | 10 | HIV | ENV | 730 | | 6025 | 59 | — | 2904 | 1 |
| 9015.0007 | ISNYTDTIY | 13265 | 9 | HIV | ENV | 731 | | 104 | 6095 | 141 | 36 | 3 |
| 9015.0160 | WFDITKWLWY | 13266 | 10 | HIV | ENV | 768 | | 1674 | 1430 | 143 | 3395 | 1 |
| 9015.0159 | WFSITNWLWY | 13267 | 10 | HIV | ENV | 768 | | 3969 | 1712 | 30 | 12,532 | 1 |
| 9015.0161 | WFDITNWLWY | 13268 | 10 | HIV | ENV | 768 | | 986 | 337 | 150 | 1663 | 2 |
| 9015.0008 | FSITNWLWY | 13269 | 9 | HIV | ENV | 769 | | 74 | 238 | 37 | 870 | 3 |
| 1605.01 | RFALNPGLL | 13270 | 9 | HIV | GAG | 44 | | — | — | — | 98 | 1 |
| 1522.02 | GSEELRSLY | 13271 | 9 | HIV | gag | 70 | | 44 | — | — | 144 | 2 |
| 9015.0010 | GTEELRSLY | 13272 | 9 | HIV | GAG | 72 | | 5.8 | 666 | 4831 | 51 | 2 |
| 9015.0011 | SSSKVSQNY | 13273 | 9 | HIV | GAG | 131 | | 73 | 1261 | 1760 | 32 | 2 |
| 1605.07 | RMYSPVSIL | 13274 | 9 | HIV | GAG | 290 | | — | — | — | 44 | 1 |
| 1595.03 | HIGPGRAFY | 13275 | 9 | HIV | gp160 | 310 | | 1310 | 58 | 157 | 11 | 3 |
| 1595.07 | IVNRVRQGY | 13276 | 9 | HIV | gp41 | | | 19,771 | 296 | 2033 | 6.3 | 2 |
| 1595.08 | KYCWNLLQY | 13277 | 9 | HIV | gp41 | | | — | — | 235 | 47 | 2 |
| 1595.04 | KIQNFRVYY | 13278 | 9 | HIV | IN | 219 | | 3427 | 17,544 | 766 | 1.9 | 1 |
| 9015.0174 | RQEILDLWVY | 13279 | 10 | HIV | NEF | 129 | | 7249 | 8718 | 13,174 | 76 | 1 |
| 9018.0001 | RTEILDLWVY | 13280 | 10 | HIV | NEF | 129 | A | 3.6 | 476 | 43 | 1.8 | 4 |
| 1605.15 | GYFPDWQNY | 13281 | 9 | HIV | NEF | 142 | | — | — | 659 | 48 | 1 |
| 9015.0027 | YTPGPGTRY | 13282 | 9 | HIV | NEF | 150 | | 136 | 11 | 1280 | 9147 | 2 |
| 9015.0026 | YTPGPGVRY | 13283 | 9 | HIV | NEF | 150 | | 162 | 27 | 1351 | 7637 | 2 |
| 9018.0002 | YTDGPGTRY | 13284 | 9 | HIV | NEF | 150 | A | 0.39 | 28 | 65 | 63 | 4 |
| 9018.0003 | YTDGPGVRY | 13285 | 9 | HIV | NEF | 150 | A | 2.1 | 152 | 39 | 45 | 4 |
| 73.0003 | RQDILDLWVY | 13286 | 10 | HIV | NEF | 182 | A | 8995 | | 13,928 | 95 | 1 |
| 1605.16 | LMWKFDSSL | 13287 | 9 | HIV | NEF | 205 | | — | — | 2052 | 348 | 1 |
| 1605.17 | MWKFDSRLAL | 13288 | 10 | HIV | NEF | 206 | | — | — | — | 429 | 1 |
| 9018.0007 | HMDREKHPEY | 13289 | 10 | HIV | NEF | 217 | A | 24 | 2765 | — | 648 | 1 |
| 9018.0035 | HYARELHPEY | 13290 | 10 | HIV | NEF | 217 | A | — | — | 928 | 104 | 1 |
| 9015.0176 | HMARELHPEY | 13291 | 10 | HIV | NEF | 217 | | 618 | 1567 | 325 | 33 | 2 |
| 9018.0006 | HTAREKHPEY | 13292 | 10 | HIV | NEF | 217 | A | 21 | 15 | 4463 | 139 | 3 |
| 9018.0005 | HMDRELHPEY | 13293 | 10 | HIV | NEF | 217 | A | 5.1 | 6.8 | 13 | 3.6 | 4 |
| 9018.0004 | HTARELHPEY | 13294 | 10 | HIV | NEF | 217 | A | 8.0 | 12 | 119 | 9.2 | 4 |
| 1595.06 | RSLYNTVATLY | 13295 | 11 | HIV | p17 | 76 | | 221 | 10,811 | 750 | 1.2 | 2 |
| 9015.0162 | ITKIGPENPY | 13296 | 10 | HIV | POL | 241 | | 1159 | 985 | — | 382 | 1 |
| 9015.0017 | ETPGIRYQY | 13297 | 9 | HIV | POL | 332 | | 9208 | 25 | — | 2298 | 1 |
| 9015.0164 | RTKNPEIVIY | 13298 | 10 | HIV | POL | 366 | | — | — | — | 12 | 1 |
| 9015.0169 | ETWETWWTDY | 13299 | 10 | HIV | POL | 592 | | 955 | 2.3 | 11,831 | 8648 | 1 |
| 9015.0168 | ETWETWWMDY | 13300 | 10 | HIV | POL | 592 | | 91 | 2.9 | 5117 | 601 | 2 |
| 9015.0019 | TWETWWTDY | 13301 | 9 | HIV | POL | 593 | | — | 3304 | 137 | 6307 | 1 |
| 9015.0170 | NTPPLVKLWY | 13302 | 10 | HIV | POL | 614 | | 18,427 | 199 | 2646 | 9347 | 1 |
| 9015.0024 | ETKKGKAGY | 13303 | 9 | HIV | POL | 645 | | — | 15 | — | 2095 | 1 |
| 9015.0023 | ETKLGKAGY | 13304 | 9 | HIV | POL | 645 | | — | 21 | — | 3900 | 1 |
| 1605.09 | QMAVFIHNF | 13305 | 9 | HIV | POL | 933 | | 8863 | 1558 | 1893 | 372 | 1 |
| 9015.0173 | ITKIQNFRVY | 13306 | 10 | HIV | POL | 973 | | 9468 | 427 | 1795 | 186 | 2 |
| 1522.03 | ISERILSTY | 13307 | 9 | HIV | rev | 55 | | 31 | 4095 | — | 247 | 2 |
| 1595.10 | KQNPDIVIY | 13308 | 9 | HIV | RT | | | — | — | — | 7.4 | 1 |
| 1595.09 | KLNWASQIY | 13309 | 9 | HIV | RT | | | 11,321 | — | 108 | 2.9 | 2 |
| 9015.0031 | QTKGLGISY | 13310 | 9 | HIV | TAT | 42 | | — | 185 | — | 715 | 1 |
| 9018.0008 | NTDKSLVKY | 13311 | 9 | HIV | VIF | 19 | A | 7.3 | 16,956 | 5426 | 3009 | 1 |
| 9015.0177 | WKSLVKHHMY | 13312 | 10 | HIV | VIF | 21 | | — | — | — | 148 | 1 |
| 9015.0034 | KSLVKHHMY | 13313 | 9 | HIV | VIF | 22 | | 10,545 | — | 2793 | 7.7 | 1 |
| 9015.0033 | NSLVKHHMY | 13314 | 9 | HIV | VIF | 22 | | 2027 | — | 326 | 451 | 2 |
| 9018.0010 | NSDVKHHMY | 13315 | 9 | HIV | VIF | 22 | A | 3.2 | 8988 | 193 | 70 | 3 |
| 9018.0037 | NYLVKHHMY | 13316 | 9 | HIV | VIF | 22 | A | 305 | 10,096 | 63 | 12 | 3 |
| 9018.0009 | NTLVKHHMY | 13317 | 9 | HIV | VIF | 22 | A | 363 | 7375 | 45 | 69 | 3 |
| 9015.0179 | VSRRANGWFY | 13318 | 10 | HIV | VIF | 31 | | 115 | — | 5578 | 5.2 | 2 |
| 9015.0178 | VSRRAKGWFY | 13319 | 10 | HIV | VIF | 31 | | 273 | — | 11,893 | 40 | 2 |
| 9018.0012 | VSDRANGWFY | 13320 | 10 | HIV | VIF | 31 | A | 4.3 | 191 | 932 | 18 | 3 |
| 9018.0011 | VTRRANGWFY | 13321 | 10 | HIV | VIF | 31 | A | 25 | 309 | 905 | 0.71 | 3 |
| 9018.0013 | VTRRAKGWFY | 13322 | 10 | HIV | VIF | 31 | A | 1.5 | 15 | 21 | 3.3 | 4 |
| 9018.0014 | VSRDAKGWFY | 13323 | 10 | HIV | VIF | 31 | A | 14 | 64 | 17 | 3.4 | 4 |
| 9015.0182 | VSIEWRQRRY | 13324 | 10 | HIV | VIF | 86 | | 7929 | 1989 | 13,948 | 65 | 1 |
| 9015.0183 | VSIEWRKRRY | 13325 | 10 | HIV | VIF | 86 | | — | 11,707 | — | 231 | 1 |
| 9018.0016 | VSDEWRLRRY | 13326 | 10 | HIV | VIF | 86 | A | 62 | 4322 | 2579 | 47 | 2 |
| 9015.0181 | VSIEWRLRRY | 13327 | 10 | HIV | VIF | 86 | | 4630 | 363 | 2491 | 55 | 2 |
| 9018.0015 | VTIEWRLRRY | 13328 | 10 | HIV | VIF | 86 | A | 19 | 33 | 123 | 3.5 | 4 |
| 9018.0020 | SIDWRLRRY | 13329 | 9 | HIV | VIF | 87 | A | 986 | 624 | 3307 | 27 | 1 |
| 9018.0036 | SYEWRLRRY | 13330 | 9 | HIV | VIF | 87 | A | 3698 | 3219 | 1211 | 58 | 1 |
| 9015.0035 | SIEWRLRRY | 13331 | 9 | HIV | VIF | 87 | | 5225 | 164 | 13,068 | 265 | 2 |

TABLE 187-continued

Binding affinity of A01 supertype peptides

| Peptide | Sequence | SEQ ID NO | AA | Organism | Protein | Position | Analog | A*0101 | A*2601 | A*2902 | A*3002 | Degen-eracy |
|---|---|---|---|---|---|---|---|---|---|---|---|---|
| 9018.0018 | SIDWRQRRY | 13332 | 9 | HIV | VIF | 87 | A | 43 | 236 | 561 | 3.5 | 3 |
| 9018.0017 | STEWRQRRY | 13333 | 9 | HIV | VIF | 87 | A | 7.1 | 371 | 331 | 19 | 4 |
| 9018.0019 | STEWRLRRY | 13334 | 9 | HIV | VIF | 87 | A | 52 | 320 | 271 | 6.6 | 4 |
| 9018.0039 | RYSTQVDPGY | 13335 | 10 | HIV | VIF | 94 | A | 12,187 | — | — | 40 | 1 |
| 9015.0184 | DLADQLIHLY | 13336 | 10 | HIV | VIF | 102 | | 958 | 6.2 | 9787 | 285 | 2 |
| 9018.0024 | GLDDQLIHLY | 13337 | 10 | HIV | VIF | 102 | A | 11 | 1419 | 432 | 56 | 3 |
| 9018.0025 | GYADQLIHLY | 13338 | 10 | HIV | VIF | 102 | A | 109 | 4401 | 42 | 1.2 | 3 |
| 9015.0185 | GLADQLIHLY | 13339 | 10 | HIV | VIF | 102 | | 5518 | 426 | 325 | 9.2 | 3 |
| 9018.0021 | DTADQLIHLY | 13340 | 10 | HIV | VIF | 102 | A | 3.6 | 3.2 | 30 | 13 | 4 |
| 9018.0022 | DLDDQLIHLY | 13341 | 10 | HIV | VIF | 102 | A | 4.9 | 38 | 3.7 | 2.7 | 4 |
| 9018.0023 | GTADQLIHLY | 13342 | 10 | HIV | VIF | 102 | A | 26 | 68 | 198 | 2.0 | 4 |
| 9015.0186 | LADQLIHMHY | 13343 | 10 | HIV | VIF | 103 | | 8.1 | 3929 | 3071 | 817 | 1 |
| 9015.0187 | LADQLIHMYY | 13344 | 10 | HIV | VIF | 103 | | 2.5 | 1785 | 217 | 769 | 2 |
| 9015.0038 | LADQLIHLY | 13345 | 9 | HIV | VIF | 103 | | 4.0 | 6086 | 1333 | 96 | 2 |
| 9018.0032 | LTDQLIHMHY | 13346 | 10 | HIV | VIF | 103 | A | 6.6 | 10,628 | 2949 | 350 | 2 |
| 9018.0034 | LYDQLIHMHY | 13347 | 10 | HIV | VIF | 103 | A | 1128 | 1179 | 123 | 55 | 2 |
| 9018.0033 | LFDQLIHMHY | 13348 | 10 | HIV | VIF | 103 | A | 4069 | 5266 | 280 | 47 | 2 |
| 9018.0029 | LTDQLIHMYY | 13349 | 10 | HIV | VIF | 103 | A | 6.3 | 3210 | 291 | 197 | 3 |
| 9018.0030 | LFDQLIHMYY | 13350 | 10 | HIV | VIF | 103 | A | 69 | 2414 | 12 | 65 | 3 |
| 9018.0031 | LYDQLIHMYY | 13351 | 10 | HIV | VIF | 103 | A | 191 | 4367 | 131 | 38 | 3 |
| 9018.0026 | LTDQLIHLY | 13352 | 9 | HIV | VIF | 103 | A | 0.53 | 432 | 178 | 2.6 | 4 |
| 9018.0027 | LFDQLIHLY | 13353 | 9 | HIV | VIF | 103 | A | 83 | 154 | 45 | 10 | 4 |
| 9018.0028 | LYDQLIHLY | 13354 | 9 | HIV | VIF | 103 | A | 177 | 69 | 249 | 21 | 4 |
| 9015.0089 | VWTIVYIEY | 13355 | 9 | HIV | VPU | 36 | | 6976 | — | 215 | 198 | 2 |
| 9018.0040 | VWDIVYIEY | 13356 | 9 | HIV | VPU | 36 | A | 91 | 336 | 540 | 472 | 3 |
| 9018.0041 | VTTIVYIEY | 13357 | 9 | HIV | VPU | 36 | A | 3.6 | 448 | 333 | 92 | 4 |
| 1580.01 | GTGCNGWFY | 13358 | 9 | HPV | E1 | 12 | | 69 | 1016 | 11 | 4.5 | 3 |
| 1593.01 | GTDCNGWFY | 13359 | 9 | HPV | E1 | 12 | A | 40 | 318 | 73 | 330 | 4 |
| 1580.15 | LSDLQDSGY | 13360 | 9 | HPV | E1 | 114 | | 1.7 | — | — | 4025 | 1 |
| 1593.06 | QTDYYGLYY | 13361 | 9 | HPV | E1 | 151 | A | 1.3 | 122 | 38 | 674 | 3 |
| 86.0139 | SSNLQGKLY | 13362 | 9 | HPV | E1 | 187 | | 3032 | 3972 | 15,949 | 62 | 1 |
| 1580.16 | NSNTKATLLY | 13363 | 10 | HPV | E1 | 193 | | 142 | 13,955 | 299 | 470 | 3 |
| 1580.08 | SSNTKANILY | 13364 | 10 | HPV | E1 | 193 | | 290 | 579 | 408 | 33 | 3 |
| 1580.09 | CTDWCITGY | 13365 | 9 | HPV | E1 | 226 | | 60 | 4818 | 4936 | 485 | 2 |
| 1593.02 | STDAALYWY | 13366 | 9 | HPV | E1 | 314 | A | 2.6 | 24 | 26 | 68 | 4 |
| 1580.02 | STAAALYWY | 13367 | 9 | HPV | E1 | 314 | | 67 | 34 | 25 | 14 | 4 |
| 1593.08 | SSDAALYWY | 13368 | 9 | HPV | E1 | 321 | A | 34 | — | 1974 | 799 | 1 |
| 1580.06 | SSVAALYWY | 13369 | 9 | HPV | E1 | 321 | | 3960 | 305 | 169 | 27 | 3 |
| 1593.07 | KSDIVTLTY | 13370 | 9 | HPV | E1 | 329 | A | 62 | — | 3165 | 313 | 2 |
| 1593.13 | VTDDSEIAY | 13371 | 9 | HPV | E1 | 349 | A | 22 | — | 2865 | 10,110 | 1 |
| 1580.07 | VMDDSEIAY | 13372 | 9 | HPV | E1 | 349 | | 18 | — | 95 | 2551 | 2 |
| 1580.10 | LSEMVQWAY | 13373 | 9 | HPV | E1 | 350 | | 6.9 | — | 633 | 101 | 2 |
| 1580.17 | LSEMIQWAY | 13374 | 9 | HPV | E1 | 350 | | 1.5 | — | 187 | 77 | 3 |
| 1580.13 | FGEMVQWAY | 13375 | 9 | HPV | E1 | 353 | | 318 | — | 81 | 249 | 3 |
| 1593.03 | LSDMVQWAY | 13376 | 9 | HPV | E1 | 357 | A | 21 | 8058 | 504 | 161 | 2 |
| 1580.03 | LSQMVQWAY | 13377 | 9 | HPV | E1 | 357 | | 25 | 18,019 | 124 | 1.8 | 3 |
| 1580.11 | LTDDSDIAY | 13378 | 9 | HPV | E1 | 362 | | 7.9 | 3922 | 4772 | 5441 | 1 |
| 1580.12 | LTDDSDIAYY | 13379 | 10 | HPV | E1 | 362 | | 6.4 | 738 | 3977 | 293 | 2 |
| 1580.14 | ITDDSDIAY | 13380 | 9 | HPV | E1 | 365 | | 4.2 | 7475 | 2100 | 3148 | 1 |
| 1593.04 | ITDDSEIAY | 13381 | 9 | HPV | E1 | 369 | A | 20 | 7373 | 1441 | 3102 | 1 |
| 1580.04 | IVDDSEIAY | 13382 | 9 | HPV | E1 | 369 | | 103 | — | 444 | 2035 | 2 |
| 1593.05 | MSDSQWIKY | 13383 | 9 | HPV | E1 | 420 | A | 10 | 10,066 | 839 | 434 | 2 |
| 1580.05 | MSMSQWIKY | 13384 | 9 | HPV | E1 | 420 | | 229 | 158 | 7.7 | 1.8 | 4 |
| 86.0135 | ISWTYIDDY | 13385 | 9 | HPV | E1 | 520 | | 1209 | — | 2488 | 9.4 | 1 |
| 1580.23 | CQDKILEHY | 13386 | 9 | HPV | E2 | 11 | | 55 | — | — | 2603 | 1 |
| 1593.14 | CTDKILEHY | 13387 | 9 | HPV | E2 | 11 | A | 110 | — | — | 15,405 | 1 |
| 1580.32 | VQDKILDIY | 13388 | 9 | HPV | E2 | 11 | | 136 | — | — | 3810 | 1 |
| 86.0141 | CQDKILTHY | 13389 | 9 | HPV | E2 | 11 | | 914 | 8904 | 12,482 | 188 | 1 |
| 86.0149 | VQEKILDLY | 13390 | 9 | HPV | E2 | 11 | | 1437 | 8175 | 17,034 | 193 | 1 |
| 1580.21 | LQDKIIDHY | 13391 | 9 | HPV | E2 | 15 | | 68 | — | — | 2770 | 1 |
| 1593.09 | LTDKIIDHY | 13392 | 9 | HPV | E2 | 15 | A | 195 | — | — | 6795 | 1 |
| 1593.16 | LTDKILDHY | 13393 | 9 | HPV | E2 | 17 | A | 3.1 | 804 | 4417 | 1262 | 1 |
| 1580.27 | LQDKILDHY | 13394 | 9 | HPV | E2 | 17 | | 66 | 7414 | — | 926 | 1 |
| 1580.18 | STDLRDHIDY | 13395 | 10 | HPV | E2 | 23 | | 25 | 9577 | — | 313 | 2 |
| 1580.24 | MLETLNNTEY | 13396 | 10 | HPV | E2 | 78 | | 36 | 11,070 | 385 | 1118 | 2 |
| 1593.15 | MTETLNNTEY | 13397 | 10 | HPV | E2 | 78 | A | 77 | 1622 | 471 | 1383 | 2 |
| 88.0433 | YVAWKYIYY | 13398 | 9 | HPV | E2 | 131 | | 310 | | | | 1 |
| 1580.29 | IVEGQVDYY | 13399 | 9 | HPV | E2 | 147 | | 188 | — | — | 1606 | 1 |
| 1580.19 | QVDYYGLYY | 13400 | 9 | HPV | E2 | 151 | | 3.4 | 777 | 69 | 1148 | 2 |
| 1580.33 | EVDYVGLYY | 13401 | 9 | HPV | E2 | 151 | | 3.6 | 161 | 4.5 | — | 3 |
| 1580.25 | KVDYIGMYY | 13402 | 9 | HPV | E2 | 151 | | 27 | 2229 | 44 | 13 | 3 |
| 1593.10 | ATDVSHRGLY | 13403 | 10 | HPV | E2 | 154 | A | 26 | 18 | 1617 | 15 | 3 |
| 1580.22 | ATCVSHRGLY | 13404 | 10 | HPV | E2 | 154 | | 421 | 492 | 4212 | 28 | 3 |
| 88.0401 | CVSHRGLYY | 13405 | 9 | HPV | E2 | 156 | | 108 | | | | 1 |
| 86.0160 | GNEKTYFKY | 13406 | 9 | HPV | E2 | 162 | | 2297 | 12,072 | 319 | 739 | 1 |

TABLE 187-continued

Binding affinity of A01 supertype peptides

| Peptide | Sequence | SEQ ID NO | AA | Organism | Protein | Position | Analog | A*0101 | A*2601 | A*2902 | A*3002 | Degeneracy |
|---|---|---|---|---|---|---|---|---|---|---|---|---|
| 86.0156 | DSVSSTCRY | 13407 | 9 | HPV | E2 | 197 | | 3056 | 12 | — | 994 | 1 |
| 1580.30 | VTDSRNTKY | 13408 | 9 | HPV | E2 | 243 | | 25 | — | — | 1650 | 1 |
| 1580.26 | ESNSLKCLRY | 13409 | 10 | HPV | E2 | 282 | | 359 | 174 | 7507 | 604 | 2 |
| 1580.31 | WTSTDNKNY | 13410 | 9 | HPV | E2 | 327 | | 163 | 4831 | — | 7308 | 1 |
| 1593.11 | KTDILTVTY | 13411 | 9 | HPV | E2 | 329 | A | 116 | — | — | 922 | 1 |
| 86.0146 | KTGILTVTY | 13412 | 9 | HPV | E2 | 329 | | 855 | — | 3395 | 20 | 1 |
| 1580.20 | KSAIVTLTY | 13413 | 9 | HPV | E2 | 329 | | 9.2 | — | 96 | 5.7 | 3 |
| 1593.17 | NTDILTVTY | 13414 | 9 | HPV | E2 | 332 | A | 22 | 1534 | 1527 | 1996 | 1 |
| 86.0152 | NTGILTVTY | 13415 | 9 | HPV | E2 | 332 | | 337 | 3147 | 1403 | 8722 | 1 |
| 1593.12 | DSDQILVGY | 13416 | 9 | HPV | E2 | 354 | A | 183 | — | — | — | 1 |
| 86.0147 | DSVQILVGY | 13417 | 9 | HPV | E2 | 354 | | 1931 | 2.8 | 13,561 | 138 | 2 |
| 78.0005 | RFEDPTRRPY | 13418 | 10 | HPV | E6 | 3 | | 19,245 | | 17,839 | 145 | 1 |
| 1549.41 | LSDALEIPY | 13419 | 9 | HPV | E6 | 15 | A | 12 | 629 | 1598 | 8688 | 1 |
| 1549.01 | LSSALEIPY | 13420 | 9 | HPV | E6 | 15 | | 25 | 4107 | 261 | 83 | 3 |
| 1549.40 | LTSALEIPY | 13421 | 9 | HPV | E6 | 15 | A | 57 | 358 | 183 | 161 | 4 |
| 86.0061 | LTDVSIACVY | 13422 | 10 | HPV | E6 | 25 | A | 2.9 | | 764 | 72 | 2 |
| 86.0054 | LTDIEITCVY | 13423 | 10 | HPV | E6 | 25 | A | 12 | | 540 | 80 | 2 |
| 86.0052 | ITDIILECVY | 13424 | 10 | HPV | E6 | 30 | A | 1.8 | | 7660 | 505 | 1 |
| 86.0168 | KTDQRSEVY | 13425 | 9 | HPV | E6 | 35 | A | 84 | | — | 1174 | 1 |
| 78.0252 | ATLERTEVY | 13426 | 9 | HPV | E6 | 37 | | 656 | | 557 | 26 | 1 |
| 78.0378 | LFTDLRIVY | 13427 | 9 | HPV | E6 | 46 | | 1262 | | 12 | 89 | 2 |
| 1549.09 | VFADLRIVY | 13428 | 9 | HPV | E6 | 46 | | — | 1799 | 2.9 | 21 | 2 |
| 78.0348 | AFTDLTIVY | 13429 | 9 | HPV | E6 | 46 | | 31 | | 36 | 71 | 3 |
| 1549.50 | VTADLRIVY | 13430 | 9 | HPV | E6 | 46 | A | 1516 | 121 | 228 | 50 | 3 |
| 1549.51 | ATTDLTIVY | 13431 | 9 | HPV | E6 | 46 | A | 391 | 163 | 194 | 109 | 4 |
| 86.0371 | FTDLTIVY | 13432 | 8 | HPV | E6 | 47 | | 16 | | 1275 | — | 1 |
| 78.0366 | AFKDLFVVY | 13433 | 9 | HPV | E6 | 48 | | — | | 174 | 37 | 2 |
| 78.0379 | RFLSKISEY | 13434 | 9 | HPV | E6 | 68 | | — | | 1460 | 19 | 1 |
| 86.0060 | YSDVSEFRWY | 13435 | 10 | HPV | E6 | 70 | A | 3.9 | | 1842 | 1026 | 1 |
| 1549.45 | LSDISEYRHY | 13436 | 10 | HPV | E6 | 70 | A | 27 | 2538 | 14,468 | 552 | 1 |
| 78.0009 | YSKVSEFRWY | 13437 | 10 | HPV | E6 | 70 | | 539 | | 4514 | 185 | 1 |
| 78.0027 | LSKISEYRHY | 13438 | 10 | HPV | E6 | 70 | | 17,195 | | — | 159 | 1 |
| 86.0059 | YTKVSEFRWY | 13439 | 10 | HPV | E6 | 70 | A | 276 | | 3308 | 420 | 2 |
| 78.0384 | LFYSKVRKY | 13440 | 9 | HPV | E6 | 71 | | — | | 201 | 35 | 2 |
| 86.0062 | FTSRIRELRY | 13441 | 10 | HPV | E6 | 71 | A | 4.4 | | 77 | 50 | 3 |
| 86.0055 | YSDIRELRHY | 13442 | 10 | HPV | E6 | 72 | A | 9.9 | | 1137 | 740 | 1 |
| 78.0253 | YSRIRELRY | 13443 | 9 | HPV | E6 | 72 | | 308 | | 6276 | 566 | 1 |
| 86.0063 | YSDIRELRYY | 13444 | 10 | HPV | E6 | 72 | A | 9.4 | | 733 | 456 | 2 |
| 86.0065 | FTSKVRKYRY | 13445 | 10 | HPV | E6 | 72 | A | 64 | | 6677 | 52 | 2 |
| 78.0176 | FYSKVRKYRY | 13446 | 10 | HPV | E6 | 72 | | — | | 146 | 326 | 2 |
| 1549.02 | VSEFRWYRY | 13447 | 9 | HPV | E6 | 73 | | 33 | — | 1521 | 135 | 2 |
| 78.0254 | ISEYRHYQY | 13448 | 9 | HPV | E6 | 73 | | 46 | | 853 | 81 | 2 |
| 78.0249 | ISEYRHYNY | 13449 | 9 | HPV | E6 | 73 | | 74 | | 4203 | 109 | 2 |
| 86.0166 | ISDYRHYQY | 13450 | 9 | HPV | E6 | 73 | A | 13 | | 37 | 382 | 3 |
| 86.0162 | ISDYRHYNY | 13451 | 9 | HPV | E6 | 73 | A | 16 | | 45 | 455 | 3 |
| 1549.49 | YSDVRKYRY | 13452 | 9 | HPV | E6 | 73 | A | 18 | — | 209 | 275 | 3 |
| 1549.43 | VSDFRWYRY | 13453 | 9 | HPV | E6 | 73 | A | 24 | 3072 | 241 | 99 | 3 |
| 1549.42 | VTEFRWYRY | 13454 | 9 | HPV | E6 | 73 | A | 26 | 3150 | 256 | 92 | 3 |
| 78.0183 | EYRHYQYSLY | 13455 | 10 | HPV | E6 | 75 | | 2267 | | 2372 | 130 | 1 |
| 78.0185 | EYRHYNYSLY | 13456 | 10 | HPV | E6 | 75 | | 2405 | | 1774 | 67 | 1 |
| 78.0180 | EYRHYNYSVY | 13457 | 10 | HPV | E6 | 75 | | — | | 16,016 | 253 | 1 |
| 78.0363 | KFYSKISEY | 13458 | 9 | HPV | E6 | 75 | | — | | 1595 | 9.5 | 1 |
| 1571.26 | ISDYRHYCY | 13459 | 9 | HPV | E6 | 80 | A | 9.4 | — | 9.9 | 192 | 3 |
| 1571.27 | ISEYRHYCY | 13460 | 9 | HPV | E6 | 80 | | 38 | — | 264 | 62 | 3 |
| 78.0177 | EYRHYCYSLY | 13461 | 10 | HPV | E6 | 82 | | 2564 | | 2449 | 120 | 1 |
| 86.0001 | TLEKLTNTGLY | 13462 | 11 | HPV | E6 | 89 | | 77 | | 5500 | 154 | 2 |
| 1589.45 | TIEKLTNTGLY | 13463 | 11 | HPV | E6 | 89 | A | 78 | 12 | 15,150 | 220 | 3 |
| 86.0167 | LTDLLIRCY | 13464 | 9 | HPV | E6 | 99 | A | 13 | | 6857 | 5515 | 1 |
| 78.0369 | RFHNIGGRW | 13465 | 9 | HPV | E6 | 124 | | — | | 12,156 | 13 | 1 |
| 78.0381 | RFHNIMGRW | 13466 | 9 | HPV | E6 | 124 | | — | | — | 27 | 1 |
| 78.0372 | RFHNISGRW | 13467 | 9 | HPV | E6 | 124 | | — | | — | 22 | 1 |
| 78.0376 | RFHSIAGQY | 13468 | 9 | HPV | E6 | 126 | | — | | 202 | 1.0 | 2 |
| 78.0365 | RFHNIRGRW | 13469 | 9 | HPV | E6 | 131 | | — | | — | 23 | 1 |
| 86.0068 | RTETPTLQDY | 13470 | 10 | HPV | E7 | 2 | A | 11 | | 1987 | 239 | 2 |
| 86.0067 | HTDTPTLHEY | 13471 | 10 | HPV | E7 | 2 | A | 20 | | 1509 | 54 | 2 |
| 86.0004 | PTLKEYVLDLY | 13472 | 11 | HPV | E7 | 6 | | 195 | | 805 | 408 | 2 |
| 78.0250 | LKEYVLDLY | 13473 | 9 | HPV | E7 | 8 | | — | | 3313 | 76 | 1 |
| 86.0169 | LTEYVLDLY | 13474 | 9 | HPV | E7 | 8 | A | 6.0 | | 941 | 81 | 2 |
| 78.0354 | LYPEPTDLY | 13475 | 9 | HPV | E7 | 15 | | — | | 268 | 1473 | 1 |
| 86.0069 | ETDPVDLLCY | 13476 | 10 | HPV | E7 | 20 | A | 6.4 | | 4110 | — | 1 |
| 78.0017 | ELDPVDLLCY | 13477 | 10 | HPV | E7 | 20 | | 26 | | 4291 | 12,746 | 1 |
| 1549.44 | QTEPDTSNY | 13478 | 9 | HPV | E7 | 44 | A | 19 | 4977 | — | 2322 | 1 |
| 1549.03 | QAEPDTSNY | 13479 | 9 | HPV | E7 | 44 | | 319 | — | — | 9935 | 1 |
| 78.0244 | QAEPDRAHY | 13480 | 9 | HPV | E7 | 44 | | 3270 | | — | 16 | 1 |
| 86.0070 | QTEQATSNYY | 13481 | 10 | HPV | E7 | 46 | A | 11 | | 9576 | 500 | 1 |

TABLE 187-continued

Binding affinity of A01 supertype peptides

| Peptide | Sequence | SEQ ID NO | AA | Organism | Protein | Position | Analog | A*0101 | A*2601 | A*2902 | A*3002 | Degen-eracy |
|---|---|---|---|---|---|---|---|---|---|---|---|---|
| 78.0022 | QAEQATSNYY | 13482 | 10 | HPV | E7 | 46 | | 101 | | — | 1436 | 1 |
| 78.0023 | ATSNYYIVTY | 13483 | 10 | HPV | E7 | 50 | | 2209 | | 2117 | 118 | 1 |
| 86.0071 | ATDNYYIVTY | 13484 | 10 | HPV | E7 | 50 | A | 7.4 | | 1918 | 65 | 2 |
| 1549.48 | TSDYYIVTY | 13485 | 9 | HPV | E7 | 51 | A | 11 | 4112 | 11,927 | 2204 | 1 |
| 9012.0158 | RTDGNRQIIGY | 13486 | 11 | Human | CEA | 72 | A | 140 | — | — | 95 | 2 |
| 9012.0160 | GTDQATPGPAY | 13487 | 11 | Human | CEA | 85 | A | 174 | 3848 | 13,260 | 234 | 2 |
| 1610.06 | QQATPGPAY | 13488 | 9 | Human | CEA | 87 | | 3427 | 1322 | 310 | 13 | 2 |
| 9012.0096 | YSDREIIY | 13489 | 8 | Human | CEA | 95 | A | 93 | 16,129 | — | 28 | 2 |
| 1470.01 | RSDSVILNVLY | 13490 | 11 | Human | CEA | 225 | | 79 | | — | 5958 | 1 |
| 9012.0162 | RTDSVILNVLY | 13491 | 11 | Human | CEA | 225 | A | 14 | 365 | 954 | 8.5 | 3 |
| 9012.0116 | TTSPLNTSY | 13492 | 9 | Human | CEA | 241 | A | 176 | 2.6 | 113 | 12 | 4 |
| 57.0007 | AADNPPAQY | 13493 | 9 | Human | CEA | 261 | A | 9.2 | | | | 1 |
| 1610.04 | AASNPPAQY | 13494 | 9 | Human | CEA | 261 | | — | 18,083 | — | 210 | 1 |
| 1553.02 | ITVNNSGSY | 13495 | 9 | Human | CEA | 289 | | 2361 | 24 | 1847 | 20 | 2 |
| 9012.0164 | LSDTRNDVGPY | 13496 | 11 | Human | CEA | 381 | A | 14 | 586 | 9860 | 152 | 2 |
| 1610.05 | VTRNDVGPY | 13497 | 9 | Human | CEA | 383 | | 414 | 4881 | — | 20 | 2 |
| 1553.03 | PTISPSYTYY | 13498 | 10 | Human | CEA | 418 | | 415 | 19,936 | 5377 | 1579 | 1 |
| 9012.0100 | TTSPSYTY | 13499 | 8 | Human | CEA | 419 | A | 2317 | 3436 | 213 | 323 | 2 |
| 9012.0102 | ISDSYTYY | 13500 | 8 | Human | CEA | 420 | A | 222 | 8550 | 1989 | 9106 | 1 |
| 9012.0142 | HTASNPPAQY | 13501 | 10 | Human | CEA | 438 | A | 106 | 0.54 | 21 | 1.8 | 4 |
| 1553.04 | ITEKNSGLY | 13502 | 9 | Human | CEA | 467 | | 58 | 513 | — | 68 | 2 |
| 9012.0166 | TTEPEAQNTTY | 13503 | 11 | Human | CEA | 522 | A | 2.1 | 530 | 1328 | 145 | 2 |
| 1470.06 | RSDPVTLDVLY | 13504 | 11 | Human | CEA | 581 | | 17 | | — | 2307 | 1 |
| 9012.0168 | RTDPVTLDVLY | 13505 | 11 | Human | CEA | 581 | A | 6.7 | 2520 | 1309 | 10 | 2 |
| 9012.0118 | ITSPPDSSY | 13506 | 9 | Human | CEA | 597 | A | 1717 | 462 | 16,458 | 8.8 | 2 |
| 9012.0170 | CTSASNPSPQY | 13507 | 11 | Human | CEA | 615 | A | 535 | 549 | — | 484 | 1 |
| 9012.0120 | ITDNNNGTY | 13508 | 9 | Human | CEA | 645 | A | 32 | 460 | 15,604 | 21 | 3 |
| 9012.0172 | ETDLDMLRHLY | 13509 | 11 | Human | Her2/neu | 40 | A | 9.6 | 4,4 | 1501 | 10 | 3 |
| 9012.0147 | VTQGNLELTY | 13510 | 10 | Human | Her2/neu | 55 | A | 90 | 6718 | 1672 | 23 | 2 |
| 9012.0149 | RTTQLFEDNY | 13511 | 10 | Human | Her2/neu | 103 | A | 2393 | — | 11,225 | 7.4 | 1 |
| 9012.0151 | LTQRNPQLCY | 13512 | 10 | Human | Her2/neu | 154 | A | 6.9 | 21 | 139 | 7.1 | 4 |
| 9012.0174 | FTSMPNPEGRY | 13513 | 11 | Human | Her2/neu | 279 | A | 10 | 2.8 | 170 | 104 | 4 |
| 9012.0122 | SMDNPEGRY | 13514 | 9 | Human | Her2/neu | 281 | A | 141 | 535 | 1443 | 11 | 2 |
| 9012.0176 | ASDVTACPYNY | 13515 | 11 | Human | Her2/neu | 293 | A | 18 | 5833 | 2444 | 205 | 2 |
| 9012.0124 | CTTACPYNY | 13516 | 9 | Human | Her2/neu | 295 | A | 1867 | 5558 | 275 | 188 | 2 |
| 9012.0106 | VTDCPYNY | 13517 | 8 | Human | Her2/neu | 296 | A | 79 | — | 1451 | 1628 | 1 |
| 9012.0178 | VTETLEEITGY | 13518 | 11 | Human | Her2/neu | 399 | A | 20 | 3514 | — | 11,269 | 1 |
| 9012.0180 | ETDEEITGYLY | 13519 | 11 | Human | Her2/neu | 401 | A | 6.4 | 27 | 277 | 1132 | 3 |
| 9012.0126 | LTEITGYLY | 13520 | 9 | Human | Her2/neu | 403 | A | 16 | 4226 | 25 | 151 | 3 |
| 9012.0128 | VTQGLPREY | 13521 | 9 | Human | Her2/neu | 546 | A | 848 | 3891 | 1014 | 1.7 | 1 |
| 9012.0182 | ETDQCVACAHY | 13522 | 11 | Human | Her2/neu | 580 | A | 9.9 | 36 | 496 | 398 | 4 |
| 9012.0153 | YTMAGVGSPY | 13523 | 10 | Human | Her2/neu | 772 | A | 9.8 | 0.32 | 2.2 | 3.5 | 4 |
| 9012.0152 | YVMAGVGSPY | 13524 | 10 | Human | Her2/neu | 772 | | 122 | 1.7 | 3.4 | 12 | 4 |
| 1215.02 | VMAGVGSPY | 13525 | 9 | Human | Her2/neu | 773 | | 1047 | 802 | 91 | 7.6 | 2 |
| 1215.07 | CMQIAKGMSY | 13526 | 10 | Human | Her2/neu | 826 | | 485 | 8333 | 2136 | 5.1 | 2 |
| 9012.0184 | DMDDLVDAEEY | 13527 | 11 | Human | Her2/neu | 1013 | A | 428 | 5662 | — | 18,038 | 1 |
| 9012.0186 | PTDDPSPLQRY | 13528 | 11 | Human | Her2/neu | 1102 | A | 32 | — | 937 | 440 | 2 |
| 1095.30 | LTCSPQPEY | 13529 | 9 | Human | Her2/neu | 1131 | | 981 | 5234 | 701 | 73 | 1 |
| 9012.0188 | ATSPAFDNLYY | 13530 | 11 | Human | Her2/neu | 1212 | A | 4.9 | 41 | 9.4 | 0.90 | 4 |
| 1610.02 | ASDLPTTMNY | 13531 | 10 | Human | MAGE | 68 | A | 32 | — | 5087 | 791 | 1 |
| 1610.03 | LTDHFVQENY | 13532 | 10 | Human | MAGE | 246 | A | 5.8 | 3760 | 12,377 | 1828 | 1 |
| 1610.01 | MTDLVQENY | 13533 | 9 | Human | MAGE | 247 | A | 7.1 | 659 | 460 | 2360 | 2 |
| 83.0099 | TQDLVQEKY | 13534 | 9 | Human | MAGE1 | 240 | | 91 | | — | 2099 | 1 |
| 9012.0190 | GTSSFSTTINY | 13535 | 11 | Human | MAGE2 | 67 | A | 4176 | 1495 | 196 | 86 | 2 |
| 9012.0130 | SSDSTTINY | 13536 | 9 | Human | MAGE2 | 69 | A | 8.5 | 3926 | 423 | 898 | 2 |
| 9012.0108 | ITSKASEY | 13537 | 8 | Human | MAGE2 | 150 | A | 3292 | 3161 | 15,233 | 165 | 1 |
| 9012.0192 | VTEVVPISHLY | 13538 | 11 | Human | MAGE2 | 166 | A | 31 | 579 | 1956 | 8.7 | 2 |
| 9012.0132 | ETVPISHLY | 13539 | 9 | Human | MAGE2 | 166 | A | 234 | 0.35 | 869 | 2.2 | 3 |
| 83.0098 | VTGPGPGY | 13540 | 8 | Human | MAGE2 | 179 | A | 1841 | | 1885 | 305 | 1 |
| 9012.0133 | LTQENYLEY | 13541 | 9 | Human | MAGE2 | 250 | A | 16 | 30 | 22 | 23 | 4 |
| 9012.0134 | LTHFLLLKY | 13542 | 9 | Human | MAGE2/3 | 116 | A | 32 | 369 | 1.3 | 3.2 | 4 |
| 9012.0135 | GTDPACYEF | 13543 | 9 | Human | MAGE2/3 | 263 | A | 467 | 186 | 1958 | 9837 | 2 |
| 9012.0194 | GTSSLPTTMNY | 13544 | 11 | Human | MAGE3 | 67 | A | 1648 | 2486 | 260 | 7.6 | 2 |
| 9012.0196 | TMDYPLWSQSY | 13545 | 11 | Human | MAGE3 | 74 | A | 149 | 419 | 721 | 99 | 3 |
| 9012.0154 | MTVDPIGHLY | 13546 | 10 | Human | MAGE3 | 167 | A | 188 | 0.42 | 19 | 1.1 | 4 |
| 1461.06 | MEVDPIGHLY | 13547 | 10 | Human | MAGE3 | 167 | | 371 | 15 | 307 | 35 | 4 |
| 9012.0136 | FTTCLGLSY | 13548 | 9 | Human | MAGE3 | 171 | A | 15 | 1.3 | 2.2 | 1303 | 3 |
| 9012.0112 | ATDLGLSY | 13549 | 8 | Human | MAGE3 | 172 | A | 9.6 | 2814 | 2196 | 6857 | 1 |
| 9012.0137 | FTQENYLEY | 13550 | 9 | Human | MAGE3 | 250 | A | 13 | 8.0 | 23 | 99 | 4 |
| 9012.0139 | SSDPSQKTY | 13551 | 9 | Human | p53 | 95 | A | 37 | — | 9710 | 101 | 2 |
| 9012.0140 | STVPSQKTY | 13552 | 9 | Human | p53 | 95 | A | — | 420 | — | 106 | 2 |
| 1553.01 | PSQKTYQGSY | 13553 | 10 | Human | p53 | 98 | | 485 | — | — | 142 | 2 |
| 1598.01 | GTDKSVTCTY | 13554 | 10 | Human | p53 | 117 | A | 412 | — | 4748 | 1886 | 1 |
| 1096.05 | GTAKSVTCTY | 13555 | 10 | Human | p53 | 117 | | 2865 | 1245 | 4535 | 59 | 1 |
| 9012.0156 | GTDVRAMAIY | 13556 | 10 | Human | p53 | 154 | A | 21 | 965 | 1061 | 1.4 | 2 |

TABLE 187-continued

| Binding affinity of A01 supertype peptides | | | | | | | | | | | | |
|---|---|---|---|---|---|---|---|---|---|---|---|---|
| Peptide | Sequence | SEQ ID NO | AA | Organism | Protein | Position | Analog | A*0101 | A*2601 | A*2902 | A*3002 | Degen-eracy |
| 9012.0155 | GTRVRAMAIY | 13557 | 10 | Human | p53 | 154 | | — | 237 | 959 | 1.4 | 2 |
| 1096.14 | RVEGNLRVEY | 13558 | 10 | Human | p53 | 196 | | 2003 | — | 14,728 | 48 | 1 |
| 9012.0198 | NTDRHSVVVPY | 13559 | 11 | Human | p53 | 210 | A | 247 | 4611 | 1716 | 9692 | 1 |
| 9012.0197 | NTFRHSVVVPY | 13560 | 11 | Human | p53 | 210 | | 4396 | 276 | 1099 | 3686 | 1 |
| 1470.36 | GSDCTTIHYNY | 13561 | 11 | Human | p53 | 226 | | 102 | 2795 | 14,738 | 729 | 1 |
| 9012.0200 | GTDCTTIHYNY | 13562 | 11 | Human | p53 | 226 | A | 29 | 4863 | 959 | 76 | 2 |
| 9012.0114 | CTDIHYNY | 13563 | 8 | Human | p53 | 229 | A | 68 | 2193 | 2552 | 1026 | 1 |
| 9012.0113 | CTTIHYNY | 13564 | 8 | Human | p53 | 229 | | 3479 | 893 | 3121 | 364 | 1 |

—indicates binding affinity >20,000 nM.

TABLE 188

| Binding affinity of A02 supertype peptides | | | | | | | | | | | | | |
|---|---|---|---|---|---|---|---|---|---|---|---|---|---|
| Peptide | Sequence | SEQ ID NO | AA | Organism | Protein | Position | Ana-log | A*0201 | A*0202 | A*0203 | A*0206 | A*6802 | Degen-eracy |
| 1369.01 | GVLGWSPQV | 13565 | 9 | HBV | env | 62 | A | 22 | 157 | 389 | 28 | 9428 | 4 |
| 1369.14 | VVQAGFFLV | 13566 | 9 | HBV | env | 177 | A | 440 | 79 | 2503 | 81 | 617 | 3 |
| 1369.13 | PVLPIFFCV | 13567 | 9 | HBV | env | 377 | A | 8.7 | 3136 | 14,286 | 22 | 1814 | 2 |
| 70.0094 | FLLAQFTSAI | 13568 | 10 | HBV | Pol | 503 | | 65 | 1.9 | 4.8 | 148 | 533 | 4 |
| 1369.15 | YVDDVVLGV | 13569 | 9 | HBV | pol | 538 | A | 18 | 14 | 70 | 16 | 354 | 5 |
| 1369.03 | FVLSLGIHV | 13570 | 9 | HBV | pol | 562 | A | 45 | 399 | 2817 | 131 | 112 | 4 |
| 1369.26 | IVRGTSFVYV | 13571 | 10 | HBV | pol | 773 | A | — | 5301 | 69 | 5398 | 1217 | 1 |
| 1369.02 | HVYSHPIIV | 13572 | 9 | HBV | pol | 1076 | A | 150 | 1923 | 14 | 1199 | 123 | 3 |
| F124.06 | CINGVCWTV | 13573 | 9 | HCV | NS3 | 1073 | | 63 | | | | | 1 |
| F124.03 | KLVALGINAV | 13574 | 10 | HCV | NS3 | 1406 | | 461 | | | | | 1 |
| 9016.0058 | YLVAYQATV | 13575 | 9 | HCV | NS4 | 1590 | | 8.6 | 0.49 | 2.5 | 5.8 | 47 | 5 |
| F124.04 | SLMAFTAAV | 13576 | 9 | HCV | NS4 | 1789 | | 20 | | | | | 1 |
| 1537.01 | RLTPLCVTL | 13577 | 9 | HIV | Env | 13 | A | 28 | 6.0 | 54 | 164 | — | 4 |
| 1537.02 | KLTQLCVTL | 13578 | 9 | HIV | Env | 13 | A | 24 | 2.7 | 38 | 131 | — | 4 |
| 1537.03 | KLTSLCVTL | 13579 | 9 | HIV | Env | 13 | A | 91 | 29 | 91 | 181 | — | 4 |
| 1516.13 | QITPLCVTL | 13580 | 9 | HIV | Env | 134 | A | 976 | 124 | 4391 | 634 | 2867 | 1 |
| 1516.14 | KLTFLCVTL | 13581 | 9 | HIV | Env | 134 | A | 19 | 3.0 | 41 | 123 | — | 4 |
| 1516.15 | KLTPLCVIL | 13582 | 9 | HIV | Env | 134 | A | 356 | 74 | 968 | 1545 | — | 2 |
| 1539.01 | MTANPPIPV | 13583 | 9 | HIV | Gag | 27 | A | 2.3 | 7.2 | 2.5 | 1066 | 2 | 4 |
| 1539.02 | MTRNPPVPV | 13584 | 9 | HIV | Gag | 27 | A | 9171 | 1136 | 35 | — | 117 | 2 |
| 1539.03 | MTSNPAIPV | 13585 | 9 | HIV | Gag | 27 | A | 1465 | 951 | 68 | 911 | 2 | 2 |
| 1539.04 | ALAEAMSQA | 13586 | 9 | HIV | Gag | 38 | A | 15 | 1.9 | 20 | 17 | 3021 | 4 |
| 1539.05 | VLAEAMGQV | 13587 | 9 | HIV | Gag | 38 | A | 55 | 1.7 | 3.2 | 75 | 168 | 5 |
| 1539.06 | VLAEAMSHT | 13588 | 9 | HIV | Gag | 38 | A | 243 | 16 | 7.5 | 975 | — | 3 |
| 1539.07 | VLAEAMSKA | 13589 | 9 | HIV | Gag | 38 | A | 69 | 3.4 | 7.6 | 101 | 4578 | 4 |
| 1539.08 | VLGEAMSQA | 13590 | 9 | HIV | Gag | 38 | A | 176 | 21 | 22 | 1089 | — | 3 |
| 1211.08 | SLYNTVATL | 13591 | 9 | HIV | GAG | 77 | | 290 | 6573 | 68 | — | 1155 | 2 |
| 1516.08 | VLAEAMSHV | 13592 | 9 | HIV | Gag | 386 | A | 29 | 1.9 | 5.5 | 89 | 304 | 5 |
| 1516.09 | ILAEAMSKA | 13593 | 9 | HIV | Gag | 386 | A | 72 | 3.5 | 2.8 | 126 | 2655 | 4 |
| 1516.10 | VLAEAMSRV | 13594 | 9 | HIV | Gag | 386 | A | 40 | 2.6 | 3.7 | 75 | 487 | 5 |
| 1516.11 | VLAEAMSAA | 13595 | 9 | HIV | Gag | 386 | A | 24 | 0.00 | 0.87 | 10 | 474 | 5 |
| 1516.12 | VLAEAMAAA | 13596 | 9 | HIV | Gag | 386 | A | 17 | 1.9 | 3.2 | 16 | 639 | 4 |
| 73.0103 | FLKEKGGLEGV | 13597 | 11 | HIV | NEF | 117 | A | 322 | 3.5 | 6.8 | 739 | 1252 | 3 |
| 73.0105 | FLKEKGGLDGV | 13598 | 11 | HIV | NEF | 117 | A | 332 | 3.7 | 11 | 3207 | 3807 | 3 |
| 73.0120 | EILDLWVYHV | 13599 | 10 | HIV | NEF | 185 | A | 496 | 569 | 1865 | 2229 | 163 | 2 |
| 73.0122 | ILDLWVYHV | 13600 | 9 | HIV | NEF | 186 | A | 17 | 30 | 156 | 145 | 7414 | 4 |
| 73.0124 | ILDLWVYNV | 13601 | 9 | HIV | NEF | 186 | A | 40 | 30 | 201 | 135 | 5814 | 4 |
| 73.0127 | WQNYTPGPGV | 13602 | 10 | HIV | NEF | 204 | A | 1175 | 114 | 230 | 223 | 11,993 | 3 |
| 73.0129 | WLNYTPGPGI | 13603 | 10 | HIV | NEF | 204 | A | 135 | 4.6 | 46 | — | 1196 | 3 |
| 73.0138 | LLFGWCFKL | 13604 | 9 | HIV | NEF | 221 | A | 18 | 4.1 | 198 | 340 | 1084 | 4 |
| 73.0139 | LTFGWCFKV | 13605 | 9 | HIV | NEF | 221 | A | 15 | 33 | 1168 | 187 | 10 | 4 |
| 73.0157 | LLLPPLERLTL | 13606 | 11 | HIV | REV | 77 | A | 34 | 2607 | 9010 | 45 | — | 2 |
| 73.0158 | LQLPPLERLTV | 13607 | 11 | HIV | REV | 77 | A | 159 | 4545 | 6270 | 52 | — | 2 |
| 1525.09 | RILQQLLFV | 13608 | 9 | HIV | Vpr | 62 | A | 28 | 489 | 60 | 18 | 17,931 | 4 |
| 1525.10 | RLLQQLLFI | 13609 | 9 | HIV | Vpr | 62 | A | 27 | 70 | 46 | 19 | — | 4 |
| 1525.11 | RTLQQLLFI | 13610 | 9 | HIV | Vpr | 62 | A | 152 | — | 1658 | 89 | — | 2 |
| 1525.12 | RMLQQLLFI | 13611 | 9 | HIV | Vpr | 62 | A | 15 | 128 | 12 | 16 | 18,745 | 4 |
| 1525.13 | RILQQLLFT | 13612 | 9 | HIV | Vpr | 62 | A | 1427 | 5693 | 5251 | 491 | — | 1 |
| 1525.14 | RILQQLLFA | 13613 | 9 | HIV | Vpr | 62 | A | 123 | 68 | 68 | 20 | — | 4 |
| 1525.15 | RTLQQLLFV | 13614 | 9 | HIV | Vpr | 62 | A | 120 | 1282 | 190 | 30 | — | 3 |
| 1525.16 | RMLQQLLFV | 13615 | 9 | HIV | Vpr | 62 | A | 21 | 21 | 6.8 | 14 | — | 4 |
| 1525.17 | RMLQQLLFT | 13616 | 9 | HIV | Vpr | 62 | A | 126 | 1868 | 493 | 139 | | 3 |
| 1525.18 | RTLQQLLFA | 13617 | 9 | HIV | Vpr | 62 | A | 948 | 1646 | 394 | 18 | — | 2 |
| 1525.20 | RILQQLLLI | 13618 | 9 | HIV | Vpr | 62 | A | 199 | 4681 | 1003 | 82 | — | 2 |
| 1525.21 | KILQQLLFI | 13619 | 9 | HIV | Vpr | 62 | A | 41 | 1056 | 126 | 51 | — | 3 |

TABLE 188-continued

Binding affinity of A02 supertype peptides

| Peptide | Sequence | SEQ ID NO | AA | Organism | Protein | Position | Ana-log | A*0201 | A*0202 | A*0203 | A*0206 | A*6802 | Degen-eracy |
|---|---|---|---|---|---|---|---|---|---|---|---|---|---|
| 1525.22 | RILQQMLFI | 13620 | 9 | HIV | Vpr | 62 | A | 187 | 709 | 241 | 108 | — | 3 |
| 1525.23 | RTLQQLMFI | 13621 | 9 | HIV | Vpr | 62 | A | 143 | 1822 | 514 | 55 | — | 2 |
| 1525.24 | RILQHLLFA | 13622 | 9 | HIV | Vpr | 62 | A | 160 | 220 | 51 | 11 | — | 4 |
| 1525.25 | RTLQLLLFV | 13623 | 9 | HIV | Vpr | 62 | A | 4.7 | 371 | 468 | 11 | 3206 | 4 |
| 1525.26 | TILQQLLFI | 13624 | 9 | HIV | Vpr | 62 | A | 95 | 2786 | 367 | 91 | 7032 | 3 |
| 1525.27 | RILQRLLFV | 13625 | 9 | HIV | Vpr | 62 | A | 64 | 1585 | 11 | 73 | — | 3 |
| 1545.01 | RVLQQLLFI | 13626 | 9 | HIV | Vpr | 62 | A | 27 | 1062 | 24 | 8.5 | 10,579 | 3 |
| 1545.03 | RILQQPLFI | 13627 | 9 | HIV | Vpr | 62 | A | 140 | 9910 | 38 | 872 | — | 2 |
| 1545.04 | RMLQHLLFI | 13628 | 9 | HIV | Vpr | 62 | A | 16 | 10 | 4.0 | 14 | — | 4 |
| 1545.05 | RVLQQLLFV | 13629 | 9 | HIV | Vpr | 62 | A | 10 | 1005 | 29 | 6.4 | — | 3 |
| 1577.43 | SLSAYIIRV | 13630 | 9 | HIV | | | | 40 | | | | | 1 |
| 1578.19 | GMGCTGWFEV | 13631 | 10 | HPV | E1 | 11 | | 1049 | 37 | 62 | 1456 | 1321 | 2 |
| 1578.41 | ALFNVQEGV | 13632 | 9 | HPV | E1 | 68 | | 64 | 2.0 | 5.2 | 45 | 914 | 4 |
| 1578.25 | AIFGVNPTV | 13633 | 9 | HPV | E1 | 232 | | 205 | 21 | 92 | 96 | 1057 | 4 |
| 1578.14 | CLYCHLQSL | 13634 | 9 | HPV | E1 | 239 | | 1031 | 90 | 45 | 1772 | 9600 | 2 |
| 86.0178 | AIFGVNPTI | 13635 | 9 | HPV | E1 | 246 | | 1822 | 13 | 324 | 421 | 3536 | 3 |
| 86.0202 | LIQPYSIYA | 13636 | 9 | HPV | E1 | 250 | | 1397 | 245 | 2112 | 428 | 3296 | 2 |
| 1578.34 | MQCLTCTWGV | 13637 | 10 | HPV | E1 | 251 | | 9.9 | 5.5 | 36 | 5.6 | 20 | 5 |
| 1578.20 | SLYTHLQCL | 13638 | 9 | HPV | E1 | 252 | | 224 | 2.6 | 11 | 540 | 8475 | 3 |
| 1578.26 | TLYAHIQCL | 13639 | 9 | HPV | E1 | 252 | | 269 | 4,9 | 9.4 | 420 | 1613 | 4 |
| 1578.01 | LLQQYCLYL | 13640 | 9 | HPV | E1 | 254 | | 224 | 11 | 17 | 309 | 606 | 4 |
| 1578.07 | LIQPFILYA | 13641 | 9 | HPV | E1 | 261 | | 124 | 70 | 46 | 71 | 8625 | 4 |
| 1578.02 | SLACSWGMVV | 13642 | 10 | HPV | E1 | 266 | | 805 | 22 | 8.5 | 1710 | 588 | 2 |
| 1578.08 | ILYAHIQCL | 13643 | 9 | HPV | E1 | 266 | | 314 | 9.4 | 10 | 420 | 16,355 | 4 |
| 1578.15 | KLLEKLLCI | 13644 | 9 | HPV | E1 | 272 | | 19 | 21 | 15 | 51 | — | 4 |
| 1578.21 | KLMSNLLSI | 13645 | 9 | HPV | E1 | 285 | | 16 | 2.7 | 7.9 | 34 | — | 4 |
| 1578.29 | KLMSQLLNI | 13646 | 9 | HPV | E1 | 288 | | 35 | 1.6 | 12 | 56 | — | 4 |
| 1578.03 | KLLSKLLCV | 13647 | 9 | HPV | E1 | 292 | | 55 | 68 | 36 | 125 | — | 4 |
| 86.0189 | ALYWYRTGM | 13648 | 9 | HPV | E1 | 298 | | 1596 | 13 | 57 | 15,649 | — | 2 |
| 86.0195 | ALYWFRTAM | 13649 | 9 | HPV | E1 | 311 | | 1477 | 17 | 214 | 13,949 | — | 2 |
| 1578.30 | ALYWYRTGL | 13650 | 9 | HPV | E1 | 314 | | 5066 | 8.2 | 23 | 11,468 | — | 2 |
| 86.0176 | ALYWYKTGI | 13651 | 9 | HPV | E1 | 318 | | 665 | 21 | 53 | 4120 | 3292 | 2 |
| 86.0181 | ALYWYRTGI | 13652 | 9 | HPV | E1 | 325 | | 555 | 24 | 64 | 4639 | 4850 | 2 |
| 1578.35 | SLQDSQFEL | 13653 | 9 | HPV | E1 | 336 | | 141 | 1.4 | 165 | 160 | 8852 | 4 |
| 86.0190 | VQWAYDNDV | 13654 | 9 | HPV | E1 | 341 | | 4435 | 89 | 375 | 428 | 3590 | 3 |
| 86.0209 | VQWAFDNEV | 13655 | 9 | HPV | E1 | 348 | | 286 | 1502 | 4519 | 31 | — | 2 |
| 86.0196 | VQWAYDNEL | 13656 | 9 | HPV | E1 | 354 | | 3974 | 190 | 1916 | 1098 | — | 1 |
| 86.0205 | VQWAYDHDI | 13657 | 9 | HPV | E1 | 357 | | 6899 | 6836 | — | 427 | — | 1 |
| 1578.36 | FQYAQLADV | 13658 | 9 | HPV | E1 | 364 | | 42 | 3.7 | 12 | 32 | 16,876 | 4 |
| 86.0182 | VQWAFDNEL | 13659 | 9 | HPV | E1 | 368 | | 3227 | 319 | 449 | 256 | — | 3 |
| 1578.09 | MAFEYALLA | 13660 | 9 | HPV | E1 | 382 | | 226 | 52 | 74 | 100 | 29 | 5 |
| 1578.16 | QQIEFVSFL | 13661 | 9 | HPV | E1 | 429 | | 19 | 3.3 | 14 | 49 | 44 | 5 |
| 1578.17 | FLSALKLFL | 13662 | 9 | HPV | E1 | 436 | | 17 | 2.8 | 11 | 45 | 2146 | 4 |
| 1578.37 | FLSYFKLFL | 13663 | 9 | HPV | E1 | 443 | | 30 | 2.1 | 8.6 | 45 | 4752 | 4 |
| 1578.22 | FLGAFKKFL | 13664 | 9 | HPV | EI | 449 | | 5839 | 10 | 476 | 11,816 | — | 2 |
| 1578.42 | FLVAFKQFL | 13665 | 9 | HPV | E1 | 449 | | 55 | 0.43 | 4.7 | 81 | 1405 | 4 |
| 1578.31 | FLDAFKKFL | 13666 | 9 | HPV | E1 | 452 | | 158 | 25 | 251 | 420 | — | 4 |
| 1578.10 | QQIEFITFL | 13667 | 9 | HPV | E1 | 456 | | 42 | 5.9 | 20 | 45 | 93 | 5 |
| 1578.11 | FLGALKSFL | 13668 | 9 | HPV | E1 | 463 | | 719 | 0.30 | 2.1 | 1720 | 3934 | 2 |
| 1593.56 | FLGALKSFV | 13669 | 9 | HPV | E1 | 463 | A | 93 | 1.1 | 1.1 | 79 | 822 | 4 |
| 1578.18 | FLQGCIISYA | 13670 | 10 | HPV | E1 | 473 | | 93 | 2.6 | 9.0 | 241 | 1409 | 4 |
| 1578.38 | FQGSVISFV | 13671 | 9 | HPV | E1 | 481 | | 15 | 1.8 | 1.8 | 13 | 564 | 4 |
| 1578.23 | FLKGCVISCV | 13672 | 10 | HPV | E1 | 486 | | 2800 | 13 | 13 | 7191 | 13,093 | 2 |
| 1578.27 | FLQGAIISFV | 13673 | 10 | HPV | E1 | 486 | | 45 | 0.65 | 6.6 | 69 | 86 | 5 |
| 1578.43 | FLKGCIISYV | 13674 | 10 | HPV | E1 | 486 | | 341 | 0.85 | 2.0 | 1165 | 795 | 3 |
| 1578.28 | LQGAIISFV | 13675 | 9 | HPV | E1 | 487 | | 42 | 6.6 | 11 | 20 | 1215 | 4 |
| 1578.04 | SLMKFLQGSV | 13676 | 10 | HPV | E1 | 489 | | 436 | 31 | 4.6 | 1452 | 10,371 | 3 |
| 1578.32 | FLSGCVISYV | 13677 | 10 | HPV | E1 | 489 | | 43 | 2.7 | 7.4 | 67 | 102 | 5 |
| 1578.05 | FLQGSVICFV | 13678 | 10 | HPV | E1 | 493 | | 41 | 3.5 | 9.1 | 73 | 380 | 5 |
| 1578.06 | LQGSVICFV | 13679 | 9 | HPV | E1 | 494 | | 23 | 33 | 21 | 52 | 3562 | 4 |
| 1578.12 | FIQGAVISFV | 13680 | 10 | HPV | E1 | 500 | | 255 | 12 | 18 | 345 | 394 | 5 |
| 1578.13 | IQGAVISFV | 13681 | 9 | HPV | E1 | 501 | | 45 | 12 | 13 | 35 | 4876 | 4 |
| 1578.24 | GMIDDVTPI | 13682 | 9 | HPV | E1 | 512 | | 25 | 0.20 | 0.63 | 24 | — | 4 |
| 1578.44 | GMIDDVTAI | 13683 | 9 | HPV | E1 | 512 | | 23 | 5.3 | 7.3 | 37 | — | 4 |
| 1578.39 | YIDDYLRNL | 13684 | 9 | HPV | EI | 518 | | 664 | 27 | 380 | 862 | — | 2 |
| 1578.33 | ALDGNDISV | 13685 | 9 | HPV | E1 | 535 | | 40 | 41 | 337 | 48 | — | 4 |
| 1578.40 | FQFQNPFPL | 13686 | 9 | HPV | E1 | 573 | | 8.4 | 0.75 | 3.5 | 6.3 | 3158 | 4 |
| 86.0075 | YLHNRLVVFT | 13687 | 10 | HPV | E1 | 578 | | 2160 | 120 | 181 | 15,169 | 1596 | 2 |
| 1578.51 | RLENAILFTA | 13688 | 10 | HPV | E2 | 43 | | 2148 | 43 | 1766 | 4556 | — | 1 |
| 1593.60 | RLENAILFTV | 13689 | 10 | HPV | E2 | 43 | A | 101 | 24 | 160 | 134 | 15,802 | 4 |
| 1578.45 | TLQDVSLEV | 13690 | 9 | HPV | E2 | 93 | | 701 | 18 | 26 | 2072 | 2682 | 2 |
| 1593.54 | TTQDVSLEV | 13691 | 9 | HPV | E2 | 93 | A | 1344 | 2355 | 147 | 674 | 9 | 2 |
| 1593.55 | TVQDVSLEV | 13692 | 9 | HPV | E2 | 93 | A | 244 | 483 | 56 | 194 | 15 | 5 |
| 1578.47 | YTNWKFIYL | 13693 | 9 | HPV | E2 | 131 | | 69 | 14 | 31 | 84 | 146 | 5 |
| 1578.49 | YTNWGEIYI | 13694 | 9 | HPV | E2 | 131 | | 293 | 10 | 82 | 700 | 24 | 4 |

TABLE 188-continued

Binding affinity of A02 supertype peptides

| Peptide | Sequence | SEQ ID NO | AA | Organism | Protein | Position | Ana-log | A*0201 | A*0202 | A*0203 | A*0206 | A*6802 | Degen-eracy |
|---|---|---|---|---|---|---|---|---|---|---|---|---|---|
| 1578.56 | YTNWSEIYI | 13695 | 9 | HPV | E2 | 131 | | 61 | 3.6 | 47 | 216 | 5 | 5 |
| 1578.46 | VAWDSVYYM | 13696 | 9 | HPV | E2 | 136 | | 172 | 603 | 1332 | 790 | 5154 | 1 |
| 1593.57 | VAWDSVYYV | 13697 | 9 | HPV | E2 | 136 | A | 4.4 | 35 | 143 | 3.3 | 48 | 5 |
| 1578.52 | YVVWDSIYYI | 13698 | 10 | HPV | E2 | 137 | | 77 | 127 | 287 | 49 | 172 | 5 |
| 1578.48 | YLCIDGQCTV | 13699 | 10 | HPV | E2 | 138 | | 1771 | 283 | 274 | 4651 | — | 2 |
| 1578.53 | VVWDSIYYI | 13700 | 9 | HPV | E2 | 138 | | 13 | 39 | 288 | 11 | 52 | 5 |
| 1593.58 | YTCIDGQCTV | 13701 | 10 | HPV | E2 | 138 | A | 698 | 314 | 420 | 1013 | 459 | 3 |
| 1593.59 | YVCIDGQCTV | 13702 | 10 | HPV | E2 | 138 | A | 950 | 128 | 399 | 538 | 593 | 2 |
| 1578.50 | KLFCADPAL | 13703 | 9 | HPV | E2 | 242 | | 70 | 6.8 | 73 | 82 | — | 4 |
| 1578.54 | FQKYKTLFV | 13704 | 9 | HPV | E2 | 311 | | 1138 | 821 | 30 | 419 | — | 2 |
| 1578.55 | FLSHVKIPV | 13705 | 9 | HPV | E2 | 351 | | 41 | 4.0 | 9.8 | 91 | 60 | 5 |
| 1491.73 | TLHDLCQAV | 13706 | 9 | HPV | E6 | 11 | A | 331 | 17 | 15 | 10,585 | 2809 | 3 |
| 1491.57 | TLSFVCPWCV | 13707 | 10 | HPV | E7 | 94 | A | 786 | 123 | 370 | 4357 | 388 | 3 |
| 1481.17 | LTNTGLYNL | 13708 | 9 | HPV18 | E6 | 93 | | 13,609 | 20 | 4987 | 1835 | 1580 | 1 |
| 1481.25 | TLSFVCPWCA | 13709 | 10 | HPV18 | E7 | 93 | | 1611 | 221 | 521 | — | 13,228 | 1 |
| 1481.46 | RTLHDLCQA | 13710 | 9 | HPV33 | E6 | 10 | | 8121 | 34 | 678 | 96 | — | 2 |
| 1481.47 | TLHDLCQAL | 13711 | 9 | HPV33 | E6 | 11 | | 1404 | 2.7 | 40 | 2182 | — | 2 |
| 9013.0115 | WQRLLLTASV | 13712 | 10 | Human | CEA | 15 | A | 5114 | 16,288 | 36 | 2227 | — | 1 |
| 9013.0116 | WLRLLLTASL | 13713 | 10 | Human | CEA | 15 | A | 8816 | 12,466 | 32 | 17,432 | 19,784 | 1 |
| 9013.0253 | WQRLLLTASLV | 13714 | 11 | Human | CEA | 15 | A | 1713 | 246 | 19 | 496 | — | 3 |
| 9013.0254 | WLRLLLTASLL | 13715 | 11 | Human | CEA | 15 | A | 3481 | 171 | 12 | 11,778 | — | 2 |
| 9013.0117 | RLLLTASLLV | 13716 | 10 | Human | CEA | 17 | A | 57 | 123 | 103 | 114 | 5937 | 4 |
| 9013.0002 | LLLTASLLV | 13717 | 9 | Human | CEA | 18 | A | 28 | 1334 | 293 | 79 | — | 3 |
| 9013.0118 | SLLTFWNPPV | 13718 | 10 | Human | CEA | 23 | A | 208 | 76 | 159 | 207 | 24 | 5 |
| 9013.0256 | SLLTFWNPPTV | 13719 | 11 | Human | CEA | 23 | A | 55 | 54 | 54 | 536 | 2272 | 3 |
| 9013.0120 | LLTFWNPPTV | 13720 | 10 | Human | CEA | 24 | A | 170 | 10 | 3.2 | 1001 | 607 | 3 |
| 9013.0259 | LLTFWNPPTTV | 13721 | 11 | Human | CEA | 24 | A | 762 | 67 | 58 | 5811 | 7535 | 2 |
| 9013.0006 | LTFWNPPTV | 13722 | 9 | Human | CEA | 25 | A | 3.4 | 17 | 2.3 | 5.2 | 14 | 5 |
| 9013.0007 | LLFWNPPTT | 13723 | 9 | Human | CEA | 25 | A | 11 | 15 | 4.3 | 889 | — | 3 |
| 9013.0122 | LTFWNPPTTV | 13724 | 10 | Human | CEA | 25 | A | 210 | 38 | 1.9 | 339 | 23 | 5 |
| 9013.0123 | LLFWNPPTTA | 13725 | 10 | Human | CEA | 25 | A | 25 | 1.3 | 1.6 | 1172 | 2136 | 3 |
| 9013.0125 | TTAKLTIESV | 13726 | 10 | Human | CEA | 32 | A | — | 4070 | 355 | 10,428 | 53 | 2 |
| 9013.0009 | TAKLTIESV | 13727 | 9 | Human | CEA | 33 | A | — | 480 | 216 | 10,738 | 243 | 3 |
| 9013.0010 | TLKLTIEST | 13728 | 9 | Human | CEA | 33 | A | 18,337 | 80 | 24 | — | — | 2 |
| 9013.0265 | KVTIESTPFNV | 13729 | 11 | Human | CEA | 35 | A | 2575 | 239 | 40 | 93 | 1547 | 3 |
| 9013.0128 | LLIESTPFNV | 13730 | 10 | Human | CEA | 36 | A | 16 | 4.0 | 8.1 | 62 | 202 | 5 |
| 9013.0267 | LTIESTPFNVV | 13731 | 11 | Human | CEA | 36 | A | 1087 | 188 | 14 | 77 | 123 | 4 |
| 9013.0268 | LLIESTPFNVA | 13732 | 11 | Human | CEA | 36 | A | 121 | 3.3 | 3.5 | 107 | — | 4 |
| 9013.0012 | TLESTPFNV | 13733 | 9 | Human | CEA | 37 | A | 216 | 19 | 221 | 1209 | 241 | 4 |
| 9013.0013 | TVESTPFNV | 13734 | 9 | Human | CEA | 37 | A | 17,240 | 1914 | 6164 | 2395 | 313 | 1 |
| 9013.0130 | TIESTPFNVV | 13735 | 10 | Human | CEA | 37 | A | 15,639 | 11,864 | 671 | 3225 | 305 | 1 |
| 9013.0015 | NVAEGKEVV | 13736 | 9 | Human | CEA | 44 | A | — | 1307 | 4755 | — | 354 | 1 |
| 9013.0016 | NLAEGKEVL | 13737 | 9 | Human | CEA | 44 | A | 3838 | 14 | 293 | — | — | 2 |
| 9013.0133 | NVAEGKEVLV | 13738 | 10 | Human | CEA | 44 | A | — | 1140 | 19,562 | — | 352 | 1 |
| 9013.0134 | NLAEGKEVLL | 13739 | 10 | Human | CEA | 44 | A | 2249 | 9.2 | 2026 | 16,857 | — | 1 |
| 9013.0271 | NLAEGKEVLLL | 13740 | 11 | Human | CEA | 44 | A | 7590 | 18 | 2718 | — | — | 1 |
| 9013.0019 | VLEGKEVLL | 13741 | 9 | Human | CEA | 45 | A | 2908 | 18 | 2324 | — | — | 1 |
| 9013.0273 | VLEGKEVLLLV | 13742 | 11 | Human | CEA | 45 | A | 1841 | 32 | 272 | 4608 | — | 2 |
| 9013.0021 | EVLLLVHNV | 13743 | 9 | Human | CEA | 50 | A | 3033 | 6240 | 6601 | 107 | 3 | 2 |
| 9013.0022 | ELLLLVHNL | 13744 | 9 | Human | CEA | 50 | A | 2176 | 1881 | — | 7182 | 296 | 1 |
| 9013.0275 | LLLVHNLPQHV | 13745 | 11 | Human | CEA | 52 | A | 4824 | 261 | 652 | 5144 | — | 1 |
| 9013.0139 | RQIIGYVIGV | 13746 | 10 | Human | CEA | 77 | A | 145 | 7.4 | 20 | 47 | 27 | 5 |
| 9013.0140 | RLIIGYVIGT | 13747 | 10 | Human | CEA | 77 | A | 1871 | 179 | 636 | 2715 | 14,594 | 1 |
| 9013.0024 | YVIGTQQAV | 13748 | 9 | Human | CEA | 82 | A | 160 | 3.2 | 6.2 | 84 | 3 | 5 |
| 9013.0025 | YLIGTQQAT | 13749 | 9 | Human | CEA | 82 | A | 207 | 2.6 | 18 | 5524 | 8242 | 3 |
| 9013.0142 | GTQQATPGPV | 13750 | 10 | Human | CEA | 85 | A | — | — | 36 | — | — | 1 |
| 9013.0143 | GLQQATPGPA | 13751 | 10 | Human | CEA | 85 | A | 4870 | 220 | 3.9 | — | — | 2 |
| 9013.0027 | TQQATPGPV | 13752 | 9 | Human | CEA | 86 | A | — | 13,655 | 268 | 5869 | — | 1 |
| 9013.0028 | TLQATPGPA | 13753 | 9 | Human | CEA | 86 | A | 19,382 | 1984 | 29 | — | — | 1 |
| 9013.0029 | IIYPNASLV | 13754 | 9 | Human | CEA | 100 | A | 230 | 24 | 4.0 | 152 | 409 | 5 |
| 9013.0030 | ILYPNASLL | 13755 | 9 | Human | CEA | 100 | A | 130 | 1.8 | 4.2 | 455 | 14,675 | 4 |
| 9013.0144 | IIYPNASLLV | 13756 | 10 | Human | CEA | 100 | A | 466 | 9.9 | 4.7 | 70 | 830 | 4 |
| 9013.0145 | ILYPNASLLI | 13757 | 10 | Human | CEA | 100 | A | 88 | 1.3 | 2.8 | 252 | 3117 | 4 |
| 9013.0032 | IQNIIQNDV | 13758 | 9 | Human | CEA | 109 | A | 16,243 | 1933 | 393 | 3364 | — | 1 |
| 9013.0033 | ILNIIQNDT | 13759 | 9 | Human | CEA | 109 | A | — | 222 | 8008 | — | — | 1 |
| 9013.0146 | IIQNDTGFYV | 13760 | 10 | Human | CEA | 112 | A | 155 | 25 | 548 | 201 | 2599 | 3 |
| 9013.0147 | ILQNDTGFYT | 13761 | 10 | Human | CEA | 112 | A | 902 | 187 | 3745 | 11,094 | — | 1 |
| 9013.0034 | IQNDTGFYT | 13762 | 9 | Human | CEA | 113 | | — | 3741 | 5640 | 474 | — | 1 |
| 9013.0035 | IQNDTGFYV | 13763 | 9 | Human | CEA | 113 | A | 148 | 16 | 37 | 32 | 4498 | 4 |
| 9013.0036 | ILNDTGFYT | 13764 | 9 | Human | CEA | 113 | A | 213 | 14 | 185 | 3812 | — | 3 |
| 9013.0149 | IQNDTGFYTV | 13765 | 10 | Human | CEA | 113 | A | 600 | 20 | 31 | 63 | 8835 | 3 |
| 9013.0150 | ILNDTGFYTL | 13766 | 10 | Human | CEA | 113 | A | 152 | 2.1 | 59 | 381 | 11,260 | 4 |
| 9013.0151 | YTLHVIKSDV | 13767 | 10 | Human | CEA | 120 | A | 4372 | 1079 | 972 | 54 | 16 | 2 |
| 9013.0152 | YLLHVIKSDL | 13768 | 10 | Human | CEA | 120 | A | 86 | 22 | 352 | 62 | 15,271 | 4 |
| 9013.0278 | VIKSDLVNEEV | 13769 | 11 | Human | CEA | 124 | A | — | 57 | 1727 | — | — | 1 |

TABLE 188-continued

Binding affinity of A02 supertype peptides

| Peptide | Sequence | SEQ ID NO | AA | Organism | Protein | Position | Ana-log | A*0201 | A*0202 | A*0203 | A*0206 | A*6802 | Degen-eracy |
|---|---|---|---|---|---|---|---|---|---|---|---|---|---|
| 9013.0279 | VLKSDLVNEEA | 13770 | 11 | Human | CEA | 124 | A | — | 14 | 3419 | — | — | 1 |
| 9013.0038 | GQFRVYPEV | 13771 | 9 | Human | CEA | 136 | A | 1376 | 344 | 313 | 43 | — | 3 |
| 9013.0039 | GLFRVYPEL | 13772 | 9 | Human | CEA | 136 | A | 43 | 13 | 229 | 1423 | — | 3 |
| 9013.0155 | AVAFTCEPEV | 13773 | 10 | Human | CEA | 162 | A | 7858 | 233 | 54 | 199 | 13,390 | 3 |
| 9013.0156 | ALAFTCEPET | 13774 | 10 | Human | CEA | 162 | A | — | 206 | 279 | 7964 | — | 2 |
| 9013.0045 | VLFTCEPET | 13775 | 9 | Human | CEA | 163 | A | 2544 | 134 | 502 | — | — | 1 |
| 9013.0158 | TLDATYLWWV | 13776 | 10 | Human | CEA | 171 | A | 61 | 137 | 468 | 155 | 1060 | 4 |
| 9013.0286 | RLQLSNGNRTL | 13777 | 11 | Human | CEA | 190 | | — | 443 | 2839 | — | — | 1 |
| 9013.0050 | QLSNGNRTL | 13778 | 9 | Human | CEA | 192 | | 16,059 | 39 | 43 | — | 8653 | 2 |
| 9013.0292 | QLSNGNRTLTL | 13779 | 11 | Human | CEA | 192 | | — | 80 | 683 | — | — | 1 |
| 9013.0230 | TLFNVTRNDV | 13780 | 10 | Human | CEA | 201 | A | 1479 | 69 | 25 | 4843 | — | 2 |
| 9013.0052 | VLYGPDAPV | 13781 | 9 | Human | CEA | 233 | A | 48 | 2.4 | 19 | 172 | 3264 | 4 |
| 9013.0054 | NLNLSCHAV | 13782 | 9 | Human | CEA | 254 | A | 633 | 15 | 39 | 7132 | 2203 | 2 |
| 9013.0172 | AQYSWFVNGV | 13783 | 10 | Human | CEA | 267 | A | 114 | 1.2 | 2.4 | 13 | 11,952 | 4 |
| 9013.0173 | ALYSWFVNGT | 13784 | 10 | Human | CEA | 267 | A | 661 | 8.9 | 3.6 | 875 | — | 2 |
| 9013.0175 | GTFQQSTQEV | 13785 | 10 | Human | CEA | 275 | A | — | 157 | 431 | 2046 | 896 | 2 |
| 9013.0176 | GLFQQSTQEL | 13786 | 10 | Human | CEA | 275 | A | 1362 | 6.2 | 48 | — | — | 2 |
| 9013.0178 | FQQSTQELFV | 13787 | 10 | Human | CEA | 277 | A | 143 | 21 | 46 | 60 | — | 4 |
| 9013.0179 | FLQSTQELFI | 13788 | 10 | Human | CEA | 277 | A | 95 | 3.7 | 59 | 1108 | — | 3 |
| 9013.0056 | QQSTQELFV | 13789 | 9 | Human | CEA | 278 | A | 1595 | 163 | 409 | 593 | — | 2 |
| 9013.0057 | QLSTQELFI | 13790 | 9 | Human | CEA | 278 | A | 65 | 4.5 | 27 | 7471 | 8169 | 3 |
| 9013.0181 | STQELFIPNV | 13791 | 10 | Human | CEA | 280 | A | 5499 | 2098 | 566 | 181 | 854 | 1 |
| 9013.0182 | SLQELFIPNI | 13792 | 10 | Human | CEA | 280 | A | 126 | 15 | 35 | 66 | 7456 | 4 |
| 9013.0059 | TQELFIPNV | 13793 | 9 | Human | CEA | 281 | A | 308 | 15,949 | 3325 | 55 | 4930 | 2 |
| 9013.0060 | TLELFIPNI | 13794 | 9 | Human | CEA | 281 | A | 29 | 113 | 398 | 84 | 4232 | 4 |
| 9013.0299 | TLELFIPNITV | 13795 | 11 | Human | CEA | 281 | A | 161 | 502 | 15,823 | 2333 | 1044 | 1 |
| 9013.0300 | TVELFIPNITV | 13796 | 11 | Human | CEA | 281 | A | 8207 | 10,183 | — | 1644 | 193 | 1 |
| 9013.0062 | EVFIPNITV | 13797 | 9 | Human | CEA | 283 | A | — | — | — | 4263 | 4 | 1 |
| 9013.0303 | NLTVNNSGSYT | 13798 | 11 | Human | CEA | 288 | A | — | — | — | — | 106 | 1 |
| 9013.0187 | ITVNNSGSYV | 13799 | 10 | Human | CEA | 289 | A | — | 334 | 255 | 1013 | 114 | 3 |
| 9013.0064 | TVNNSGSYV | 13800 | 9 | Human | CEA | 290 | A | 16,583 | 310 | 39 | — | 44 | 3 |
| 9013.0065 | TLNNSGSYT | 13801 | 9 | Human | CEA | 290 | A | — | 237 | 233 | — | — | 2 |
| 9013.0190 | CQAHNSDTGV | 13802 | 10 | Human | CEA | 299 | A | — | 339 | 466 | 1565 | — | 2 |
| 9013.0191 | CLAHNSDTGL | 13803 | 10 | Human | CEA | 299 | A | 13,550 | 13 | 39 | — | — | 2 |
| 9013.0066 | GLNRTTVTV | 13804 | 9 | Human | CEA | 307 | A | 109 | 10 | 3.8 | 4726 | — | 3 |
| 9013.0067 | RLTVTTITV | 13805 | 9 | Human | CEA | 307 | A | 108 | 22 | 36 | 704 | 12,988 | 3 |
| 9013.0304 | RTTVTTITVYV | 13806 | 11 | Human | CEA | 310 | A | 154 | 9.6 | 244 | 73 | 0.18 | 5 |
| 9013.0305 | RLTVTTITVYA | 13807 | 11 | Human | CEA | 310 | A | 243 | 23 | 205 | 1103 | 53 | 4 |
| 9013.0192 | TTVTTITVYV | 13808 | 10 | Human | CEA | 311 | A | 1042 | 21 | 326 | 408 | 17 | 4 |
| 9013.0193 | TLVTTITVYA | 13809 | 10 | Human | CEA | 311 | A | 781 | 11 | 57 | 1740 | 194 | 3 |
| 9013.0068 | TVTTITVYV | 13810 | 9 | Human | CEA | 312 | A | 102 | 12 | 58 | 95 | 3 | 5 |
| 9013.0069 | TLTTITVYA | 13811 | 9 | Human | CEA | 312 | A | 14 | 0.75 | 2.6 | 666 | 5 | 4 |
| 9013.0195 | ILNTTYLWWV | 13812 | 10 | Human | CEA | 349 | A | 1017 | 121 | 22 | 775 | 15,923 | 2 |
| 9013.0196 | IVNTTYLWWV | 13813 | 10 | Human | CEA | 349 | A | 5940 | 1435 | 389 | 91 | 71 | 3 |
| 9013.0197 | YLWWVNNQSV | 13814 | 10 | Human | CEA | 354 | A | 8.9 | 1.2 | 4.2 | 65 | 17 | 5 |
| 9013.0070 | WLNNQSLPV | 13815 | 9 | Human | CEA | 357 | A | 29 | 1.3 | 4.3 | 978 | 197 | 4 |
| 9013.0072 | LQLSNDNRV | 13816 | 9 | Human | CEA | 369 | A | — | 1699 | — | 298 | — | 1 |
| 9013.0205 | LLLSNDNRTL | 13817 | 10 | Human | CEA | 369 | A | 8195 | 303 | 4176 | — | — | 1 |
| 9013.0307 | LQLSNDNRTLV | 13818 | 11 | Human | CEA | 369 | A | 12,781 | 1393 | 5204 | 99 | — | 1 |
| 9013.0075 | RTLTLLSVV | 13819 | 9 | Human | CEA | 376 | A | 505 | 6019 | 300 | 88 | — | 2 |
| 9013.0076 | RLLTLLSVT | 13820 | 9 | Human | CEA | 376 | A | 1829 | 4606 | 1603 | 482 | — | 1 |
| 9013.0310 | NLLYGPDDPTI | 13821 | 11 | Human | CEA | 410 | A | 9882 | 421 | 8646 | — | — | 1 |
| 9013.0208 | YTYYRPGVNV | 13822 | 10 | Human | CEA | 424 | A | 514 | 5.6 | 2.9 | 75 | 7 | 4 |
| 9013.0209 | YLYYRPGVNL | 13823 | 10 | Human | CEA | 424 | A | 54 | 2.2 | 2.8 | 940 | 953 | 3 |
| 9013.0311 | GVNLSLSCHAV | 13824 | 11 | Human | CEA | 430 | A | 2089 | 63 | 2590 | 15,270 | 947 | 1 |
| 9013.0312 | GLNLSLSCHAA | 13825 | 11 | Human | CEA | 430 | A | 1418 | 47 | 1179 | — | — | 1 |
| 9013.0314 | AQYSWLIDGNV | 13826 | 11 | Human | CEA | 445 | A | 267 | 62 | 48 | 70 | 15,592 | 4 |
| 9013.0315 | ALYSWLIDGNI | 13827 | 11 | Human | CEA | 445 | A | 25 | 3.6 | 7.0 | 92 | 10,417 | 4 |
| 9013.0212 | ILQHTQELFI | 13828 | 10 | Human | CEA | 455 | A | 845 | 49 | 594 | — | — | 1 |
| 9013.0078 | QQHTQELFV | 13829 | 9 | Human | CEA | 456 | A | 2478 | 5294 | 847 | 325 | — | 1 |
| 9013.0079 | QLHTQELFI | 13830 | 9 | Human | CEA | 456 | A | 832 | 25 | 264 | 11,685 | 19,117 | 2 |
| 9013.0316 | HTQELF1SNIV | 13831 | 11 | Human | CEA | 458 | A | 2662 | 1140 | 1403 | 5388 | 88 | 1 |
| 9013.0082 | TLELFISNI | 13832 | 9 | Human | CEA | 459 | A | 2464 | 170 | 1696 | 3854 | 949 | 1 |
| 9013.0318 | RTTVKTITVSV | 13833 | 11 | Human | CEA | 488 | A | 1593 | 866 | 457 | 137 | 1.4 | 3 |
| 9013.0319 | RLTVKTITVSA | 13834 | 11 | Human | CEA | 488 | A | 1059 | 401 | 91 | 1359 | 270 | 3 |
| 9013.0083 | KTITVSAEV | 13835 | 9 | Human | CEA | 492 | A | 971 | 42 | 2.6 | 79 | 15 | 4 |
| 9013.0084 | KLITVSAEL | 13836 | 9 | Human | CEA | 492 | A | 71 | 3.3 | 27 | 153 | — | 4 |
| 9013.0089 | VLFTCEPEA | 13837 | 9 | Human | CEA | 519 | A | 240 | 70 | 125 | 4567 | — | 3 |
| 9013.0323 | FTCEPEAQNTV | 13838 | 11 | Human | CEA | 521 | A | 336 | 29 | 86 | 920 | 215 | 4 |
| 9013.0324 | FLCEPEAQNTf | 13839 | 11 | Human | CEA | 521 | A | 328 | 52 | 51 | — | — | 3 |
| 9013.0325 | ELQNTTYLWWV | 13840 | 11 | Human | CEA | 526 | A | 3002 | 355 | 1209 | — | 157 | 2 |
| 9013.0326 | EVQNTTYLWWV | 13841 | 11 | Human | CEA | 526 | A | — | — | 19,567 | — | 34 | 1 |
| 9013.0217 | ALNTTYLWWV | 13842 | 10 | Human | CEA | 527 | A | 223 | 48 | 5.6 | 578 | 7695 | 3 |
| 9013.0090 | WLNGQSLPV | 13843 | 9 | Human | CEA | 535 | A | 287 | 8.6 | 6.4 | 2254 | 2181 | 3 |
| 9013.0220 | GLSLPVSPRL | 13844 | 10 | Human | CEA | 538 | A | 15,655 | 223 | 3867 | — | — | 1 |

TABLE 188-continued

Binding affinity of A02 supertype peptides

| Peptide | Sequence | SEQ ID NO | AA | Organism | Protein | Position | Ana-log | A*0201 | A*0202 | A*0203 | A*0206 | A*6802 | Degen-eracy |
|---|---|---|---|---|---|---|---|---|---|---|---|---|---|
| 9013.0222 | SLPVSPRLQV | 13845 | 10 | Human | CEA | 540 | A | 7314 | 1258 | 155 | — | — | 1 |
| 9013.0224 | RLQLSNGNRV | 13846 | 10 | Human | CEA | 546 | A | 17,576 | 207 | 669 | — | — | 1 |
| 9013.0328 | RLQLSNGNRTV | 13847 | 11 | Human | CEA | 546 | A | 5904 | 128 | 57 | — | 4842 | 2 |
| 9013.0227 | LLLSNGNRTL | 13848 | 10 | Human | CEA | 547 | A | 1552 | 158 | 412 | 3987 | — | 2 |
| 9013.0095 | QLSNGNRTV | 13849 | 9 | Human | CEA | 548 | A | 15,126 | 139 | 54 | — | — | 2 |
| 9013.0229 | QLSNGNRTLV | 13850 | 10 | Human | CEA | 548 | A | — | 66 | 146 | — | — | 2 |
| 9013.0334 | QLSNGNRTLTV | 13851 | 11 | Human | CEA | 548 | A | 1053 | 20 | 363 | — | — | 2 |
| 9013.0335 | RLYVCGIQNSV | 13852 | 11 | Human | CEA | 567 | A | 170 | 6.3 | 24 | 1538 | — | 3 |
| 9013.0336 | RVYVCGIQNSV | 13853 | 11 | Human | CEA | 567 | A | 425 | 0.22 | 3.6 | 305 | 6320 | 4 |
| 9013.0096 | YTCGIQNSV | 13854 | 9 | Human | CEA | 569 | A | 1971 | 71 | 310 | 342 | 140 | 4 |
| 9013.0337 | YVCGIQNSVSV | 13855 | 11 | Human | CEA | 569 | A | 344 | 242 | 159 | 58 | 207 | 5 |
| 9013.0338 | YLCGIQNSVSA | 13856 | 11 | Human | CEA | 569 | A | 208 | 21 | 180 | 513 | 9155 | 3 |
| 9013.0099 | SLNRSDPVT | 13857 | 9 | Human | CEA | 578 | A | — | 121 | 2493 | — | — | 1 |
| 9013.0233 | SLNRSDPVTL | 13858 | 10 | Human | CEA | 578 | A | 16,179 | 59 | 80 | — | — | 2 |
| 9013.0100 | YVSGANLNL | 13859 | 9 | Human | CEA | 605 | A | 6161 | 13 | 75 | 230 | 374 | 4 |
| 9013.0235 | PQYSWRINGV | 13860 | 10 | Human | CEA | 623 | A | — | 1328 | 25 | — | — | 1 |
| 9013.0236 | PLYSWRINGI | 13861 | 10 | Human | CEA | 623 | A | — | 348 | 14 | — | — | 2 |
| 9013.0102 | QQHTQVLFV | 13862 | 9 | Human | CEA | 634 | A | 2103 | 1424 | 80 | 126 | — | 2 |
| 9013.0103 | QLHTQVLFI | 13863 | 9 | Human | CEA | 634 | A | 1244 | 22 | 39 | 5523 | — | 2 |
| 9013.0242 | QLHTQVLFIA | 13864 | 10 | Human | CEA | 634 | A | 3938 | 322 | 163 | — | — | 2 |
| 9013.0243 | HTQVLFIAKV | 13863 | 10 | Human | CEA | 636 | A | 2648 | 1572 | 86 | 834 | 1577 | 1 |
| 9013.0244 | HLQVLFIAKI | 13866 | 10 | Human | CEA | 636 | A | 5928 | 789 | 29 | 121 | — | 2 |
| 9013.0105 | TQVLFIAKV | 13867 | 9 | Human | CEA | 637 | A | 1036 | 296 | 27 | 46 | 212 | 4 |
| 9013.0106 | TLVLFIAKI | 13868 | 9 | Human | CEA | 637 | A | 16,573 | 105 | 21 | 29 | 13,030 | 3 |
| 9013.0248 | YACFVSNLAV | 13869 | 10 | Human | CEA | 653 | A | 1389 | 754 | 194 | 71 | 95 | 3 |
| 9013.0250 | GLSAGATVGV | 13870 | 10 | Human | CEA | 682 | A | 97 | 2.9 | 2.8 | 1100 | 1153 | 3 |
| 9013.0342 | GATVGIMIGVV | 13871 | 11 | Human | CEA | 686 | A | — | 7524 | 341 | 4527 | 671 | 1 |
| 9013.0343 | GLTVGIMIGVL | 13872 | 11 | Human | CEA | 686 | A | 5010 | 914 | 290 | 11,500 | 2645 | 1 |
| 9013.0108 | TLGIMIGVL | 13873 | 9 | Human | CEA | 688 | A | 7416 | 286 | 1705 | 9064 | — | 1 |
| 9013.0251 | TLGIMIGVLV | 13874 | 10 | Human | CEA | 688 | A | 195 | 87 | 197 | 2240 | 1782 | 3 |
| 9013.0344 | GIMIGVLVGVV | 13875 | 11 | Human | CEA | 690 | A | 563 | 185 | 82 | 912 | 10,296 | 2 |
| 9013.0345 | GLMIGVLVGVA | 13876 | 11 | Human | CEA | 690 | A | 2187 | 39 | 69 | 3298 | — | 2 |
| 9013.0109 | ITIGVLVGV | 13877 | 9 | Human | CEA | 691 | A | 113 | 43 | 16 | 55 | 9 | 5 |
| 9013.0346 | IMIGVLVGVAV | 13878 | 11 | Human | CEA | 691 | A | 75 | 18 | 55 | 61 | 9005 | 4 |
| 9013.0347 | ILIGVLVGVAL | 13879 | 11 | Human | CEA | 691 | A | 1524 | 239 | 1007 | 120 | — | 2 |
| 9013.0349 | MLGVLVGVALI | 13880 | 11 | Human | CEA | 692 | A | 4961 | 432 | 139 | 4729 | 8788 | 2 |
| 9013.0110 | GVLVGVALV | 13881 | 9 | Human | CEA | 694 | A | 946 | 6088 | 472 | 56 | 15,737 | 2 |
| 9013.0111 | GLLVGVALI | 13882 | 9 | Human | CEA | 694 | A | 158 | 89 | 13 | 206 | 14,914 | 4 |
| 1325.03 | ALBRWGLLV | 13883 | 9 | Human | Her2/neu | 5 | A | 20 | 25 | 4.2 | 285 | 16,000 | 4 |
| 1334.07 | AMCRWGLLV | 13884 | 9 | Human | Her2/neu | 5 | A | 51 | 9282 | 1573 | 2115 | 3904 | 1 |
| 1334.09 | KLFGSLAFV | 13885 | 9 | Human | Her2/neu | 369 | A | 6.8 | 7.9 | 20 | 18 | 1274 | 4 |
| 60.0180 | VLVHPQWVV | 13886 | 9 | Human | Kallikrein | 53 | A | 464 | 65 | 1988 | 3224 | 14,606 | 2 |
| 1419.11 | VLVHPQWVLTV | 13887 | 11 | Human | Kallikrein | 53 | A | 11 | 1.5 | 16 | 31 | 8889 | 4 |
| 63.0109 | DLMLLRLSEPV | 13888 | 11 | Human | Kallikrein | 120 | A | 69 | 66 | 32 | 118 | 2078 | 4 |
| 1419.17 | PLVCNGVLQGV | 13889 | 11 | Human | Kallikrein | 216 | A | 26 | 126 | 19 | 264 | 4211 | 4 |
| 1586.07 | GLYDGMEHL | 13890 | 9 | Human | MAGE10 | 254 | | 160 | | | | | 1 |
| 1586.08 | GLYDGMEHV | 13891 | 9 | Human | MAGE10 | 254 | A | 155 | | | | | 1 |
| 1586.02 | KVAELVHYL | 13892 | 9 | Human | MAGE3 | 112 | A | 132 | | | | | 1 |
| 1586.03 | KVAEIVHYL | 13893 | 9 | Human | MAGE3 | 112 | A | 119 | | | | | 1 |
| 9016.0059 | LVFGIELMEV | 13894 | 10 | Human | MAGE3 | 160 | | 7.3 | 1.3 | 1.8 | 1.7 | 12 | 5 |
| 1586.05 | GVYDGREHTV | 13895 | 10 | Human | MAGE4 | 230 | | 163 | | | | | 1 |
| 1586.06 | GLYDGREHTV | 13896 | 10 | Human | MAGE4 | 230 | A | 144 | | | | | 1 |
| 1317.29 | RMPEAAPPVV | 13897 | | Human | p53 | 65 | A | 55 | 62 | 6.3 | 259 | — | 4 |
| 1323.17 | RLPEAAPPVV | 13898 | 10 | Human | p53 | 65 | A | 152 | 32 | 18 | 240 | — | 4 |
| 1323.01 | ALPPVAPV | 13899 | 8 | Human | p53 | 69 | A | 346 | 672 | 606 | 789 | 165 | 2 |
| 1323.03 | ALNKMFCQV | 13900 | 9 | Human | p53 | 129 | A | 75 | 172 | 8.2 | 15 | — | 4 |
| 1323.14 | ALNKMFCQLV | 13901 | 10 | Human | p53 | 129 | A | 218 | 298 | 71 | 8273 | — | 3 |
| 1317.19 | KMFBQLAKV | 13902 | 9 | Human | p53 | 132 | A | 138 | 15 | 10 | 35 | 8889 | 4 |
| 1317.27 | KMFCQLAKV | 13903 | 9 | Human | p53 | 132 | A | 36 | 8.6 | 8.2 | 16 | — | 4 |
| 1323.16 | VLVPYEPPEV | 13904 | 10 | Human | p53 | 216 | A | 90 | 408 | 82 | 3270 | — | 3 |
| 1323.07 | CLTIHYNYV | 13905 | 9 | Human | p53 | 229 | A | 270 | 216 | 65 | 1047 | 640 | 3 |
| 1324.17 | KLFCQLAKV | 13906 | 9 | Human | p53/mp53 | 132 | A | 58 | 4.0 | 3.4 | 15 | 1294 | 4 |
| 1323.05 | KLCPVQLWV | 13907 | 9 | Human | p53/mp53 | 139 | A | 121 | 249 | 49 | 23 | — | 4 |
| 1418.24 | VTAKELKFV | 13908 | 9 | Human | PAP | 30 | A | 7143 | 2688 | 40 | 137 | — | 2 |
| 1389.03 | TLMSAMTNV | 13909 | 9 | Human | PAP | 112 | A | 636 | 14 | 35 | 2188 | 484 | 3 |
| 1389.07 | IVYSAHDTTV | 13910 | 10 | Human | PAP | 284 | A | 7643 | 91 | 627 | 356 | 737 | 2 |
| 1418.26 | ITYSAHDTTV | 13911 | 10 | Human | PAP | 284 | A | 4167 | 115 | 238 | 154 | 82 | 4 |
| 1389.06 | ILYSAHDTTV | 13912 | 10 | Human | PAP | 384 | A | 397 | 1.1 | 13 | 1480 | 6285 | 3 |
| 1419.50 | SLSLGFLFV | 13913 | 9 | Human | PAP | | | 77 | 25 | 21 | 93 | — | 4 |
| 1419.52 | SLSLGFLFLV | 13914 | 10 | Human | PAP | | | 3.3 | 3.9 | 17 | 42 | 348 | 5 |
| 1419.58 | LLALFPPEGV | 13915 | 10 | Human | PAP | | | 5.0 | 0.73 | 1.6 | 148 | 163 | 5 |
| 1419.59 | LVALFPPEGV | 13916 | 10 | Human | PAP | | | 156 | 17 | 4.8 | 463 | 28 | 5 |
| 1419.61 | ALFPPEGVSV | 13917 | 10 | Human | PAP | | | 15 | 1.1 | 18 | 119 | 4444 | 4 |
| 1419.62 | GLHGQDLFGV | 13918 | 10 | Human | PAP | | | 12 | 2.3 | 3.1 | 18 | — | 4 |
| 1419.64 | LLPPYASCHV | 13919 | 10 | Human | PAP | | | 88 | 15 | 16 | 97 | 5333 | 4 |

TABLE 188-continued

| Binding affinity of A02 supertype peptides | | | | | | | | | | | | | |
|---|---|---|---|---|---|---|---|---|---|---|---|---|---|
| Peptide | Sequence | SEQ ID NO | AA | Organism | Protein | Position | Analog | A*0201 | A*0202 | A*0203 | A*0206 | A*6802 | Degeneracy |
| 1419.69 | LLWQPIPVHV | 13920 | 10 | Human | PAP | | | 25 | 1.8 | 18 | 285 | 62 | 5 |
| 1389.10 | MLLRLSEPV | 13921 | 9 | Human | PSA | 118 | A | 47 | 29 | 48 | 689 | 433 | 4 |
| 1389.14 | ALGTTCYV | 13922 | 8 | Human | PSA | 143 | A | 93 | 6.7 | 12 | 292 | — | 4 |

— indicates binding affinity >20,000 nM.

TABLE 189

| Binding affinity of A03/11 supertype peptides | | | | | | | | | | | | | |
|---|---|---|---|---|---|---|---|---|---|---|---|---|---|
| Peptide | Sequence | SEQ ID NO | AA | Organism | Protein | Position | Analog | A*0301 | A*1101 | A*3101 | A*3301 | A*6801 | Degeneracy |
| 1525.01 | VTVYYGVPVWR | 13923 | 11 | HIV | Env | 47 | A | 560 | 22 | 19 | 511 | 29 | 3 |
| 1525.02 | VTVYYGVPIWK | 13924 | 11 | HIV | Env | 47 | A | 18 | 2.3 | 150 | 1353 | 5.0 | 4 |
| 1525.03 | VTIYYGVPVWK | 13925 | 11 | HIV | Env | 47 | A | 42 | 2.5 | 534 | — | 28 | 3 |
| 1525.04 | VTIYYGVPVWR | 13926 | 11 | HIV | Env | 47 | A | 920 | 3.0 | 4.0 | 51 | 3.4 | 4 |
| 1525.05 | VTVYYGIPVWR | 13927 | 11 | HIV | Env | 47 | A | 123 | 17 | 3.8 | 4.5 | 3.6 | 5 |
| 1525.06 | ITVYYGVPVWR | 13928 | 11 | HIV | Env | 47 | A | 831 | 76 | 13 | 114 | 5.4 | 4 |
| 1525.07 | VTVYYGVPVRR | 13929 | 11 | HIV | Env | 47 | A | 2323 | 271 | 59 | 795 | 32 | 3 |
| 1525.08 | VTVYDGVPVWR | 13930 | 11 | HIV | Env | 47 | A | 7843 | 246 | 552 | 5718 | 59 | 2 |
| 1539.09 | VTVYDGVPVWK | 13931 | 11 | HIV | Env | 47 | A | 1065 | 19 | 18,318 | — | 362 | 2 |
| F207.02 | RLRPGGKKK | 13932 | 9 | HIV | gag | 17 | | 21 | 11,259 | 415 | 787 | — | 2 |
| 1595.03 | NIGPGRAFY | 13933 | 9 | HIV | gp160 | 310 | | 175 | 691 | 1418 | 4500 | 29 | 2 |
| 1595.04 | KIQNFRVYY | 13934 | 9 | HIV | IN | 219 | | 170 | 22 | 857 | — | 12,942 | 2 |
| 9017.0185 | SSIVGWPAVR | 13935 | 10 | HIV | NEF | 8 | | 3174 | 22 | 26 | 648 | 14 | 3 |
| 9017.0058 | SIVGWPAVR | 13936 | 9 | HIV | NEF | 9 | | 1088 | 632 | 79 | 469 | 21 | 3 |
| 9017.0186 | IVGWPAVRER | 13937 | 10 | HIV | NEF | 11 | | 630 | 1169 | 110 | 1178 | 81 | 2 |
| 9017.0187 | AAEGVGAASR | 13938 | 10 | HIV | NEF | 45 | | — | 478 | 3268 | 5097 | 450 | 2 |
| 9017.0188 | AAEGVGAVSR | 13939 | 10 | HIV | NEF | 45 | | 16,042 | 992 | 2681 | 4117 | 424 | 1 |
| 66.0063 | PVRPQVPLR | 13940 | 9 | HIV | NEF | 95 | | — | 16,112 | 332 | 3439 | 7012 | 1 |
| 9017.0189 | AAFDLSFFLK | 13941 | 10 | HIV | NEF | 105 | | 9.0 | 2.3 | 130 | 2181 | 1.9 | 4 |
| 9017.0190 | AAFDLSHFLK | 13942 | 10 | HIV | NEF | 105 | | 8.7 | 2.0 | 96 | 2553 | 2.5 | 4 |
| 9017.0063 | AFDLSHFLK | 13943 | 9 | HIV | NEF | 106 | | 777 | 46 | 639 | 1435 | 216 | 2 |
| 73.0184 | AVDLSFFLK | 13944 | 9 | HIV | NEF | 111 | A | 226 | 23 | 6207 | — | 4038 | 2 |
| 9017.0192 | EVLMWKFDSR | 13945 | 10 | HIV | NEF | 203 | | — | 7630 | 436 | 62 | 2.8 | 3 |
| 9017.0066 | VLMWKFDSR | 13946 | 9 | HIV | NEF | 204 | | 1427 | 883 | 72 | 63 | 516 | 2 |
| 9017.0193 | SSLARRHMAR | 13947 | 10 | HIV | NEF | 211 | | 1059 | 928 | 4.8 | 190 | 869 | 2 |
| 9017.0067 | SLARRHIAR | 13948 | 9 | HIV | NEF | 212 | | 66 | 1100 | 1.5 | 30 | 621 | 3 |
| 73.0243 | RVPLTFGWCFK | 13949 | 11 | HIV | NEF | 216 | A | 69 | 30 | 102 | — | 571 | 3 |
| 1595.06 | RSLYNTVATLY | 13950 | 11 | HIV | p17 | 76 | | 1085 | 148 | 9272 | — | — | 1 |
| 1516.01 | VTIKIGGQLR | 13951 | 10 | HIV | Pol | 98 | A | 13,755 | 64 | 58 | 6018 | 31 | 3 |
| 1516.02 | VTIKIGGQIK | 13952 | 10 | HIV | Pol | 98 | A | 1110 | 184 | 19,318 | — | 381 | 2 |
| 1516.03 | VTVKIGGELK | 13953 | 10 | HIV | Pol | 98 | A | 4106 | 39 | — | — | 33 | 2 |
| 1516.04 | VTIRVAGQVK | 13954 | 10 | HIV | Pol | 98 | A | 53 | 21 | 4603 | — | 52 | 3 |
| 1516.05 | VTIKIGGQIR | 13955 | 10 | HIV | Pol | 98 | A | 12,996 | 389 | 1145 | — | 46 | 2 |
| 1516.06 | VTVKVGGQLR | 13956 | 10 | HIV | Pol | 98 | A | 8931 | 199 | 503 | 12,672 | 96 | 2 |
| 1516.07 | VTIRVGGQLR | 13957 | 10 | HIV | Pol | 98 | A | 3264 | 17 | 32 | 9435 | 28 | 3 |
| F207.03 | KLVDFRELNK | 13958 | 10 | HIV | pol | | | 23 | 82 | 4977 | 5902 | 3135 | 2 |
| F207.04 | GIPHPAGLK | 13959 | 9 | HIV | pol | | | 19 | 18 | — | 11,072 | 210 | 3 |
| F207.06 | QIYPGIKVR | 13960 | 9 | HIV | pol | | | 99 | 480 | 32 | 571 | 22 | 4 |
| F207.29 | AIFQSSMIK | 13961 | 9 | HIV | pol | | | 18 | 7.0 | 6468 | — | 183 | 3 |
| F207.30 | QIYPGIKVK | 13962 | 9 | HIV | pol | | | 18 | 13 | 2818 | 14,344 | 249 | 3 |
| 9017.0194 | ALLQAVIIK | 13963 | 10 | HIV | REV | 14 | | 86 | 86 | 1270 | — | — | 2 |
| 9017.0068 | LLQAVRIIK | 13964 | 9 | HIV | REV | 15 | | 107 | 326 | 328 | 3022 | 15,869 | 3 |
| 9017.0069 | LLRAVRIIK | 13965 | 9 | HIV | REV | 15 | | 69 | 2028 | 2638 | — | — | 1 |
| 9017.0197 | KTVRLIKFLY | 13966 | 10 | HIV | REV | 17 | | 106 | 235 | 1295 | 6647 | 12,027 | 2 |
| 9017.0198 | ILYQSNPYPK | 13967 | 10 | HIV | REV | 24 | | 8.8 | 14 | 549 | 11,025 | 37 | 3 |
| 9017.0070 | QSNPYPEPK | 13968 | 9 | HIV | REV | 27 | | 1043 | 46 | 513 | — | 868 | 1 |
| 9017.0071 | GTRQARKNR | 13969 | 9 | HIV | REV | 37 | | 1212 | 8349 | 24 | 5067 | — | 1 |
| 9017.0200 | GTRQARKNRR | 13970 | 10 | HIV | REV | 37 | | 1547 | 2925 | 56 | 8367 | 1483 | 1 |
| 73.0369 | KVRRRRWRAR | 13971 | 10 | HIV | REV | 43 | A | 327 | — | 342 | 3243 | 15,501 | 2 |
| 9017.0072 | RILSTYLGR | 13972 | 9 | HIV | REV | 62 | | 7.5 | 7.2 | 1.6 | 404 | 457 | 5 |
| 9017.0073 | RILSTCLGR | 13973 | 9 | HIV | REV | 62 | | 58 | 113 | 8.5 | 1447 | 1446 | 3 |
| F207.11 | ERISLTYLGR | 13974 | 10 | HIV | rev | | | 409 | 114 | 96 | 494 | 721 | 4 |
| 1595.09 | KLNWASQIY | 13975 | 9 | HIV | RT | | | 63 | 950 | — | — | — | 1 |
| 1595.10 | KQNPDIVIY | 13976 | 9 | HIV | RT | | | 3802 | 263 | 4553 | — | — | 1 |
| 9017.0202 | GSQPKTACNK | 13977 | 10 | HIV | TAT | 18 | | 472 | 30 | 1478 | — | 15,822 | 2 |
| 9017.0203 | KTACNNCYCK | 13978 | 10 | HIV | TAT | 22 | | 131 | 21 | 656 | — | 665 | 2 |
| 9017.0204 | KTACNKCYCK | 13979 | 10 | HIV | TAT | 22 | | 301 | 56 | 393 | — | 792 | 3 |
| 9017.0077 | TACNKCYCK | 13980 | 9 | HIV | TAT | 23 | | 17,895 | 345 | 1179 | 4894 | 1926 | 1 |
| 9017.0205 | TACNNCYCKK | 13981 | 10 | HIV | TAT | 23 | | 6208 | 394 | — | — | 2271 | 1 |
| 66.0055 | KTLGISYGR | 13982 | 9 | HIV | TAT | 44 | A | 53 | 9.8 | 21 | 502 | 36 | 4 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 66.0073 | KTLGISYGRK | 13983 | 10 | HIV | TAT | 44 | A | 36 | 79 | 841 | — | 1629 | 2 |
| 66.0090 | KTLGISYGRKK | 13984 | 11 | HIV | TAT | 44 | A | 52 | 285 | 91 | — | 647 | 3 |
| 66.0062 | GTGISYGRK | 13985 | 9 | HIV | TAT | 45 | A | 480 | 77 | — | — | 7407 | 2 |
| 66.0060 | LTISYGRKK | 13986 | 9 | HIV | TAT | 46 | A | 584 | 69 | 13,918 | — | 63 | 2 |
| 9017.0079 | ISYGRKKRR | 13987 | 9 | HIV | TAT | 48 | | 9285 | — | 36 | 1121 | 1363 | 1 |
| 9017.0207 | ISKQPLPQTR | 13988 | 10 | HIV | TAT | 74 | | — | — | 83 | 2582 | 417 | 2 |
| 9017.0082 | ESKKKVESK | 13989 | 9 | HIV | TAT | 92 | | 12,500 | — | — | — | 250 | 1 |
| 9017.0083 | ESKKEVESK | 13990 | 9 | HIV | TAT | 92 | | — | 8037 | — | — | 158 | 1 |
| 73.0333 | KVGPGGYPRR | 13991 | 10 | HIV | TAT | 101 | A | 2268 | 487 | 250 | 7904 | 721 | 2 |
| 73.0334 | KAGPGGYPRK | 13992 | 10 | HIV | TAT | 101 | A | 62 | 43 | 10,734 | — | 5555 | 2 |
| 73.0336 | KVGPGGYPRRK | 13993 | 11 | HIV | TAT | 101 | A | 70 | 87 | 775 | — | 921 | 2 |
| 9017.0212 | OVMIVWQVDR | 13994 | 10 | HIV | VIF | 6 | | 8346 | 103 | 140 | 1055 | 26 | 3 |
| 9017.0213 | MIVWQVDRMR | 13995 | 10 | HIV | VIF | 8 | | 7279 | 4572 | 61 | 267 | 22 | 3 |
| 9017.0084 | IVWQVDRMR | 13996 | 9 | HIV | VIF | 9 | | 1472 | 729 | 23 | 269 | 381 | 3 |
| 9017.0214 | RIRTWNSKVK | 13997 | 10 | HIV | VIF | 17 | | 7.0 | 89 | 71 | — | 15,864 | 3 |
| 9017.0215 | RINTWKSLVK | 13998 | 10 | HIV | VIF | 17 | | 12 | 10 | 632 | — | 11,491 | 2 |
| 9017.0216 | LVKHHMYVSK | 13999 | 10 | HIV | VIF | 24 | | 574 | 184 | 347 | 10,857 | 17 | 3 |
| 9017.0217 | EVHIPLGDAR | 14000 | 10 | HIV | VIF | 54 | | 9390 | 17,803 | 9917 | 344 | 9.5 | 2 |
| 9017.0219 | GQGVSIEWRK | 14001 | 10 | HIV | VIF | 83 | | 15,044 | 142 | 8010 | — | 2214 | 1 |
| 9017.0087 | GVSIEWRQR | 14002 | 9 | HIV | VIF | 85 | | 13,140 | 1224 | 335 | 2089 | 1164 | 1 |
| 9017.0220 | GVSIEWRLRR | 14003 | 10 | HIV | VIF | 85 | | 7779 | 468 | 189 | 1081 | 4420 | 2 |
| 9017.0221 | GVSIEWRKRR | 14004 | 10 | HIV | VIF | 85 | | — | 6317 | 226 | 1683 | 8806 | 1 |
| 9017.0222 | GVSIEQRQRR | 14005 | 10 | HIV | VIF | 85 | | — | 1620 | 130 | 571 | 1419 | 1 |
| 9017.0088 | VSIEWRLRR | 14006 | 9 | HIV | VIF | 86 | | 338 | 6.9 | 3.1 | 29 | 131 | 5 |
| 9017.0089 | VSIEWRQRR | 14007 | 9 | HIV | VIF | 86 | | 1350 | 13 | 1.5 | 7.1 | 41 | 4 |
| 9017.0090 | VSIEWRKRR | 14008 | 9 | HIV | VIF | 86 | | 2654 | 77 | 9.2 | 58 | 156 | 4 |
| 9017.0223 | AIRKAILGHR | 14009 | 10 | HIV | VIF | 120 | | 244 | 12,606 | 25 | 1522 | 7728 | 2 |
| 9017.0092 | KAILGQVVR | 14010 | 9 | HIV | VIF | 123 | | 15,480 | 5337 | 441 | — | 159 | 2 |
| 9017.0224 | AILGHIVIPR | 14011 | 10 | HIV | VIF | 124 | | 31 | 48 | 2.0 | 102 | 42 | 5 |
| 9017.0225 | AILGHIVSPR | 14012 | 10 | HIV | VIF | 124 | | 14 | 122 | 4.6 | 74 | 92 | 5 |
| 9017.0226 | AILGHIVRPR | 14013 | 10 | HIV | VIF | 124 | | 49 | 160 | 7.1 | 240 | 234 | 5 |
| 9017.0093 | ILGNIVIPR | 14014 | 9 | HIV | VIF | 125 | | 22 | 167 | 64 | 83 | 9.2 | 5 |
| 9017.0094 | ILGNIVSPR | 14015 | 9 | HIV | VIF | 125 | | 10 | 1395 | 44 | 126 | 18 | 4 |
| 9017.0095 | ILGNIVRPR | 14016 | 9 | HIV | VIF | 125 | | 32 | 11,376 | 242 | 377 | 160 | 4 |
| 9017.0096 | GSLQYLALK | 14017 | 9 | HIV | VIF | 144 | | 17 | 6.6 | 72 | 14,446 | 10,050 | 3 |
| 66.0057 | KVGSLQYLK | 14018 | 9 | HIV | VIF | 146 | A | 482 | 70 | 2104 | — | 4200 | 2 |
| 9017.0097 | YLALTALIK | 14019 | 9 | HIV | VIF | 148 | | 235 | 3037 | — | — | 5899 | 1 |
| 9017.0227 | LALTALIKPK | 14020 | 10 | HIV | VIF | 149 | | 286 | 34 | 1168 | — | 3480 | 2 |
| 9017.0228 | LALTALITPK | 14021 | 10 | HIV | VIF | 149 | | 88 | 6.6 | 1731 | — | 1085 | 2 |
| 9017.0098 | ALTALIKPK | 14022 | 9 | HIV | VIF | 150 | | 24 | 19 | 2252 | — | 6017 | 2 |
| 9017.0099 | ALTALITPK | 14023 | 9 | HIV | VIF | 150 | | 17 | 16 | 439 | 12,337 | 833 | 3 |
| 9017.0229 | ALTALIKPKK | 14024 | 10 | HIV | VIF | 150 | | 529 | 430 | 901 | — | 2103 | 1 |
| 9017.0230 | ALTALITPKK | 14025 | 10 | HIV | VIF | 150 | | 44 | 6.8 | 7407 | — | 802 | 2 |
| 9017.0100 | LTALIKPKK | 14026 | 9 | HIV | VIF | 151 | | 167 | 71 | 2479 | 1115 | 27 | 3 |
| 9017.0101 | LTALITPKK | 14027 | 9 | HIV | VIF | 151 | | 41 | 4.2 | 4504 | 12,333 | 6.5 | 3 |
| 9017.0231 | LTALIKPKKR | 14028 | 10 | HIV | VIF | 151 | | 6457 | 1810 | 1299 | 8721 | 39 | 1 |
| 9017.0102 | TALIKPKKR | 14029 | 9 | HIV | VIF | 152 | | — | 2726 | 1736 | 774 | 295 | 1 |
| 9017.0234 | KIKPPLPSVR | 14030 | 10 | HIV | VIF | 159 | | 1115 | 6951 | 8.1 | 3435 | 14,670 | 1 |
| 9017.0105 | SVRKLVEDR | 14031 | 9 | HIV | VIF | 166 | | 5099 | 1143 | 15 | 187 | 153 | 3 |
| 9017.0106 | SVRKLTEDR | 14032 | 9 | HIV | VIF | 166 | | 16,753 | 7641 | 48 | 646 | 226 | 2 |
| 9017.0107 | KLVEDRWNK | 14033 | 9 | HIV | VIF | 169 | | 265 | 102 | 61 | — | 17,962 | 3 |
| 9017.0108 | KLTEDRWNK | 14034 | 9 | HIV | VIF | 169 | | 278 | 42 | 55 | — | — | 3 |
| F207.12 | RIRTWKSLVK | 14035 | 10 | HIV | vif | | | 16 | 128 | 173 | — | — | 3 |
| F207.13 | NMYISKKAK | 14036 | 9 | HIV | vif | | | 7.3 | 596 | 95 | 833 | 16,536 | 2 |
| F207.14 | KTKPPLPSVKK | 14037 | 11 | HIV | vif | | | 18 | 64 | 42 | — | 4028 | 3 |
| 9017.0238 | WTLELLEELK | 14038 | 10 | HIV | VPR | 18 | | — | 3842 | 17,231 | — | 169 | 1 |
| 9017.0239 | KQEAVRHFPR | 14039 | 10 | HIV | VPR | 27 | | 9259 | 394 | 9.9 | 575 | 6742 | 2 |
| 9017.0241 | LQQLLFIHFR | 14040 | 10 | HIV | VPR | 64 | | 2492 | 58 | 1.3 | 114 | 81 | 4 |
| 9017.0111 | QQLLFIHFR | 14041 | 9 | HIV | VPR | 65 | | 1795 | 4.8 | 2.0 | 41 | 17 | 4 |
| 9017.0112 | FIHFRIGCR | 14042 | 9 | HIV | VPR | 69 | | 1008 | 7119 | 61 | 13 | 67 | 3 |
| 9017.0242 | HSRIGILRQR | 14043 | 10 | HIV | VPR | 78 | | 637 | 6905 | 9.8 | 418 | 253 | 3 |
| 9017.0113 | RIGILRQRR | 14044 | 9 | HIV | VPR | 80 | | 277 | 1142 | 7.6 | 2316 | 3789 | 2 |
| 9017.0114 | GILRQRRAR | 14045 | 9 | HIV | VPR | 82 | | 1367 | 672 | 177 | 3194 | 1483 | 1 |
| 9017.0115 | AIVVWTIAY | 14046 | 9 | HIV | VPU | 33 | | 121 | 9.2 | 3191 | 5230 | 7185 | 2 |
| 9017.0116 | WTIAYIEYR | 14047 | 9 | HIV | VPU | 37 | | 11,300 | 31 | 97 | 14 | 8.6 | 4 |
| 9017.0117 | WTIVYIEYR | 14048 | 9 | HIV | VPU | 37 | | 10,426 | 1505 | 1923 | 92 | 17 | 2 |
| 9017.0243 | WTIVYIEYRK | 14049 | 10 | HIV | VPU | 37 | | 4886 | 37 | 1349 | 3507 | 0.94 | 2 |
| 9017.0244 | WTIAYIEYRK | 14050 | 10 | HIV | VPU | 37 | | 4654 | 62 | 885 | 493 | 1.2 | 3 |
| 9017.0118 | TIVYIEYRK | 14051 | 9 | HIV | VPU | 38 | | 8833 | 94 | 13,688 | 10,866 | 18 | 2 |
| 9017.0119 | TIAYIEYRK | 14052 | 9 | HIV | VPU | 38 | | 911 | 24 | 3305 | 892 | 7.8 | 2 |
| 9017.0245 | IVFIEYRKIR | 14053 | 10 | HIV | VPU | 39 | | 4369 | 1466 | 12 | 312 | 186 | 3 |
| 9017.0246 | KILRQRKIDR | 14054 | 10 | HIV | VPU | 46 | | 1028 | 5081 | 166 | 3743 | — | 1 |
| 9017.0121 | ILRQRKIDR | 14055 | 9 | HIV | VPU | 47 | | 7828 | — | 7.3 | 26 | — | 2 |
| 9017.0247 | RQRKIDWLIK | 14056 | 10 | HIV | VPU | 49 | | 198 | 101 | 95 | — | — | 3 |
| 9017.0248 | KIDWLIKRIR | 14057 | 10 | HIV | VPU | 52 | | 8653 | 8627 | 19 | 6690 | — | 1 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 9017.0249 | KIDRLIDRIR | 14058 | 10 | HIV | VPU | 52 | | — | — | 351 | — | — | 1 |
| 9017.0122 | WLIKRIRER | 14059 | 9 | HIV | VPU | 55 | | 5158 | — | 85 | 20 | 50 | 3 |
| 9017.0123 | RLIDRIRER | 14060 | 9 | HIV | VPU | 55 | | 36 | 137 | 4.6 | 937 | 227 | 4 |
| 9017.0124 | RLIERIRER | 14061 | 9 | HIV | VPU | 55 | | 57 | 407 | 14 | 1105 | 983 | 3 |
| 9017.0250 | STMVDMGNLR | 14062 | 10 | HIV | VPU | 88 | | 1421 | 8.1 | 11 | 325 | 8.7 | 4 |
| 9017.0125 | TMVDMGNLR | 14063 | 9 | HIV | VPU | 89 | | 1459 | 274 | 63 | 66 | 15 | 4 |
| 1577.23 | KGLGISYGRKK | 14064 | 11 | HIV | | | | 23 | 6210 | 49 | — | — | 2 |
| 1577.25 | GLGISYGRK | 14065 | 9 | HIV | | | | 64 | 2153 | — | — | — | 1 |
| 1577.30 | KGLGISYGR | 14066 | 9 | HIV | | | | 4233 | 415 | 1.4 | — | — | 2 |
| F207.31 | RTRGAHTNDVK | 14067 | 11 | HIV | | | | 44 | 74 | 182 | — | 1301 | 3 |
| F207.32 | RTRGAHTNDVR | 14068 | 11 | HIV | | | | 343 | 712 | 69 | 6686 | 192 | 3 |
| F207.33 | AVFVHNFKRK | 14069 | 10 | HIV | | | | 64 | 17 | 1474 | — | 104 | 3 |
| R207.37 | RISTWKSLVK | 14070 | 10 | HIV | | | | 21 | 62 | 2310 | — | — | 2 |
| F207.39 | RTKPPLPSVTK | 14071 | 11 | HIV | | | | 176 | 84 | 150 | — | 1602 | 3 |
| 86.0124 | GTGCNGWFY | 14072 | 9 | HPV | E1 | 12 | | 11,727 | 196 | — | 18,319 | — | 1 |
| 88.0140 | WFYVQAIVDK | 14073 | 10 | HPV | E1 | 17 | | 196 | 12,889 | — | — | 19,490 | 1 |
| 88.0171 | WFFVETIVEK | 14074 | 10 | HPV | E1 | 17 | | 13,715 | 1480 | 18,327 | 201 | 1215 | 1 |
| 88.0323 | ALFTAQEAK | 14075 | 9 | HPV | E1 | 69 | | 28 | 13 | 2664 | 16,062 | 603 | 2 |
| 88.0141 | AQVLHVLKRK | 14076 | 10 | HPV | E1 | 79 | | 161 | 104 | 3362 | — | 15,782 | 2 |
| 88.0335 | AQVLHVLKR | 14077 | 9 | HPV | E1 | 79 | | 353 | 79 | 296 | 64 | 6533 | 4 |
| 88.0364 | AQVLHLLKR | 14078 | 9 | HPV | E1 | 79 | | 1667 | 285 | 98 | 3776 | 19,473 | 2 |
| 1587.52 | AQVLHLLKRK | 14079 | 10 | HPV | E1 | 79 | | 339 | 308 | 18,204 | — | — | 2 |
| 88.0365 | QVLHLLKRK | 14080 | 9 | HPV | E1 | 80 | | 1547 | 320 | 3640 | 1848 | 801 | 1 |
| 88.0383 | NVCVSWKYK | 14081 | 9 | HPV | E1 | 106 | | 1074 | 927 | 265 | 2460 | 628 | 1 |
| 1587.01 | RLKAICIEK | 14082 | 9 | HPV | E1 | 109 | | 43 | 520 | 20 | — | — | 2 |
| 88.0325 | KQSRAAKRR | 14083 | 9 | HPV | E1 | 117 | | 1050 | 18,752 | 325 | 512 | 1121 | 1 |
| 88.0128 | TQQMLQVEGR | 14084 | 10 | HPV | E1 | 141 | | — | 2996 | 354 | 1847 | 739 | 1 |
| 88.0374 | TQQLQDLFK | 14085 | 9 | HPV | E1 | 178 | | 1700 | 53 | — | 1996 | 6677 | 1 |
| 88.0375 | NLQGKLYYK | 14086 | 9 | HPV | E1 | 189 | | 277 | 55 | 363 | 9.4 | 98 | 5 |
| 88.0184 | LQGKLYYKFK | 14087 | 10 | HPV | E1 | 190 | | 724 | 130 | 3710 | 16,223 | — | 1 |
| 1587.02 | LTNILNVLK | 14088 | 9 | HPV | E1 | 191 | | 221 | 4.6 | 210 | 2025 | 12 | 4 |
| 88.0358 | NTKANILYK | 14089 | 9 | HPV | E1 | 195 | | 2124 | 142 | 2417 | 693 | 100 | 2 |
| 88.0385 | NTKATLLYK | 14090 | 9 | HPV | E1 | 195 | | 396 | 109 | 3824 | 168 | 186 | 4 |
| 88.0369 | KTTVLFKFK | 14091 | 9 | HPV | E1 | 200 | | 31 | 20 | 36 | 1396 | 874 | 3 |
| 88.0142 | KQGAMLAVFK | 14092 | 10 | HPV | E1 | 210 | | 35 | 11 | 519 | — | 235 | 3 |
| 88.0163 | SFMELVRPFK | 14093 | 10 | HPV | E1 | 211 | | 2018 | 199 | 7.7 | 3.3 | 1393 | 3 |
| 1587.03 | SFSELVRPFK | 14094 | 10 | HPV | E1 | 218 | | 4245 | 551 | 2.0 | 24 | 5338 | 2 |
| 88.0143 | SFTDLVRNFK | 14095 | 10 | HPV | E1 | 225 | | 1594 | 244 | 47 | 56 | 22 | 4 |
| 88.0153 | KTLLQPYCLY | 14096 | 10 | HPV | E1 | 232 | | 180 | 405 | 4279 | 19,598 | — | 2 |
| 88.0130 | KTLLQQYCLY | 14097 | 10 | HPV | E1 | 252 | | 206 | 134 | 2920 | 14,416 | 7029 | 2 |
| 1587.29 | MVMLMLVREK | 14098 | 10 | HPV | E1 | 253 | | 16 | 16 | 41 | 175 | 13 | 5 |
| 1587.30 | MLVRFKCAK | 14099 | 9 | HPV | E1 | 257 | | 151 | 187 | 85 | 983 | 864 | 3 |
| 88.0376 | GVIVMMLIR | 14100 | 9 | HPV | E1 | 259 | | 2380 | 434 | 3460 | 214 | 2773 | 2 |
| 88.0377 | MLIRYTCGK | 14101 | 9 | HPV | E1 | 264 | | 34 | 14 | 1220 | 526 | 15 | 3 |
| 88.0386 | ILLLLIRFK | 14102 | 9 | HPV | E1 | 267 | | 120 | 1880 | 48 | 402 | 2501 | 3 |
| 1587.31 | ITIEKLLEK | 14103 | 9 | HPV | E1 | 268 | | 115 | 14 | 313 | 10,981 | 16 | 4 |
| 88.0164 | LLLIRFRCSK | 14104 | 10 | HPV | E1 | 269 | | 205 | 6976 | 1713 | — | 732 | 1 |
| 88.0191 | LLLIRFKCSK | 14105 | 10 | HPV | E1 | 269 | | 284 | 3523 | 749 | 17,431 | 879 | 1 |
| 88.0359 | LLRFRCSK | 14106 | 9 | HPV | E1 | 270 | | 192 | 41 | 245 | 576 | 1145 | 3 |
| 88.0178 | LLLRFKCGK | 14107 | 10 | HPV | E1 | 272 | | 198 | 6310 | 2187 | 7097 | 356 | 2 |
| 1587.04 | MVVLLLVRYK | 14108 | 10 | HPV | E1 | 273 | | 2629 | 1032 | 118 | 4484 | 720 | 1 |
| 1587.05 | VVLLLVRYK | 14109 | 9 | HPV | E1 | 274 | | 13 | 21 | 1.2 | 21 | 540 | 4 |
| 88.0338 | GVLILALLR | 14110 | 9 | HPV | E1 | 279 | | 2877 | 56 | 2304 | 3887 | 943 | 1 |
| 88.0144 | VLILALLRYK | 14111 | 10 | HPV | E1 | 280 | | 52 | 266 | 285 | 1190 | 2182 | 3 |
| 88.0339 | ALLRKCGK | 14112 | 9 | HPV | E1 | 284 | | 100 | 125 | 343 | 4346 | 4601 | 3 |
| 88.0378 | EQMLIQPPK | 14113 | 9 | HPV | E1 | 290 | | 15,279 | 79 | — | 831 | 732 | 1 |
| 1587.32 | STAAALYWYR | 14114 | 10 | HPV | E1 | 294 | | 89 | 4.0 | 2.4 | 28 | 4.1 | 5 |
| 88.0360 | MVIEPPKLR | 14115 | 9 | HPV | E1 | 298 | | — | 271 | 729 | 118 | 13 | 3 |
| 88.0366 | MLIEPPKLR | 14116 | 9 | HPV | E1 | 298 | | 15,447 | 2877 | 3156 | 150 | 12 | 2 |
| 88.0165 | SQTCALYWFR | 14117 | 10 | HPV | E1 | 307 | | 4846 | 1835 | 227 | 260 | 1159 | 2 |
| 88.0192 | SQACALYWFR | 14118 | 10 | HPV | E1 | 307 | | 4658 | 174 | 42 | 212 | 85 | 4 |
| 88.0361 | QTCALYWFR | 14119 | 9 | HPV | E1 | 308 | | 1963 | 64 | 51 | 19 | 18 | 4 |
| 88.0371 | ATCALYWYR | 14120 | 9 | HPV | E1 | 311 | | 211 | 18 | 19 | 15 | 120 | 5 |
| 88.0340 | MLIQPPKLR | 14121 | 9 | HPV | E1 | 312 | | 16,220 | 2321 | 699 | 146 | 25 | 2 |
| 86.0126 | STAAALYWY | 14122 | 9 | HPV | E1 | 314 | | 689 | 17 | — | — | 320 | 2 |
| 1587.06 | STAAALYWYK | 14123 | 10 | HPV | E1 | 314 | | 4.5 | 1.6 | 35 | 138 | 5.9 | 5 |
| 86.0130 | SSVAALYWY | 14124 | 9 | HPV | E1 | 321 | | — | 470 | — | — | 3772 | 1 |
| 88.0341 | SVAALYWYR | 14125 | 9 | HPV | E1 | 322 | | 32 | 4.5 | 3.7 | 0.87 | 4.1 | 5 |
| 1587.33 | DSNACAFLK | 14126 | 9 | HPV | E1 | 366 | | 1425 | 303 | 1129 | 39 | 68 | 3 |
| 88.0379 | DSNAQAFLK | 14127 | 9 | HPV | E1 | 373 | | — | 1274 | — | 20 | 39 | 2 |
| 88.0387 | NSNAAAFLR | 14128 | 9 | HPV | E1 | 379 | | — | 213 | 158 | 50 | 20 | 4 |
| 1587.07 | NSNASAFLK | 14129 | 9 | HPV | E1 | 386 | | 426 | 13 | 3403 | 269 | 27 | 4 |
| 1587.34 | GTMCRHYKR | 14130 | 9 | HPV | E1 | 386 | | 611 | 31 | 20 | 226 | 56 | 4 |
| 88.0342 | NSNAAAFLK | 14131 | 9 | HPV | E1 | 393 | | 955 | 19 | 2636 | 665 | 22 | 2 |
| 1587.35 | RQMSMGQWIK | 14132 | 10 | HPV | E1 | 398 | | 53 | 6.0 | 48 | — | 2228 | 3 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 88.0388 | GVMCRHYKR | 14133 | 9 | HPV | E1 | 399 | | 2889 | 80 | 37 | 114 | 93 | 4 |
| 1587.53 | AVMCRHYKR | 14134 | 9 | HPV | E1 | 399 | | 213 | 31 | 14 | 59 | 25 | 5 |
| 88.0134 | IVKDCATMCR | 14135 | 10 | HPV | E1 | 401 | | 17,765 | 18,794 | 272 | 1737 | 838 | 1 |
| 88.0186 | QQMNMCQWIK | 14136 | 10 | HPV | E1 | 405 | | 346 | 20 | 261 | 13,142 | 197 | 4 |
| 1587.08 | ATMCRHYKR | 14137 | 9 | HPV | E1 | 406 | | 90 | 28 | 10 | 42 | 60 | 5 |
| 1587.54 | RQMNMSQWIK | 14138 | 10 | HPV | E1 | 411 | | 18 | 7.5 | 41 | — | 3106 | 3 |
| 88.0343 | ATMCKHYRR | 14139 | 9 | HPV | E1 | 413 | | 221 | 19 | 23 | 74 | 55 | 5 |
| 88.0166 | GQWIQSRCEK | 14140 | 10 | HPV | E1 | 416 | | 320 | 261 | 626 | 4919 | — | 2 |
| 88.0174 | SQWIKYRCSK | 14141 | 10 | HPV | E1 | 416 | | 944 | 156 | 323 | 3399 | — | 2 |
| 1587.09 | KQMSMSQWIK | 14142 | 10 | HPV | E1 | 418 | | 49 | 17 | 50 | 11,429 | 3789 | 3 |
| 88.0380 | KTDEGGDWK | 14143 | 9 | HPV | E1 | 419 | | 3630 | 407 | — | 13,111 | 9892 | 1 |
| 88.0136 | SQWIKYRCDR | 14144 | 10 | HPV | E1 | 423 | | 19,130 | 10,969 | 418 | 2708 | — | 1 |
| 88.0147 | SQWIRFRCSK | 14145 | 10 | HPV | E1 | 430 | | 415 | 130 | 373 | 3770 | 11,750 | 3 |
| 1587.36 | EFVSFLSALK | 14146 | 10 | HPV | E1 | 432 | | 1289 | 181 | 11,594 | 17 | 22 | 3 |
| 1587.37 | FVSFLSALK | 14147 | 9 | HPV | E1 | 433 | | 111 | 8.8 | 4375 | 3786 | 13 | 3 |
| 1587.38 | FLSALKLFLK | 14148 | 10 | HPV | E1 | 436 | | 715 | 165 | 984 | 2594 | 1561 | 1 |
| 1587.39 | LSALKLFLK | 14149 | 9 | HPV | E1 | 437 | | 957 | 31 | 96 | 1818 | 2211 | 3 |
| 88.0188 | DFISFLSYFK | 14150 | 10 | HPV | E1 | 439 | | 175 | 30 | 2629 | 5.7 | 1.5 | 4 |
| 88.0330 | KQIVMFLRY | 14151 | 9 | HPV | E1 | 440 | | 138 | 97 | 4391 | 6403 | 2257 | 2 |
| 1587.40 | KLFLKGVPKK | 14152 | 10 | HPV | E1 | 441 | | 16 | 85 | 1036 | — | — | 2 |
| 1587.41 | KLFLKGVPK | 14153 | 9 | HPV | E1 | 441 | | 16 | 17 | 1.5 | 9684 | — | 3 |
| 1587.55 | GVEFISFLR | 14154 | 9 | HPV | E1 | 443 | | — | 440 | 124 | 314 | 48 | 4 |
| 88.0167 | EFTAFLGAFK | 14155 | 10 | HPV | E1 | 445 | | 4665 | 293 | — | 35 | 197 | 3 |
| 88.0193 | EFTAFLVAFK | 14156 | 10 | HPV | E1 | 445 | | 7483 | 1406 | 13,774 | 127 | 980 | 1 |
| 88.0168 | FTAFLGAFKK | 14157 | 10 | HPV | E1 | 446 | | 1902 | 25 | — | 17,735 | 20 | 2 |
| 88.0362 | FTAFLGAFK | 14158 | 9 | HPV | E1 | 446 | | 31 | 3.8 | 833 | 71 | 5.4 | 4 |
| 88.0389 | FTAFLVAFK | 14159 | 9 | HPV | E1 | 446 | | 45 | 15 | 663 | 76 | 23 | 4 |
| 88.0179 | EFTAFLDAFK | 14160 | 10 | HPV | E1 | 448 | | 5794 | 968 | 16,517 | 14 | 127 | 2 |
| 88.0381 | KLFLQGTPK | 14161 | 9 | HPV | E1 | 448 | | 15 | 12 | 51 | — | 703 | 3 |
| 88.0169 | FLGAFKKFLK | 14162 | 10 | HPV | E1 | 449 | | 3.3 | 9.6 | 11 | 112 | 275 | 5 |
| 1587.10 | EFMSFLTALK | 14163 | 10 | HPV | E1 | 452 | | 477 | 683 | 5962 | 21 | 20 | 3 |
| 88.0194 | KQFLQGVPLL | 14164 | 10 | HPV | E1 | 454 | | 172 | 34 | 209 | — | — | 3 |
| 88.0390 | KQFLQGVPK | 14165 | 9 | HPV | E1 | 454 | | 32 | 17 | 44 | 5182 | 15,334 | 3 |
| 1587.11 | MSFLTALKR | 14166 | 9 | HPV | E1 | 454 | | 106 | 26 | 49 | 119 | 2.4 | 5 |
| 88.0189 | VLCGPPNTGK | 14167 | 10 | HPV | E1 | 461 | | 141 | 220 | 370 | — | 12,303 | 3 |
| 88.0148 | FLGALKSFLK | 14168 | 10 | HPV | E1 | 463 | | 27 | 120 | 327 | 2313 | 1391 | 3 |
| 88.0195 | LLCGPANTGK | 14169 | 10 | HPV | E1 | 467 | | 137 | 134 | 3646 | — | 1898 | 2 |
| 1587.56 | LLYGPANTGK | 14170 | 10 | HPV | E1 | 467 | | 14 | 8.8 | 6302 | 14,529 | 44 | 3 |
| 88.0149 | KSFLKGTPKK | 14171 | 10 | HPV | E1 | 468 | | 48 | 89 | 572 | — | — | 2 |
| 88.0344 | KSFLKGTPK | 14172 | 9 | HPV | E1 | 468 | | 16 | 23 | 22 | 16,134 | 1911 | 3 |
| 88.0180 | VLYGPANTGK | 14173 | 10 | HPV | E1 | 470 | | 9.8 | 25 | 1935 | 5267 | 175 | 3 |
| 88.0190 | KSCFAMSLIK | 14174 | 10 | HPV | E1 | 470 | | 57 | 17 | 311 | — | 12,226 | 3 |
| 1587.12 | LLYGAANTGK | 14175 | 10 | HPV | E1 | 474 | | 3.3 | 16 | 6720 | — | 76 | 3 |
| 88.0150 | VFCGPANTGK | 14176 | 10 | HPV | E1 | 481 | | 1948 | 1664 | 485 | 811 | 2996 | 1 |
| 1587.13 | KSLFGMSLMK | 14177 | 10 | HPV | E1 | 483 | | 4.4 | 1.5 | 271 | — | 1062 | 3 |
| 1587.14 | SLRIGMSLMK | 14178 | 9 | HPV | E1 | 484 | | 1.5 | 1.3 | 624 | 16,502 | 56 | 3 |
| 1587.15 | SVICFVNSK | 14179 | 9 | HPV | E1 | 497 | | 109 | 3.5 | 1906 | 2847 | 8.6 | 3 |
| 88.0346 | WTYFDTYMR | 14180 | 9 | HPV | E1 | 536 | | — | 293 | 332 | 95 | 3.8 | 4 |
| 88.0372 | NTNAGTDPR | 14181 | 9 | HPV | E1 | 563 | | 1120 | 1017 | 7017 | 418 | 50 | 2 |
| 88.0162 | TFPNPFPFDK | 14182 | 10 | HPV | E1 | 567 | | 2417 | 221 | 2264 | 1827 | 1108 | 1 |
| 88.0347 | LTTNIHPAK | 14183 | 9 | HPV | E1 | 571 | | 44 | 18 | 231 | 575 | 16 | 4 |
| 88.0176 | TFPHAFPFDK | 14184 | 10 | HPV | E1 | 580 | | 1412 | 154 | 4958 | — | 200 | 2 |
| 1587.42 | SFFSRTWCR | 14185 | 9 | HPV | E1 | 591 | | 2379 | 155 | 2.2 | 3.5 | 28 | 4 |
| 88.0382 | CFFTRTWSR | 14186 | 9 | HPV | E1 | 598 | | 13,453 | 1489 | 4.3 | 3.0 | 52 | 3 |
| 88.0170 | KSFFSRTWCK | 14187 | 10 | HPV | E1 | 603 | | 7.9 | 12 | 5.4 | 22 | 219 | 5 |
| 88.0363 | SFFSRTWCK | 14188 | 9 | HPV | E1 | 604 | | 172 | 16 | 12 | 4.0 | 66 | 5 |
| 1587.16 | SFFSRTWSR | 14189 | 9 | HPV | E1 | 611 | | 1142 | 26 | 0.29 | 0.59 | 3.6 | 4 |
| 88.0348 | CFFEFTWSR | 14190 | 9 | HPV | E1 | 618 | | — | 1245 | 8.6 | 2.9 | 24 | 3 |
| 88.0373 | GTFKCSAGK | 14191 | 9 | HPV | E1 | 632 | | 23 | 14 | 617 | 18,240 | 81 | 3 |
| 88.0205 | SQRLNVCQDK | 14192 | 10 | HPV | E2 | 5 | | 1869 | 222 | 13,426 | — | — | 1 |
| 1589.34 | SQRLNACQNK | 14193 | 10 | HPV | E2 | 5 | | 2698 | 424 | 5957 | — | — | 1 |
| 88.0212 | DLPSQIEHWK | 14194 | 10 | HPV | E2 | 25 | | — | — | — | — | 25 | 1 |
| 88.0235 | DLTSQIEIIWK | 14195 | 10 | HPV | E2 | 25 | | 18,132 | 70 | — | 8967 | 29 | 2 |
| 1589.11 | RLCDHIDYWK | 14196 | 10 | HPV | E2 | 25 | | 457 | 444 | 1627 | — | 17,116 | 2 |
| 88.0439 | LTSQIEHWK | 14197 | 9 | HPV | E2 | 26 | | 4936 | 14 | 8876 | — | 24 | 2 |
| 88.0213 | SQIEHWKLIR | 14198 | 10 | HPV | E2 | 28 | | 16,598 | 86 | 515 | — | 1326 | 1 |
| 88.0226 | AQIEHWKLTR | 14199 | 10 | HPV | E2 | 28 | | 2068 | 63 | 293 | — | 2905 | 2 |
| 88.0199 | SQIQYWQLIR | 14200 | 10 | HPV | E2 | 32 | | 2308 | 84 | 219 | 7540 | 952 | 2 |
| 88.0220 | SQISYWQLIR | 14201 | 10 | HPV | E2 | 34 | | 2611 | 94 | 239 | — | 934 | 2 |
| 1589.01 | RLECAIYYK | 14202 | 9 | HPV | E2 | 37 | | 55 | 30 | 150 | 6549 | 7015 | 3 |
| 1589.12 | RLECVLMYK | 14203 | 9 | HPV | E2 | 37 | | 8.7 | 21 | 44 | 828 | 3633 | 3 |
| 1589.13 | QVVPALSVSK | 14204 | 10 | HPV | E2 | 57 | | 825 | 25 | 8916 | — | 12 | 2 |
| 88.0432 | MVPCLQVCK | 14205 | 9 | HPV | E2 | 58 | | 1463 | 332 | 7314 | 11,761 | 83 | 2 |
| 1589.14 | VVPALSVSK | 14206 | 9 | HPV | E2 | 58 | | 515 | 33 | — | — | 133 | 2 |
| 1589.06 | QVVPAYNISK | 14207 | 10 | HPV | E2 | 61 | | 326 | 15 | 6665 | — | 7.6 | 3 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 88.0397 | VVPAYNISK | 14208 | 9 | HPV | E2 | 62 | | 69 | 14 | — | — | 992 | 2 |
| 1589.23 | QVVPPINISK | 14209 | 10 | HPV | E2 | 63 | | 1277 | 11 | 1558 | — | 14 | 2 |
| 88.0214 | LQMALETLSK | 14210 | 10 | HPV | E2 | 75 | | 559 | 22 | 10,636 | — | 13,756 | 1 |
| 88.0227 | LQLALEALNK | 14211 | 10 | HPV | E2 | 75 | | 1103 | 21 | 3632 | — | — | 1 |
| 88.0424 | QLALEALNK | 14212 | 9 | HPV | E2 | 76 | | 166 | 155 | — | — | 1293 | 2 |
| 1589.39 | ETLNASPYK | 14213 | 9 | HPV | E2 | 80 | | 163 | 27 | — | 4713 | 28 | 3 |
| 88.0398 | ALQGLAQSR | 14214 | 9 | HPV | E2 | 82 | | 3972 | 2756 | 311 | — | 11,336 | 1 |
| 88.0201 | LQGLAQSRYK | 14215 | 10 | HPV | E2 | 83 | | 1097 | 262 | 4007 | — | — | 1 |
| 88.0416 | ALKGLAQSK | 14216 | 9 | HPV | E2 | 84 | | 65 | 1660 | 2931 | — | — | 1 |
| 88.0228 | LQQTSLEMWR | 14217 | 10 | HPV | E2 | 94 | | 13,062 | 445 | 306 | — | 2926 | 2 |
| 88.0236 | WLSEPQKCFK | 14218 | 10 | HPV | E2 | 102 | | 1689 | 1942 | 2340 | 617 | 202 | 1 |
| 1589.15 | YLTAPTGCLK | 14219 | 10 | HPV | E2 | 102 | | 149 | 573 | — | — | 2563 | 1 |
| 88.0216 | VTVQYDNDKK | 14220 | 10 | HPV | E2 | 117 | | 18,225 | 100 | — | — | 1153 | 1 |
| 88.0202 | TVQVYFDGNK | 14221 | 10 | HPV | E2 | 120 | | 1106 | 14 | 4620 | 15,609 | 121 | 2 |
| 88.0399 | VQVYFDGNK | 14222 | 9 | HPV | E2 | 121 | | 2054 | 182 | — | — | 15,681 | 1 |
| 1589.24 | TVHVYFDGNK | 14223 | 10 | HPV | E2 | 122 | | 707 | 61 | — | — | 97 | 2 |
| 88.0425 | NTMDYTNWK | 14224 | 9 | HPV | E2 | 127 | | 1596 | 19 | — | 3533 | 13 | 2 |
| 1589.16 | NTMHYTNWK | 14225 | 9 | HPV | E2 | 127 | | 1021 | 11 | 4921 | 402 | 11 | 3 |
| 88.0233 | MQYVAWKYIY | 14226 | 10 | HPV | E2 | 129 | | 1894 | 52 | — | — | 12,086 | 1 |
| 1589.07 | MTYVAWDSVY | 14227 | 10 | HPV | E2 | 133 | | 616 | 892 | 19,447 | — | 73 | 1 |
| 88.0400 | MTDAGTWDK | 14228 | 9 | HPV | E2 | 144 | | 1576 | 12 | — | — | 28 | 2 |
| 1589.35 | KVCSGVDYR | 14229 | 9 | HPV | E2 | 147 | | — | 5172 | 171 | 5780 | 13,594 | 1 |
| 88.0209 | GQVNCKGIYY | 14230 | 10 | HPV | E2 | 150 | | 1016 | 168 | 2763 | — | — | 1 |
| 1589.02 | GQVDYYGLYY | 14231 | 10 | HPV | E2 | 150 | | 156 | 53 | 5404 | — | — | 2 |
| 86.0150 | KVDYIGMYY | 14232 | 9 | HPV | E2 | 151 | | 317 | 156 | — | — | — | 2 |
| 88.0408 | QVNCKGIYY | 14233 | 9 | HPV | E2 | 151 | | 379 | 1619 | — | — | — | 1 |
| 88.0229 | GLYYWCDGEK | 14234 | 10 | HPV | E2 | 156 | | 107 | 24 | 5104 | — | 10,048 | 2 |
| 88.0401 | CVSHRGLYY | 14235 | 9 | HPV | E2 | 156 | | 27 | 1211 | — | — | — | 1 |
| 1589.40 | GLYYIHGNEK | 14236 | 10 | HPV | E2 | 156 | | 17 | 18 | 141 | 4514 | 24118 | 3 |
| 88.0409 | YVHEGEITY | 14237 | 9 | HPV | E2 | 159 | | 791 | 136 | 3124 | — | 262 | 2 |
| 1589.25 | VSYWGVYYIK | 14238 | 10 | HPV | E2 | 159 | | 109 | 3.0 | 3183 | 11,489 | 24 | 3 |
| 88.0419 | VQFKSECEK | 14239 | 9 | HPV | E2 | 176 | | 181 | 20 | 2678 | 4767 | — | 2 |
| 88.0441 | STTETADPK | 14240 | 9 | HPV | E2 | 205 | | 1538 | 17 | 3584 | — | 74 | 2 |
| 1589.17 | ISFAGIVTK | 14241 | 9 | HPV | E2 | 205 | | 33 | 9.5 | 119 | 4366 | 31 | 4 |
| 88.0230 | AVHLCTETSK | 14242 | 10 | HPV | E2 | 210 | | 1271 | 87 | 12,257 | — | 10,456 | 1 |
| 1589.08 | TVSATQLVK | 14243 | 9 | HPV | E2 | 211 | | 6.5 | 4.4 | 14,579 | — | 31 | 3 |
| 1589.36 | TVNEYNTHK | 14244 | 9 | HPV | E2 | 212 | | 83 | 20 | 4119 | 2730 | 49 | 3 |
| 1589.26 | TVSATQIVR | 14245 | 9 | HPV | E2 | 213 | | 2535 | 183 | 213 | 645 | 14 | 3 |
| 88.0204 | KQLQHTPSPY | 14246 | 10 | HPV | E2 | 219 | | 117 | 1538 | — | — | — | 1 |
| 88.0224 | LQHASTSTPK | 14247 | 10 | HPV | E2 | 223 | | 19 | 20 | 5825 | — | 14,286 | 2 |
| 1589.09 | STVSVGTAK | 14248 | 9 | HPV | E2 | 230 | | 34 | 6.0 | 1760 | 16,034 | 9.9 | 3 |
| 1589.27 | KTASVGTPK | 14249 | 9 | HPV | E2 | 232 | | 11 | 13 | 44 | — | 8.5 | 4 |
| 88.0210 | GVRRATTSTK | 14250 | 10 | HPV | E2 | 235 | | 6.1 | 664 | 3629 | — | 18,304 | 1 |
| 1589.20 | ATNCTNKQR | 14251 | 9 | HPV | E2 | 258 | | 1829 | 156 | 51 | 13,016 | 139 | 3 |
| 1589.41 | TTNCTYKGR | 14252 | 9 | HPV | E2 | 263 | | — | 2206 | 58 | 165 | 38 | 3 |
| 1589.03 | ILTAFNSSHK | 14253 | 10 | HPV | E2 | 267 | | 12 | 1788 | 5270 | — | 6393 | 1 |
| 88.0394 | AFNSSHKGR | 14254 | 9 | HPV | E2 | 270 | | — | — | 55 | 368 | — | 2 |
| 1589.21 | NVAPIVHLK | 14255 | 9 | HPV | E2 | 272 | | 6381 | 394 | — | — | 2.4 | 2 |
| 1589.42 | KVSPIVHLK | 14256 | 9 | HPV | E2 | 277 | | 21 | 30 | 6.0 | — | 25 | 4 |
| 88.0217 | SLKCLRYRLK | 14257 | 10 | HPV | E2 | 285 | | 74 | 1207 | 2694 | 18,818 | 12,623 | 1 |
| 1589.30 | CTAPUHLK | 14258 | 9 | HPV | E2 | 286 | | 13 | 3.5 | 286 | 662 | 4.3 | 4 |
| 1589.37 | KTTPVVHLK | 14259 | 9 | HPV | E2 | 290 | | 28 | 22 | 28 | — | 33 | 4 |
| 1589.18 | ATTPIIHLK | 14260 | 9 | HPV | E2 | 291 | | 9.7 | 7.6 | 49 | 11,153 | 6.7 | 4 |
| 88.0198 | TLKCLRYREK | 14261 | 10 | HPV | E2 | 297 | | 33 | 894 | 286 | 1085 | 8367 | 2 |
| 1589.22 | STWHWTSDNK | 14262 | 10 | HPV | E2 | 305 | | 161 | 17 | 2179 | — | 18 | 3 |
| 1589.43 | STWHWTSDDK | 14263 | 10 | HPV | E2 | 310 | | 342 | 47 | 5299 | — | 153 | 3 |
| 1589.28 | STWHWTGCNK | 14264 | 10 | HPV | E2 | 322 | | 72 | 15 | 160 | 1896 | 32 | 4 |
| 1589.31 | TSNECTNNK | 14265 | 9 | HPV | E2 | 324 | | 4787 | 116 | 8912 | — | 125 | 2 |
| 88.0219 | QQQMFLGTVK | 14266 | 10 | HPV | E2 | 330 | | 1019 | 13 | 44211 | — | 1464 | 1 |
| 88.0415 | QQMFLGTVK | 14267 | 9 | HPV | E2 | 331 | | 2044 | 22 | 7169 | — | 1583 | 1 |
| 88.0428 | KLGIVTITY | 14268 | 9 | HPV | E2 | 332 | | 65 | 3426 | — | — | — | 1 |
| 88.0437 | YSHTHYK | 14269 | 9 | HPV | E2 | 335 | | 2165 | 29 | 3932 | — | 108 | 2 |
| 1589.04 | LTYDSEWQR | 14270 | 9 | HPV | E2 | 335 | | 888 | 35 | 314 | 541 | 14 | 3 |
| 1589.10 | VTYHSETQR | 14271 | 9 | HPV | E2 | 335 | | 29 | 22 | 66 | 181 | 32 | 5 |
| 1589.44 | RQLFLNTVK | 14272 | 9 | HPV | E2 | 336 | | 175 | 39 | 87 | — | 16,249 | 3 |
| 88.0429 | ITYSDETQR | 14273 | 9 | HPV | E2 | 338 | | 2959 | 165 | 879 | 1348 | 26 | 2 |
| 1589.29 | VTYNSEVQR | 14274 | 9 | HPV | E2 | 338 | | 71 | 25 | 40 | 152 | 23 | 5 |
| 88.0211 | TLTYISTSQR | 14275 | 10 | HPV | E2 | 341 | | 3754 | 8268 | 688 | 1006 | 56 | 1 |
| 1589.19 | LTYISTSQR | 14276 | 9 | HPV | E2 | 342 | | 14 | 112 | 39 | 79 | 0.76 | 5 |
| 1589.32 | ETQRQQFLK | 14277 | 9 | HPV | E2 | 343 | | 1012 | 28 | 3922 | 80 | 30 | 3 |
| 1589.05 | FLSQVKIPK | 14278 | 9 | HPV | E2 | 346 | | 86 | 22 | 72 | 158 | 48 | 5 |
| 1589.33 | RQQFLKTVK | 14279 | 9 | HPV | E2 | 346 | | 1318 | 162 | 45 | 2515 | — | 2 |
| 1589.38 | VVYRLVWDK | 14280 | 9 | HPV | E2 | 359 | | 63 | 13 | 989 | 3784 | 1165 | 2 |
| 86.0011 | RFEDPTRRPYK | 14281 | 11 | HPV | E6 | 3 | | 169 | 432 | 53 | 1758 | 7338 | 3 |
| 86.0005 | RTAMFQDPQER | 14282 | 11 | HPV | E6 | 5 | | 1478 | 103 | 49 | 3459 | 19 | 3 |

TABLE 189-continued

| Binding affinity of A03/11 supertype peptides | | | | | | | | | | | | | |
|---|---|---|---|---|---|---|---|---|---|---|---|---|---|
| Peptide | Sequence | SEQ ID NO | AA | Organism | Protein | Position | Ana-log | A*0301 | A*1101 | A*3101 | A*3301 | A*6801 | Degen-eracy |
| 78.0270 | AMFQDPQER | 14283 | 9 | HPV | E6 | 7 | | 736 | 268 | 63 | 7253 | 403 | 3 |
| 88.0273 | RTQCVQCKK | 14284 | 9 | HPV | E6 | 27 | A | 234 | 20 | 127 | 8147 | 3066 | 3 |
| 78.0288 | VSIACVYCK | 14285 | 9 | HPV | E6 | 28 | | 2694 | 296 | 13,241 | — | 2353 | 1 |
| 88.0262 | VSIACVYCR | 14286 | 9 | HPV | E6 | 28 | A | 3236 | 143 | 42 | 1347 | 185 | 3 |
| 78.0295 | RLSCVYCKK | 14287 | 9 | HPV | E6 | 30 | | 153 | 378 | 1066 | — | 7535 | 2 |
| 78.0047 | LTWVFEFAFK | 14288 | 10 | HPV | E6 | 41 | | 8672 | 71 | — | — | 27 | 2 |
| 78.0062 | RTEVYQFAFK | 14289 | 10 | HPV | E6 | 41 | | 285 | 111 | 1691 | 9180 | 3310 | 2 |
| 1521.05 | RTEVYQFAFR | 14290 | 10 | HPV | E6 | 41 | A | 755 | 211 | 8.4 | 696 | 439 | 3 |
| 88.0293 | YFVFADLR | 14291 | 9 | HPV | E6 | 43 | A | 3633 | 8.1 | 20 | 6.6 | 2.9 | 4 |
| 78.0103 | FAFTDLTIVY | 14292 | 10 | HPV | E6 | 45 | | — | — | — | — | 346 | 1 |
| 78.0115 | FAFADLTVVY | 14293 | 10 | HPV | E6 | 45 | | 18,592 | 5866 | — | — | 402 | 1 |
| 86.0018 | FLFTDLRIVYR | 14294 | 11 | HPV | E6 | 45 | | 672 | 227 | 58 | 21 | 1.4 | 4 |
| 1550.08 | FTDLRIVYR | 14295 | 9 | HPV | E6 | 45 | | 2942 | 10,466 | 65 | 9.7 | 158 | 3 |
| 78.0052 | AFTDLTIVYR | 14296 | 10 | HPV | E6 | 46 | | — | 331 | 810 | 817 | 210 | 2 |
| 78.0058 | AFADLTVVYR | 14297 | 10 | HPV | E6 | 46 | | — | 5093 | 140 | 249 | 39 | 3 |
| 78.0073 | VFADLRIVYR | 14298 | 10 | HPV | E6 | 46 | | — | 2089 | 31 | 52 | 197 | 3 |
| 88.0039 | ATTDLTIVYR | 14299 | 10 | HPV | E6 | 46 | A | 247 | 10 | 34 | 1739 | 14 | 4 |
| 88.0055 | AVADLTVVYR | 14300 | 10 | HPV | E6 | 46 | A | 489 | 11 | 31 | 892 | 7.3 | 4 |
| 88.0084 | LFTDLRIVYK | 14301 | 10 | HPV | E6 | 46 | A | 628 | 263 | 258 | 149 | 277 | 4 |
| 88.0105 | VVADLRIVYR | 14302 | 10 | HPV | E6 | 46 | A | 513 | 18 | 41 | 101 | 16 | 4 |
| 78.0313 | FTDLTIVYR | 14303 | 9 | HPV | E6 | 47 | | — | 2662 | 602 | 585 | 28 | 1 |
| 78.0318 | FADLTVVYR | 14304 | 9 | HPV | E6 | 47 | | 19,181 | 9024 | 1784 | 310 | 39 | 2 |
| 88.0023 | AVKDLFVVYR | 14305 | 10 | HPV | E6 | 48 | A | 1728 | 91 | 3.1 | 9.1 | 3.3 | 4 |
| 88.0073 | AVKDLCIVYR | 14306 | 10 | HPV | E6 | 48 | A | 841 | 66 | 7.3 | 8.0 | 6.5 | 4 |
| 78.0334 | CTELKLVYR | 14307 | 9 | HPV | E6 | 50 | | — | — | 64 | 153 | 1332 | 2 |
| 78.0292 | IVYRDNNPY | 14308 | 9 | HPV | E6 | 52 | | 106 | 18 | — | — | 33 | 3 |
| 78.0079 | AFRDLCIVYR | 14309 | 10 | HPV | E6 | 53 | | 3106 | 4377 | 13 | 41 | 600 | 2 |
| 88.0001 | ATRDLCIVYR | 14310 | 10 | HPV | E6 | 53 | A | 237 | 156 | 4.7 | 44 | 28 | 5 |
| 88.0002 | AFRDLCIVYK | 14311 | 10 | HPV | E6 | 53 | A | 31 | 15 | 10 | 132 | 57 | 5 |
| 88.0026 | FVVYRDSIPK | 14312 | 10 | HPV | E6 | 53 | A | 265 | 81 | 6216 | 146 | 10 | 4 |
| 78.0275 | VVYRDSIPH | 14313 | 9 | HPV | E6 | 54 | | 401 | 178 | — | — | — | 2 |
| 88.0266 | IVYRDCIAR | 14314 | 9 | HPV | E6 | 54 | A | 465 | 106 | 27 | 325 | 64 | 5 |
| 88.0280 | LVYRDDFPK | 14315 | 9 | HPV | E6 | 55 | A | 317 | 13 | 3009 | 1970 | 110 | 3 |
| 1581.04 | LVYRDDFPY | 14316 | 9 | HPV | E6 | 55 | | 7381 | 58 | — | — | 11,315 | 1 |
| 78.0272 | IVYRDGNPY | 14317 | 9 | HPV | E6 | 59 | | 76 | 251 | — | — | 3756 | 2 |
| 88.0246 | SIPHAACHR | 14318 | 9 | HPV | E6 | 59 | A | 1053 | 352 | 236 | 253 | 181 | 4 |
| 78.0048 | AACHKCIDFY | 14319 | 10 | HPV | E6 | 63 | | 18,824 | 261 | — | — | — | 1 |
| 88.0076 | AACHKCIDFK | 14320 | 10 | HPV | E6 | 63 | A | 118 | 20 | 437 | — | 414 | 4 |
| 88.0086 | CIMCLRFLSR | 14321 | 10 | HPV | E6 | 63 | A | 41 | 101 | 167 | 83 | 155 | 5 |
| 78.0068 | AVCRVCLLFY | 14322 | 10 | HPV | E6 | 64 | | 77 | 21 | 1978 | 4520 | 1302 | 2 |
| 78.0302 | KVCLRLLSK | 14323 | 9 | HPV | E6 | 64 | | 288 | 230 | 525 | — | — | 2 |
| 88.0094 | AVCRVCLLFR | 14324 | 10 | HPV | E6 | 64 | A | 20 | 1.8 | 2.1 | 64 | 21 | 5 |
| 1571.12 | IMCLRFLSK | 14325 | 9 | HPV | E6 | 64 | | 11 | 1672 | 2299 | 2616 | 12,867 | 1 |
| 1571.20 | KLCLRFLSK | 14326 | 9 | HPV | E6 | 64 | | 18 | 279 | 271 | — | — | 3 |
| 88.0281 | RFCLLFYSK | 14327 | 9 | HPV | E6 | 67 | A | 1156 | 484 | 83 | 450 | 232 | 4 |
| 78.0043 | AVCDKCLKFY | 14328 | 10 | HPV | E6 | 68 | | 561 | 83 | 1959 | — | 3323 | 1 |
| 78.0107 | RFYSKSEFR | 14329 | 10 | HPV | E6 | 68 | | 1382 | 17,885 | 54 | 204 | 250 | 3 |
| 88.0004 | AVCDKCLKFR | 14330 | 10 | HPV | E6 | 68 | A | 77 | 15 | 11 | 45 | 34 | 5 |
| 88.0041 | RLYSKVSEFR | 14331 | 10 | HPV | E6 | 68 | A | 6.4 | 131 | 24 | 690 | 73 | 4 |
| 88.0057 | RVLSKISEYR | 14332 | 10 | HPV | E6 | 68 | A | 34 | 84 | 24 | 197 | 136 | 5 |
| 88.0087 | RLLSKISEYR | 14333 | 10 | HPV | E6 | 68 | A | 5.2 | 662 | 7.7 | 108 | 21 | 4 |
| 88.0107 | RTLSKISEYR | 14334 | 10 | HPV | E6 | 68 | A | 77 | 100 | 52 | 189 | 133 | 5 |
| 1571.13 | RFLSKISEYR | 14335 | 10 | HPV | E6 | 68 | | 1803 | 5563 | 14 | 20 | 17 | 3 |
| 88.0095 | CFLFYSKVRK | 14336 | 10 | HPV | E6 | 69 | A | 125 | 96 | 81 | 315 | 172 | 5 |
| 78.0298 | LLFYSKVRK | 14337 | 9 | HPV | E6 | 70 | | 3.9 | 13 | 395 | 799 | 23 | 4 |
| 86.0024 | LLFYSKVRKYR | 14338 | 11 | HPV | E6 | 70 | | 28 | 94 | 7.0 | 11 | 15 | 5 |
| 88.0097 | LVYSKVRKYR | 14339 | 10 | HPV | E6 | 71 | A | 320 | 619 | 17 | 49 | 31 | 4 |
| 78.0053 | KVSEFRWYRY | 14340 | 10 | HPV | E6 | 72 | | 248 | 24 | 11 | 7073 | 1908 | 3 |
| 78.0074 | KISEYRHYNY | 14341 | 10 | HPV | E6 | 72 | | 197 | 136 | 1759 | — | 10,323 | 2 |
| 78.0281 | KVSEFRWYR | 14342 | 9 | HPV | E6 | 72 | | 43 | 15 | 10 | 32 | 23 | 5 |
| 88.0044 | KVSEFRWYRR | 14343 | 10 | HPV | E6 | 72 | A | 266 | 16 | 2.8 | 159 | 30 | 5 |
| 88.0060 | KISEYRHYNR | 14344 | 10 | HPV | E6 | 72 | A | 58 | 140 | 17 | 161 | 1579 | 4 |
| 88.0110 | KISEYRHYNK | 14345 | 10 | HPV | E6 | 72 | A | 29 | 18 | 397 | — | 15,565 | 3 |
| 1571.14 | KISEYRHYQY | 14346 | 10 | HPV | E6 | 72 | | 291 | 392 | 7218 | — | 11,736 | 2 |
| 78.0081 | KFYSKISEYR | 14347 | 10 | HPV | E6 | 75 | | 1684 | 18,047 | 48 | 79 | 264 | 3 |
| 88.0005 | KLYSKISEYR | 14348 | 10 | HPV | E6 | 75 | A | 5.4 | 168 | 6.4 | 28 | 91 | 5 |
| 78.0082 | KISEYRHYCY | 14349 | 10 | HPV | E6 | 79 | | 152 | 163 | 4847 | 2348 | 2004 | 2 |
| 78.0054 | YSVYGTTLEK | 14350 | 10 | HPV | E6 | 81 | | 357 | 100 | — | — | 36 | 3 |
| 78.0142 | SLYGKTLEER | 14351 | 10 | HPV | E6 | 82 | | 56 | 1728 | 435 | 5499 | 178 | 3 |
| 78.0282 | SVYGTTLEK | 14352 | 9 | HPV | E6 | 82 | | 19 | 3.8 | 8875 | — | 15 | 3 |
| 88.0090 | SLYGKTLEEK | 14353 | 10 | HPV | E6 | 82 | A | 7.9 | 6.8 | 1044 | 6516 | 29 | 3 |
| 88.0252 | SVYGTTLER | 14354 | 9 | HPV | E6 | 82 | A | 28 | 6.4 | 133 | 454 | 21 | 5 |
| 88.0032 | DSVYGDTLER | 14355 | 10 | HPV | E6 | 83 | A | 292 | 23 | 485 | 891 | 28 | 4 |
| 78.0277 | SVYGDTLEK | 14356 | 9 | HPV | E6 | 84 | | 72 | 14 | — | — | 17 | 3 |
| 78.0291 | SVYGETLEK | 14357 | 9 | HPV | E6 | 84 | | 347 | 166 | — | — | 2622 | 2 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 88.0270 | SVYGETLER | 14358 | 9 | HPV | E6 | 84 | A | 44 | 11 | 235 | 160 | 17 | 5 |
| 78.0283 | TTLEKLTNK | 14359 | 9 | HPV | E6 | 86 | | 262 | 42 | 598 | 469 | 2555 | 3 |
| 78.0294 | KTLEERVKK | 14360 | 9 | HPV | E6 | 86 | | 302 | 160 | 261 | — | — | 3 |
| 78.0300 | ATLESITKK | 14361 | 9 | HPV | E6 | 89 | | 56 | 18 | 3195 | — | 1948 | 2 |
| 78.0044 | GTTLEQQYNK | 14362 | 10 | HPV | E6 | 92 | | 10,850 | 69 | — | — | 3935 | 1 |
| 78.0273 | TTLEQQYNK | 14363 | 9 | HPV | E6 | 93 | | 816 | 26 | 862 | 1353 | 203 | 2 |
| 88.0289 | KVLCDLLIR | 14364 | 9 | HPV | E6 | 97 | A | 363 | 169 | 66 | 5896 | 9053 | 3 |
| 1513.14 | KQLCDLLIR | 14365 | 9 | HPV | E6 | 97 | | 1607 | 1676 | 24 | 6900 | — | 1 |
| 78.0117 | ILIRCIICQR | 14366 | 10 | HPV | E6 | 99 | | 8550 | 5012 | 377 | 2480 | 537 | 1 |
| 88.0049 | LVIRCITCQR | 14367 | 10 | HPV | E6 | 99 | A | 2222 | 255 | 54 | 135 | 14 | 4 |
| 88.0050 | LLIRCITCQK | 14368 | 10 | HPV | E6 | 99 | A | 291 | 120 | 3009 | 2165 | 40 | 3 |
| 88.0061 | ITIRCIICQR | 14369 | 10 | HPV | E6 | 99 | A | 488 | 93 | 50 | 123 | 12 | 5 |
| 78.0320 | LIRCIICQR | 14370 | 9 | HPV | E6 | 100 | | 2200 | 1289 | 386 | 336 | 993 | 2 |
| 88.0297 | LVRCIICQR | 14371 | 9 | HPV | E6 | 100 | A | 677 | 358 | 59 | 109 | 201 | 4 |
| 88.0298 | LIRCIICQR | 14372 | 9 | HPV | E6 | 100 | A | 445 | 252 | 639 | 834 | 285 | 3 |
| 78.0066 | LLIRCLRCQK | 14373 | 10 | HPV | E6 | 101 | | 270 | 226 | 2496 | 11,367 | 44 | 3 |
| 88.0079 | LSIRCLRCQK | 14374 | 10 | HPV | E6 | 101 | A | 245 | 14 | 100 | 1135 | 17 | 4 |
| 78.0045 | LLIRCINCQK | 14375 | 10 | HPV | E6 | 106 | | 296 | 49 | 556 | 5375 | 32 | 3 |
| 78.0097 | RFHNIAGHYR | 14376 | 10 | HPV | E6 | 126 | | 2463 | 2855 | 11 | 99 | 151 | 3 |
| 88.0036 | RFHNIAGHYK | 14377 | 10 | HPV | E6 | 126 | A | 25 | 22 | 2.6 | 80 | 23 | 5 |
| 88.0278 | NIMGRWTGK | 14378 | 9 | HPV | E6 | 127 | A | 52 | 54 | 3274 | 86 | 173 | 4 |
| 78.0083 | KQRFHNIRGR | 14379 | 10 | HPV | E6 | 129 | | 2037 | 11,596 | 178 | 4441 | 10,279 | 1 |
| 88.0011 | KVRFHNIRGR | 14380 | 10 | HPV | E6 | 129 | A | 39 | 8632 | 27 | 4500 | 3979 | 2 |
| 78.0056 | WTGRCIACWR | 14381 | 10 | HPV | E6 | 132 | | 2260 | 1035 | 179 | 17 | 31 | 3 |
| 88.0052 | WTGRGCIACWK | 14382 | 10 | HPV | E6 | 132 | A | 2633 | 55 | 3078 | 169 | 24 | 3 |
| 78.0321 | AGRCAACWR | 14383 | 9 | HPV | E6 | 133 | | — | — | 366 | 6049 | — | 1 |
| 78.0331 | RCSECWRPR | 14384 | 9 | HPV | E6 | 135 | | — | — | 526 | 521 | 439 | 1 |
| 88.0037 | RTQCHSCCNR | 14385 | 10 | HPV | E6 | 135 | A | 338 | 20 | 22 | 132 | 161 | 5 |
| 88.0053 | RTIACWRRPR | 14386 | 10 | HPV | E6 | 135 | A | 40 | 63 | 3.2 | 95 | 51 | 5 |
| 88.0299 | RVAVCWRPR | 14387 | 9 | HPV | E6 | 135 | A | 5.3 | 8.5 | 7.0 | 102 | 33 | 5 |
| 78.0322 | AACWRSRRR | 14388 | 9 | HPV | E6 | 137 | | 5603 | 18,788 | 407 | 17,506 | — | 1 |
| 88.0260 | AACWRSRRK | 14389 | 9 | HPV | E6 | 137 | A | 75 | 770 | 3022 | — | 12,877 | 1 |
| 88.0302 | AVCWRPRRK | 14390 | 9 | HPV | E6 | 137 | A | 34 | 101 | 263 | 7950 | 1810 | 3 |
| 78.0086 | MSCCRSSRTR | 14391 | 10 | HPV | E6 | 144 | | 571 | 829 | 324 | 1142 | 26 | 2 |
| 78.0311 | RARQERLQR | 14392 | 9 | HPV | E6 | 144 | | 18,461 | — | 350 | — | — | 1 |
| 88.0016 | MSCCRSSRTK | 14393 | 10 | HPV | E6 | 144 | A | 352 | 169 | 2333 | 6916 | 12 | 3 |
| 88.0243 | SVCRSSRTR | 14394 | 9 | HPV | E6 | 145 | A | 323 | 97 | 249 | 547 | 17 | 4 |
| 78.0278 | ATLQDIVLH | 14395 | 9 | HPV | E7 | 6 | | 4511 | 152 | 15,374 | — | — | 1 |
| 88.0304 | ATLQDIVLK | 14396 | 9 | HPV | E7 | 6 | A | 37 | 8.6 | 65 | 17,121 | 3231 | 3 |
| 78.0316 | VIDSPAGQA | 14397 | 9 | HPV | E7 | 37 | | 13,039 | 9433 | 407 | 913 | 983 | 1 |
| 88.0306 | GVNHQHLPK | 14398 | 9 | HPV | E7 | 43 | A | 26 | 7.7 | 353 | 15,615 | 1192 | 3 |
| 88.0313 | VVHAQLPAR | 14399 | 9 | HPV | E7 | 45 | A | 423 | 127 | 3.4 | 12 | 201 | 5 |
| 78.0023 | ATSNYYIVTY | 14400 | 10 | HPV | E7 | 50 | | 2437 | 162 | — | — | — | 1 |
| 88.0119 | NVVTFCCQCK | 14401 | 10 | HPV | E7 | 53 | A | 790 | 303 | 4757 | 87 | 13 | 3 |
| 88.0320 | KQHTCYLIR | 14402 | 9 | HPV | E7 | 54 | A | 135 | 213 | 13 | 2275 | 12,177 | 3 |
| 86.0026 | TFCCKCDSTLR | 14403 | 11 | HPV | E7 | 56 | | — | 8043 | 332 | 91 | 260 | 3 |
| 88.0308 | HTMLCMCCR | 14404 | 9 | HPV | E7 | 59 | A | 405 | 92 | 11 | 14 | 24 | 5 |
| 78.0265 | 'TLRLCIHST | 14405 | 9 | HPV | E7 | 66 | | 1644 | 235 | 5656 | 8957 | 1594 | 1 |
| 78.0301 | VQLDIQSTK | 14406 | 9 | HPV | E7 | 72 | | 2182 | 216 | 6859 | — | — | 1 |
| 88.0321 | VTLDIQSTK | 14407 | 9 | HPV | E7 | 72 | A | 78 | 13 | 2046 | 1954 | 237 | 3 |
| 78.0338 | VVQQLLMGA | 14408 | 9 | HPV | E7 | 85 | | — | — | 2829 | 438 | 1440 | 1 |
| 78.0046 | GIVCPICSQK | 14409 | 10 | HPV | E7 | 88 | | 2758 | 75 | — | — | 2714 | 1 |
| 86.0031 | TLQVVCPGCAR | 14410 | 11 | HPV | E7 | 88 | | — | 1395 | 67 | 63 | 147 | 3 |
| 88.0115 | GLVCPICSQK | 14411 | 10 | HPV | E7 | 88 | A | 428 | 814 | +13 | — | 3568 | 1 |
| 78.0274 | IVCPICSQK | 14412 | 9 | HPV | E7 | 89 | | 636 | 274 | 6491 | — | 3658 | 1 |
| 88.0310 | LSFVCPWCR | 14413 | 9 | HPV | E7 | 94 | A | — | 200 | 47 | 231 | 152 | 4 |
| 1556.02 | TFWNPPTTAR | 14414 | 10 | Human | CEA | 26 | A | 18,115 | 1502 | 57 | 40 | 29 | 3 |
| 1556.03 | TVWNPPTTAK | 14415 | 10 | Human | CEA | 26 | A | 25 | 26 | 9189 | 1580 | 106 | 3 |
| 1556.04 | TLWNPPTTAK | 14416 | 10 | Human | CEA | 26 | A | 22 | 107 | 6828 | 2243 | 438 | 3 |
| 76.0146 | KLFGYSWYK | 14417 | 9 | Human | CEA | 61 | A | 11 | 7.3 | 7.3 | 3720 | 16 | 4 |
| 76.0153 | HLYGYSWYK | 14418 | 9 | Human | CEA | 61 | A | 12 | 11 | 48 | 61 | 16 | 5 |
| 76.0164 | HLFTYSWYK | 14419 | 9 | Human | CEA | 61 | A | 4.9 | 7.7 | 35 | 137 | 19 | 5 |
| 76.0165 | HLFDYSWYK | 14420 | 9 | Human | CEA | 61 | A | 4.1 | 0.99 | 36 | 61 | 2.1 | 5 |
| 76.0168 | HLFWYSWYK | 14421 | 9 | Human | CEA | 61 | A | 6.4 | 5.3 | 28 | 39 | 3.4 | 5 |
| 76.0171 | HLFRYSWYK | 14422 | 9 | Human | CEA | 61 | A | 21 | 16 | 62 | 83 | 27 | 5 |
| 76.0190 | HLFGYSFYK | 14423 | 9 | Human | CEA | 61 | A | 5.4 | 2.4 | 27 | 33 | 2.4 | 5 |
| 76.0191 | HLFGYSYYK | 14424 | 9 | Human | CEA | 61 | A | 11 | 2.7 | 1796 | 3472 | 14 | 3 |
| 1556.07 | TTITVYAEPPR | 14425 | 11 | Human | CEA | 314 | A | — | 1189 | 577 | 2548 | 20 | 1 |
| 1556.10 | TVYAEPPR | 14426 | 8 | Human | CEA | 317 | A | 3638 | 1377 | 8407 | 11,816 | 21 | 1 |
| 1556.11 | TTYAEPPK | 14427 | 8 | Human | CEA | 317 | A | 1712 | 227 | — | — | 320 | 2 |
| 1556.12 | TLYAEPPK | 14428 | 8 | Human | CEA | 317 | A | 734 | 269 | — | — | 1978 | 1 |
| 1556.13 | RTLTLLSVTK | 14429 | 10 | Human | CEA | 376 | A | 23 | 15 | 111 | 6765 | 219 | 4 |
| 1556.16 | TVTVSAELPK | 14430 | 10 | Human | CEA | 493 | A | 3433 | 125 | — | — | 267 | 2 |
| 1556.18 | ITVSAELPR | 14431 | 9 | Human | CEA | 494 | A | — | 739 | 6927 | 8714 | 25 | 1 |
| 1556.19 | IVVSAELPK | 14432 | 9 | Human | CEA | 494 | A | 248 | 93 | — | — | 218 | 3 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 1556.20 | ILVASELPK | 14433 | 9 | Human | CEA | 494 | A | 226 | 177 | 18,065 | — | 2730 | 2 |
| 1556.22 | TVSAELPR | 14434 | 8 | Human | CEA | 495 | A | — | 1883 | 11,456 | 10,112 | 214 | 1 |
| 1556.23 | TTSAELPK | 14435 | 8 | Human | CEA | 495 | A | 19,352 | 221 | — | — | 1403 | 1 |
| 1556.24 | TLSAELPK | 14436 | 8 | Human | CEA | 495 | A | 2247 | 102 | — | — | — | 1 |
| 9012.0217 | QTRSLTEILK | 14437 | 10 | Human | Her2/neu | 141 | A | 250 | 96 | 3168 | 19,840 | 297 | 3 |
| 9012.0218 | QQRSLTEILK | 14438 | 10 | Human | Her2/neu | 141 | A | 520 | 93 | 1251 | — | 18,525 | 1 |
| 9012.0221 | LVYQDTILWK | 14439 | 10 | Human | Her2/neu | 161 | A | 199 | 32 | — | — | 155 | 3 |
| 9012.0223 | TILWKDIFHR | 14440 | 10 | Human | Her2/neu | 166 | A | 1972 | 10 | 33 | 11 | 26 | 4 |
| 9012.0201 | ILWKDIFHR | 14441 | 9 | Human | Her2/neu | 167 | A | 181 | 217 | 6.4 | 4.8 | 235 | 5 |
| 9012.0225 | RTVCAGGCAK | 14442 | 10 | Human | Her2/neu | 217 | A | 25 | 13 | 70 | 2247 | 1161 | 3 |
| 9012.0226 | RVVCAGGCAR | 14443 | 10 | Human | Her2/neu | 217 | A | 1636 | 690 | 88 | 176 | 1240 | 2 |
| 9012.0227 | RLVCAGGCAR | 14444 | 10 | Human | Her2/neu | 217 | A | 1072 | 5858 | 290 | 73 | 14,230 | 2 |
| 9012.0203 | TVCAGGCAK | 14445 | 9 | Human | Her2/neu | 218 | A | 172 | 22 | 694 | 668 | 230 | 3 |
| 9012.0231 | SVFQNLQVIK | 14446 | 10 | Human | Her2/neu | 423 | A | 217 | 11 | 3558 | 6223 | 16 | 3 |
| 9012.0232 | SFFQNLQVIR | 14447 | 10 | Human | Her2/neu | 423 | A | 3795 | 3988 | 432 | 702 | 1404 | 1 |
| 9012.0234 | ISWLGLRSLK | 14448 | 10 | Human | Her2/neu | 450 | A | 31 | 18 | 265 | 2496 | 39 | 4 |
| 9012.0235 | HTVPWQLFK | 14449 | 10 | Human | Her2/neu | 478 | A | 222 | 17 | 2809 | — | 17 | 3 |
| 9012.0236 | HLVPWDQLFR | 14450 | 10 | Human | Her2/neu | 478 | A | 278 | 1531 | 308 | 247 | 21 | 4 |
| 9012.0204 | CVNCSQFLK | 14451 | 9 | Human | Her2/neu | 528 | A | 410 | 62 | 2982 | 1121 | 196 | 3 |
| 9012.0238 | RVLQGLPREK | 14452 | 10 | Human | Her2/neu | 545 | A | 38 | 35 | 88 | — | 14,415 | 3 |
| 9012.0240 | CTARCPSGVK | 14453 | 10 | Human | Her2/neu | 596 | A | 463 | 586 | — | 10,160 | 2056 | 1 |
| 9012.0242 | GVVFGILIKK | 14454 | 10 | Human | Her2/neu | 668 | A | 484 | 17 | — | — | 146 | 3 |
| 9012.0243 | GTVFGILIKR | 14455 | 10 | Human | Her2/neu | 668 | A | 2560 | 27 | 46 | 3135 | 18 | 3 |
| 9012.0244 | GLVFGILIKR | 14456 | 10 | Human | Her2/neu | 668 | A | 3510 | 489 | 2110 | 2635 | 183 | 2 |
| 9012.0246 | VVFGILIKRK | 14457 | 10 | Human | Her2/neu | 669 | A | 54 | 13 | 2598 | 10,142 | 139 | 3 |
| 9012.0206 | IVIKRRQQK | 14458 | 9 | Human | Her2/neu | 673 | A | 198 | 154 | 712 | 9114 | 3295 | 2 |
| 9012.0207 | IQIKRRQQK | 14459 | 9 | Human | Her2/neu | 673 | A | 29 | 20 | 393 | — | — | 3 |
| 9012.0248 | RLLKETELRK | 14460 | 10 | Human | Her2/neu | 713 | A | 27 | 52 | 7014 | — | 12,777 | 2 |
| 9012.0249 | RQLKETELRK | 14461 | 10 | Human | Her2/neu | 713 | A | 167 | 149 | — | 12,588 | — | 2 |
| 9012.0209 | IVKETELRK | 14462 | 9 | Human | Her2/neu | 714 | A | 1606 | 156 | — | — | 1733 | 1 |
| 9012.0253 | YVMAGVGSPK | 14463 | 10 | Human | Her2/neu | 772 | A | 25 | 13 | 5729 | 219 | 18 | 4 |
| 9012.0211 | QLVTQLMPK | 14464 | 9 | Human | Her2/neu | 795 | A | 88 | 79 | — | 15,747 | 2259 | 2 |
| 9012.0213 | LTARNVLVK | 14465 | 9 | Human | Her2/neu | 846 | A | 23 | 12 | — | — | 52 | 3 |
| 9012.0255 | VVVKSPNHVK | 14466 | 10 | Human | Her2/neu | 851 | A | 256 | 88 | 7703 | — | 320 | 3 |
| 9012.0214 | MALESILRK | 14467 | 9 | Human | Her2/neu | 889 | A | 216 | 13 | — | 5475 | 433 | 3 |
| 9012.0215 | MTLESILRR | 14468 | 9 | Human | Her2/neu | 889 | A | 287 | 14 | 243 | 94 | 15 | 5 |
| 9012.0257 | TVDVYMIMVK | 14469 | 10 | Human | Her2/neu | 948 | A | 11,146 | 95 | — | — | 308 | 2 |
| 9012.0258 | TLDVYMIMVK | 14470 | 10 | Human | Her2/neu | 948 | A | 1564 | 17 | 12,405 | — | 2025 | 1 |
| 1556.25 | KTYQGSYGFR | 14471 | 10 | Human | p53 | 101 | | 7.9 | 8.2 | 11 | 954 | 15 | 4 |
| 1556.26 | YGFRLGFLH | 14472 | 9 | Human | p53 | 107 | | 1383 | 19 | 3246 | 9907 | 1545 | 1 |
| 1556.27 | YGFRLGFLK | 14473 | 9 | Human | p53 | 107 | A | 41 | 1.0 | 224 | 839 | 16 | 4 |
| 1556.28 | YVFRLGFH | 14474 | 9 | Human | p53 | 107 | A | 17 | 1.4 | 718 | 1165 | 2.4 | 3 |
| 1556.29 | GTAKSVTCTY | 14475 | 10 | Human | p53 | 117 | | 363 | 170 | — | — | 15,162 | 2 |
| 1556.30 | GTAKSTCTK | 14476 | 10 | Human | p53 | 117 | A | 25 | 7.5 | 840 | 5151 | 134 | 3 |
| 1556.31 | GTAKSVTCTR | 14477 | 10 | Human | p53 | 117 | A | 960 | 98 | 214 | 168 | 208 | 4 |
| 1556.33 | VTVTYSPALNK | 14478 | 11 | Human | p53 | 122 | | 236 | 66 | 4955 | — | 1634 | 2 |
| 1556.34 | VTCTYSPALNR | 14479 | 11 | Human | p53 | 122 | A | 289 | 26 | 57 | 108 | 106 | 5 |
| 1556.35 | VVCTYSPALNK | 14480 | 11 | Human | p53 | 122 | A | 370 | 104 | 5189 | — | 10,304 | 2 |
| 1556.36 | VLCTYSPALNK | 14481 | 11 | Human | p53 | 122 | A | 133 | 150 | 4805 | — | 14,686 | 2 |
| 1556.38 | TCTYSPALNK | 14482 | 10 | Human | p53 | 123 | | 781 | 174 | — | — | 34511 | 1 |
| 1556.40 | TVTYSPALNK | 14483 | 10 | Human | p53 | 123 | A | 112 | 11 | — | — | 165 | 3 |
| 1556.41 | TTTYSPALNK | 14484 | 10 | Human | p53 | 123 | A | 102 | 2.5 | — | — | 18 | 3 |
| 1556.42 | CTYSPALNR | 14485 | 9 | Human | p53 | 124 | A | 27 | 9.6 | 17 | 8.6 | 19 | 5 |
| 1556.43 | CFYSPALNK | 14486 | 9 | Human | p53 | 124 | A | 127 | 74 | 185 | 122 | 1449 | 4 |
| 1556.44 | ALNKMECQLAK | 14487 | 11 | Human | p53 | 129 | | 46 | 104 | 2197 | — | — | 2 |
| 1556.45 | ALNKMFCQLAK | 14488 | 11 | Human | p53 | 129 | A | 1028 | 3133 | 145 | 2020 | 18,920 | 1 |
| 1556.46 | AVNKMFCQLAK | 14489 | 11 | Human | p53 | 129 | A | 55 | 10 | 284 | — | 1312 | 3 |
| 1556.47 | ATNKMFCQLAK | 14490 | 11 | Human | p53 | 129 | A | 29 | 7.3 | 160 | — | 1625 | 3 |
| 1556.49 | LNKMFCQLAR | 14491 | 10 | Human | p53 | 130 | A | 11,093 | 8882 | 2175 | 149 | 1804 | 1 |
| 1556.50 | LVKMFCQLAK | 14492 | 10 | Human | p53 | 130 | A | 1198 | 189 | 3335 | 15,335 | 221 | 2 |
| 1556.51 | LTKMFCQLAK | 14493 | 10 | Human | p53 | 130 | A | 940 | 103 | 2377 | 12,567 | 173 | 2 |
| 1556.52 | KMFCQLAK | 14494 | 8 | Human | p53 | 132 | | 37 | 22 | 410 | — | 1285 | 3 |
| 1556.53 | KMFCQLAR | 14495 | 8 | Human | p53 | 132 | A | 22 | 85 | 35 | 1372 | 249 | 4 |
| 1556.54 | KFFCALAK | 14496 | 8 | Human | p53 | 132 | A | 358 | 224 | 1566 | 19,987 | 3449 | 2 |
| 1556.58 | GLAPPQHLIR | 14497 | 10 | Human | p53 | 187 | | 178 | 16 | 47 | 72 | 172 | 5 |
| 1556.59 | SSCMGGMNR | 14498 | 9 | Human | p53 | 240 | | 206 | 16 | 54 | 39 | 110 | 5 |
| 1556.60 | SVCMGGMNR | 14499 | 9 | Human | p53 | 240 | A | 157 | 17 | 92 | 78 | 134 | 5 |
| 1556.61 | STCMGGMNR | 14500 | 9 | Human | p53 | 240 | A | 281 | 1101 | 157 | 17,917 | 1632 | 2 |
| 1556.62 | RVCACPGRDRR | 14501 | 11 | Human | p53 | 273 | | 26 | 19 | 307 | — | 1220 | 3 |
| 1556.63 | RVCACPGRDRK | 14502 | 11 | Human | p53 | 273 | A | 207 | 160 | 43 | 9863 | 198 | 4 |
| 1556.64 | RTCACPGRDRR | 14503 | 11 | Human | p53 | 273 | A | 150 | 7970 | 132 | 10,233 | — | 2 |
| 1556.65 | RLCACPGRDRR | 14504 | 11 | Human | p53 | 273 | A | 126 | 110 | 38 | 6175 | 190 | 4 |
| 1556.66 | RVCACPGRDR | 14505 | 10 | Human | p53 | 273 | | 267 | 273 | — | 1006 | 161 | 3 |
| 1556.68 | ETNEALELK | 14506 | 9 | Human | p53 | 343 | A | 16,836 | 93 | — | 10,328 | 1443 | 1 |
| 1556.69 | EQNEALELK | 14507 | 9 | Human | p53 | 343 | A | 166 | 128 | 2296 | — | 11,805 | 2 |

TABLE 189-continued

Binding affinity of A03/11 supertype peptides

| Peptide | Sequence | SEQ ID NO | AA | Organism | Protein | Position | Analog | A*0301 | A*1101 | A*3101 | A*3301 | A*6801 | Degeneracy |
|---|---|---|---|---|---|---|---|---|---|---|---|---|---|
| 1556.70 | RAHSSHLK | 14508 | 8 | Human | p53 | 363 | | 27 | 18 | 619 | — | 2875 | 2 |
| 1556.71 | RAHSSHLR | 14509 | 8 | Human | p53 | 363 | A | 1906 | 1181 | 40 | 2859 | 1718 | 1 |
| 1556.72 | RVHSSHLK | 14510 | 8 | Human | p53 | 363 | A | 144 | 13 | 483 | 13,231 | 1632 | 3 |
| 1556.73 | RAHSSHLKSKK | 14511 | 11 | Human | p53 | 363 | | 296 | 115 | 1397 | 11,165 | 7492 | 2 |
| 1556.74 | RAHSSHLKSKR | 14512 | 11 | Human | p53 | 363 | A | 1110 | 749 | 265 | 1247 | 1567 | 1 |
| 1556.75 | RVHSSHLKSKK | 14513 | 11 | Human | p53 | 363 | A | 118 | 20 | 300 | 12,007 | 2153 | 3 |
| 1556.76 | RTHSSHLKSKK | 14514 | 11 | Human | p53 | 363 | A | 59 | 9.8 | 195 | 10,742 | 1358 | 3 |
| 1556.77 | STSRHKKLMFK | 14515 | 11 | Human | p53 | 376 | | 168 | 54 | 212 | 59 | 103 | 5 |
| 1556.78 | TSRHKKLMFK | 14516 | 10 | Human | p53 | 377 | | 597 | 87 | 3091 | 856 | 1479 | 1 |
| 1556.79 | TVRHKKLMFK | 14517 | 10 | Human | p53 | 377 | A | 440 | 188 | 5102 | 11,797 | 2181 | 2 |

—indicates binding affinity >20,000 nM.

LENGTHY TABLES

The patent contains a lengthy table section. A copy of the table is available in electronic form from the USPTO web site (http://seqdata.uspto.gov/?pageRequest=docDetail&DocID=US09340577B2). An electronic copy of the table will also be available from the USPTO upon request and payment of the fee set forth in 37 CFR 1.19(b)(3).

SEQUENCE LISTING (14635 sequences)

SEQ ID NO: 1 - protein, 9 aa, Artificial Sequence
  Synthetic Peptide
LQIGNIISI

SEQ ID NO: 2 - protein, 9 aa, Artificial Sequence
  Synthetic Peptide
NLSLSCHAA

SEQ ID NO: 3 - protein, 9 aa, Artificial Sequence
  Synthetic Peptide
YLSGANLNV

SEQ ID NO: 4 - protein, 9 aa, Artificial Sequence
  Synthetic Peptide
SMPPPGTRV

SEQ ID NO: 5 - protein, 9 aa, Artificial Sequence
  Synthetic Peptide
SLPPPGTRV

SEQ ID NO: 6 - protein, 9 aa, Artificial Sequence
  Synthetic Peptide
KTCPVQLWV

SEQ ID NO: 7 - protein, 9 aa, Artificial Sequence
  Synthetic Peptide
KLLPENNVV

SEQ ID NO: 8 - protein, 9 aa, Artificial Sequence
  Synthetic Peptide
ALNKMFBQV

SEQ ID NO: 9 - protein, 9 aa, Artificial Sequence
  Synthetic Peptide
KLBPVQLWV

SEQ ID NO: 10 - protein, 9 aa, Artificial Sequence
  Synthetic Peptide
BLTIHYNYV

SEQ ID NO: 11 - protein, 10 aa, Artificial Sequence
  Synthetic Peptide
LLPPQHLIRV

SEQ ID NO: 12 - protein, 11 aa, Artificial Sequence
  Synthetic Peptide
YMCNSSCMGGM

SEQ ID NO: 13 - protein, 11 aa, Artificial Sequence
  Synthetic Peptide
YLCNSSCMGGV

SEQ ID NO: 14 - protein, 11 aa, Artificial Sequence
  Synthetic Peptide
KLYQGSYGFRV

SEQ ID NO: 15 - protein, 9 aa, Artificial Sequence
  Synthetic Peptide
CQLAKTCPV

SEQ ID NO: 16 - protein, 9 aa, Artificial Sequence
  Synthetic Peptide
RLPEAAPPV

SEQ ID NO: 17 - protein, 9 aa, Artificial Sequence
  Synthetic Peptide
GLAPPQHLV

SEQ ID NO: 18 - protein, 9 aa, Artificial Sequence
  Synthetic Peptide
KMAELVHFL

SEQ ID NO: 19 - protein, 9 aa, Artificial Sequence
  Synthetic Peptide
KLAELVHFL

SEQ ID NO: 20 - protein, 9 aa, Artificial Sequence
  Synthetic Peptide
CLLAKTCPV

SEQ ID NO: 21 - protein, 9 aa, Artificial Sequence
  Synthetic Peptide
KLSQHMTEV

SEQ ID NO: 22 - protein, 9 aa, Artificial Sequence
  Synthetic Peptide
ELAPVVAPV

SEQ ID NO: 23 - protein, 10 aa, Artificial Sequence
  Synthetic Peptide
QLAKTCPVQV

SEQ ID NO: 24 - protein, 9 aa, Artificial Sequence
  Synthetic Peptide
HLTEVVRRV

SEQ ID NO: 25 - protein, 11 aa, Artificial Sequence
  Synthetic Peptide
KTYQGSYGFRL

SEQ ID NO: 26 - protein, 10 aa, Artificial Sequence
  Synthetic Peptide
VVVPYEPPEV

SEQ ID NO: 27 - protein, 9 aa, Artificial Sequence
  Synthetic Peptide
BQLAKTBPV

SEQ ID NO: 28 - protein, 9 aa, Artificial Sequence
  Synthetic Peptide
BLLAKTBPV

SEQ ID NO: 29 - protein, 9 aa, Artificial Sequence
  Synthetic Peptide
QIIGYVIGT

SEQ ID NO: 30 - protein, 9 aa, Artificial Sequence
  Synthetic Peptide
QLIGYVIGV

SEQ ID NO: 31 - protein, 9 aa, Artificial Sequence
  Synthetic Peptide
YVCGIQNSV

SEQ ID NO: 32 - protein, 9 aa, Artificial Sequence
  Synthetic Peptide
YLCGIQNSV

SEQ ID NO: 33 - protein, 9 aa, Artificial Sequence
  Synthetic Peptide
ATVGIMIGV

SEQ ID NO: 34 - protein, 9 aa, Artificial Sequence
  Synthetic Peptide
ALVGIMIGV

SEQ ID NO: 35 - protein, 10 aa, Artificial Sequence
  Synthetic Peptide
VLYGPDDPTI

SEQ ID NO: 36 - protein, 10 aa, Artificial Sequence
  Synthetic Peptide
VLYGPDDPTV

SEQ ID NO: 37 - protein, 9 aa, Artificial Sequence
  Synthetic Peptide
DLMLSPDDV

SEQ ID NO: 38 - protein, 9 aa, Artificial Sequence
  Synthetic Peptide
ALMLSPDDI

SEQ ID NO: 39 - protein, 9 aa, Artificial Sequence
  Synthetic Peptide
ALMLSPDDV

SEQ ID NO: 40 - protein, 9 aa, Artificial Sequence
  Synthetic Peptide
DLMLSPADI

SEQ ID NO: 41 - protein, 9 aa, Artificial Sequence
  Synthetic Peptide
DLMLSPADV

SEQ ID NO: 42 - protein, 9 aa, Artificial Sequence
  Synthetic Peptide
DLMLSPDAI

SEQ ID NO: 43 - protein, 9 aa, Artificial Sequence
  Synthetic Peptide
DLMLSPDAV

SEQ ID NO: 44 - protein, 9 aa, Artificial Sequence
  Synthetic Peptide
AILTFGSFV

SEQ ID NO: 45 - protein, 9 aa, Artificial Sequence
  Synthetic Peptide
HLRDFALAV

SEQ ID NO: 46 - protein, 9 aa, Artificial Sequence
  Synthetic Peptide
ALLGSIALL

SEQ ID NO: 47 - protein, 9 aa, Artificial Sequence
  Synthetic Peptide
ALLATILAA

SEQ ID NO: 48 - protein, 9 aa, Artificial Sequence
  Synthetic Peptide
LLATILAAV

SEQ ID NO: 49 - protein, 9 aa, Artificial Sequence
  Synthetic Peptide
RLFADELAA

SEQ ID NO: 50 - protein, 9 aa, Artificial Sequence
  Synthetic Peptide
YLSKCTLAV

SEQ ID NO: 51 - protein, 9 aa, Artificial Sequence
  Synthetic Peptide
LVYHIYSKI

SEQ ID NO: 52 - protein, 9 aa, Artificial Sequence
  Synthetic Peptide
SMYLCILSA

SEQ ID NO: 53 - protein, 9 aa, Artificial Sequence
  Synthetic Peptide
YLCILSALV

SEQ ID NO: 54 - protein, 9 aa, Artificial Sequence
  Synthetic Peptide
VMFSYLQSL

SEQ ID NO: 55 - protein, 9 aa, Artificial Sequence
  Synthetic Peptide
RLHVYAYSA

SEQ ID NO: 56 - protein, 9 aa, Artificial Sequence
  Synthetic Peptide
GLQTLGAFV

SEQ ID NO: 57 - protein, 9 aa, Artificial Sequence
  Synthetic Peptide
FVEEQMTWA

SEQ ID NO: 58 - protein, 9 aa, Artificial Sequence
  Synthetic Peptide
QMTWAQTVV

SEQ ID NO: 59 - protein, 9 aa, Artificial Sequence
  Synthetic Peptide
IILDTAIFV

SEQ ID NO: 60 - protein, 9 aa, Artificial Sequence
  Synthetic Peptide
AIFVCNAFV

SEQ ID NO: 61 - protein, 9 aa, Artificial Sequence
  Synthetic Peptide
AMGNRLVEA

SEQ ID NO: 62 - protein, 9 aa, Artificial Sequence
  Synthetic Peptide
RLVEACNLL

SEQ ID NO: 63 - protein, 9 aa, Artificial Sequence
  Synthetic Peptide
TLSIVTFSL

SEQ ID NO: 64 - protein, 9 aa, Artificial Sequence
  Synthetic Peptide
KLSVLLLEV

SEQ ID NO: 65 - protein, 9 aa, Artificial Sequence
  Synthetic Peptide
LLLEVNRSV

SEQ ID NO: 66 - protein, 9 aa, Artificial Sequence
  Synthetic Peptide
FVSSPTLPV

SEQ ID NO: 67 - protein, 9 aa, Artificial Sequence
  Synthetic Peptide
AMLVLLAEI

SEQ ID NO: 68 - protein, 9 aa, Artificial Sequence
  Synthetic Peptide
QMARLAWEA

SEQ ID NO: 69 - protein, 10 aa, Artificial Sequence
  Synthetic Peptide
VLAIEGIFMA

SEQ ID NO: 70 - protein, 10 aa, Artificial Sequence
  Synthetic Peptide
YLYHPLLSPI

SEQ ID NO: 71 - protein, 10 aa, Artificial Sequence
  Synthetic Peptide
SLFEAMLANV

SEQ ID NO: 72 - protein, 10 aa, Artificial Sequence
  Synthetic Peptide
STTGINQLGL

SEQ ID NO: 73 - protein, 10 aa, Artificial Sequence
  Synthetic Peptide
LAILTFGSFV

SEQ ID NO: 74 - protein, 10 aa, Artificial Sequence
  Synthetic Peptide
ALLGSIALLA

SEQ ID NO: 75 - protein, 10 aa, Artificial Sequence
  Synthetic Peptide
ALLATILAAV

SEQ ID NO: 76 - protein, 10 aa, Artificial Sequence
  Synthetic Peptide
LLATILAAVA

SEQ ID NO: 77 - protein, 10 aa, Artificial Sequence
  Synthetic Peptide
RLFADELAAL

SEQ ID NO: 78 - protein, 10 aa, Artificial Sequence
  Synthetic Peptide
YLSKCTLAVL

SEQ ID NO: 79 - protein, 10 aa, Artificial Sequence
  Synthetic Peptide
LLVYHIYSKI

SEQ ID NO: 80 - protein, 10 aa, Artificial Sequence
  Synthetic Peptide
SMYLCILSAL

SEQ ID NO: 81 - protein, 10 aa, Artificial Sequence
  Synthetic Peptide
HLHRQMLSFV

SEQ ID NO: 82 - protein, 10 aa, Artificial Sequence
  Synthetic Peptide
LLCGKTGAFL

SEQ ID NO: 83 - protein, 10 aa, Artificial Sequence
  Synthetic Peptide
ETLSIVTFSL

SEQ ID NO: 84 - protein, 9 aa, Artificial Sequence
  Synthetic Peptide
VMCTYSPPL

SEQ ID NO: 85 - protein, 9 aa, Artificial Sequence
  Synthetic Peptide
KLFCQLAKT

SEQ ID NO: 86 - protein, 9 aa, Artificial Sequence
  Synthetic Peptide
ATPPAGSRV

SEQ ID NO: 87 - protein, 10 aa, Artificial Sequence
  Synthetic Peptide
FLQSGTAKSV

SEQ ID NO: 88 - protein, 10 aa, Artificial Sequence
  Synthetic Peptide
CMDRGLTVFV

SEQ ID NO: 89 - protein, 10 aa, Artificial Sequence
  Synthetic Peptide
VLLNWWRWRL

SEQ ID NO: 90 - protein, 9 aa, Artificial Sequence
  Synthetic Peptide
GVFTGLTHI

SEQ ID NO: 91 - protein, 9 aa, Artificial Sequence
  Synthetic Peptide
QMWKCLIRL

SEQ ID NO: 92 - protein, 9 aa, Artificial Sequence
  Synthetic Peptide
IMTCMSADL

SEQ ID NO: 93 - protein, 9 aa, Artificial Sequence
  Synthetic Peptide
ALAAYCLST

SEQ ID NO: 94 - protein, 9 aa, Artificial Sequence
  Synthetic Peptide
VLSGKPAII

SEQ ID NO: 95 - protein, 9 aa, Artificial Sequence
  Synthetic Peptide
FISGIQYLA

SEQ ID NO: 96 - protein, 10 aa, Artificial Sequence
  Synthetic Peptide
YIMTCMSADL

SEQ ID NO: 97 - protein, 10 aa, Artificial Sequence
  Synthetic Peptide
AIASLMAFTA

SEQ ID NO: 98 - protein, 10 aa, Artificial Sequence
  Synthetic Peptide
GLAGAAIGSV

SEQ ID NO: 99 - protein, 8 aa, Artificial Sequence
  Synthetic Peptide
MIGVLVGV

SEQ ID NO: 100 - protein, 9 aa, Artificial Sequence
  Synthetic Peptide
VLPLAYISL

SEQ ID NO: 101 - protein, 9 aa, Artificial Sequence
  Synthetic Peptide
SLGCIFFPL

SEQ ID NO: 102 - protein, 9 aa, Artificial Sequence
  Synthetic Peptide
PLAYISLFL

SEQ ID NO: 103 - protein, 9 aa, Artificial Sequence
  Synthetic Peptide
LMLFYQVWA

SEQ ID NO: 104 - protein, 9 aa, Artificial Sequence
  Synthetic Peptide
NISIYNYFV

SEQ ID NO: 105 - protein, 9 aa, Artificial Sequence
  Synthetic Peptide
NISVYNYFV

SEQ ID NO: 106 - protein, 9 aa, Artificial Sequence
  Synthetic Peptide
FVWTHYYSV

SEQ ID NO: 107 - protein, 9 aa, Artificial Sequence
  Synthetic Peptide
FLTWHRYHL

SEQ ID NO: 108 - protein, 9 aa, Artificial Sequence
  Synthetic Peptide
LTWHRYHLL

SEQ ID NO: 109 - protein, 9 aa, Artificial Sequence
  Synthetic Peptide
MLQEPSFSL

SEQ ID NO: 110 - protein, 9 aa, Artificial Sequence
  Synthetic Peptide
SLPYWNFAT

SEQ ID NO: 111 - protein, 9 aa, Artificial Sequence
  Synthetic Peptide
RLPEPQDVA

SEQ ID NO: 112 - protein, 9 aa, Artificial Sequence
  Synthetic Peptide
VTQCLEVRV

SEQ ID NO: 113 - protein, 9 aa, Artificial Sequence
  Synthetic Peptide
LLHTFTDAV

SEQ ID NO: 114 - protein, 9 aa, Artificial Sequence
  Synthetic Peptide
NMVPFWPPV

SEQ ID NO: 115 - protein, 9 aa, Artificial Sequence
  Synthetic Peptide
AVVGALLLV

SEQ ID NO: 116 - protein, 9 aa, Artificial Sequence
  Synthetic Peptide
AVVAALLLV

SEQ ID NO: 117 - protein, 9 aa, Artificial Sequence
  Synthetic Peptide
LLVAAIFGV

SEQ ID NO: 118 - protein, 9 aa, Artificial Sequence
  Synthetic Peptide
SMDEANQPL

SEQ ID NO: 119 - protein, 9 aa, Artificial Sequence
  Synthetic Peptide
VLPLAYISV

SEQ ID NO: 120 - protein, 9 aa, Artificial Sequence
  Synthetic Peptide
SLGCIFFPV

SEQ ID NO: 121 - protein, 9 aa, Artificial Sequence
  Synthetic Peptide
PLAYISLFV

SEQ ID NO: 122 - protein, 9 aa, Artificial Sequence
  Synthetic Peptide
LLLFQQARV

SEQ ID NO: 123 - protein, 9 aa, Artificial Sequence
  Synthetic Peptide
LMLFYQVWV

SEQ ID NO: 124 - protein, 9 aa, Artificial Sequence
  Synthetic Peptide
LLPSSGPGV

SEQ ID NO: 125 - protein, 9 aa, Artificial Sequence
  Synthetic Peptide
NLSIYNYFV

SEQ ID NO: 126 - protein, 9 aa, Artificial Sequence
  Synthetic Peptide
NLSVYNYFV

SEQ ID NO: 127 - protein, 9 aa, Artificial Sequence
  Synthetic Peptide
FLWTHYYSV

SEQ ID NO: 128 - protein, 9 aa, Artificial Sequence
  Synthetic Peptide
SLKKTFLGV

SEQ ID NO: 129 - protein, 9 aa, Artificial Sequence
  Synthetic Peptide
FLTWHRYHV

SEQ ID NO: 130 - protein, 9 aa, Artificial Sequence
  Synthetic Peptide
MLQEPSFSV

SEQ ID NO: 131 - protein, 9 aa, Artificial Sequence
  Synthetic Peptide
SLPYWNFAV

SEQ ID NO: 132 - protein, 9 aa, Artificial Sequence
  Synthetic Peptide
ALGKNVCDV

SEQ ID NO: 133 - protein, 9 aa, Artificial Sequence
  Synthetic Peptide
SLLISPNSV

SEQ ID NO: 134 - protein, 9 aa, Artificial Sequence
  Synthetic Peptide
SLFSQWRVV

SEQ ID NO: 135 - protein, 9 aa, Artificial Sequence
  Synthetic Peptide
TLGTLCNSV

SEQ ID NO: 136 - protein, 9 aa, Artificial Sequence
  Synthetic Peptide
RLPEPQDVV

SEQ ID NO: 137 - protein, 9 aa, Artificial Sequence
  Synthetic Peptide
VLQCLEVRV

SEQ ID NO: 138 - protein, 9 aa, Artificial Sequence
  Synthetic Peptide
SLNSFRNTV

SEQ ID NO: 139 - protein, 9 aa, Artificial Sequence
  Synthetic Peptide
SLDSFRNTV

SEQ ID NO: 140 - protein, 9 aa, Artificial Sequence
  Synthetic Peptide
FLNGTGGQV

SEQ ID NO: 141 - protein, 9 aa, Artificial Sequence
  Synthetic Peptide
VLLHTFTDV

SEQ ID NO: 142 - protein, 9 aa, Artificial Sequence
  Synthetic Peptide
ALVGALLLV

SEQ ID NO: 143 - protein, 9 aa, Artificial Sequence
  Synthetic Peptide
ALVAALLLV

SEQ ID NO: 144 - protein, 9 aa, Artificial Sequence
  Synthetic Peptide
LLVALIFGV

SEQ ID NO: 145 - protein, 9 aa, Artificial Sequence
  Synthetic Peptide
YLIRARRSV

SEQ ID NO: 146 - protein, 9 aa, Artificial Sequence
  Synthetic Peptide
SMDEANQPV

SEQ ID NO: 147 - protein, 10 aa, Artificial Sequence
  Synthetic Peptide
SLGCIFFPLL

SEQ ID NO: 148 - protein, 10 aa, Artificial Sequence
  Synthetic Peptide
GMCCPDLSPV

SEQ ID NO: 149 - protein, 10 aa, Artificial Sequence
  Synthetic Peptide
AACNQKILTV

SEQ ID NO: 150 - protein, 10 aa, Artificial Sequence
  Synthetic Peptide
FLTWHRYHLL

SEQ ID NO: 151 - protein, 10 aa, Artificial Sequence
  Synthetic Peptide
SLHNLAHLFL

SEQ ID NO: 152 - protein, 10 aa, Artificial Sequence
  Synthetic Peptide
LLLVAAIFGV

SEQ ID NO: 153 - protein, 10 aa, Artificial Sequence
  Synthetic Peptide
LLVAAIFGVA

SEQ ID NO: 154 - protein, 10 aa, Artificial Sequence
  Synthetic Peptide
ALIFGTASYL

SEQ ID NO: 155 - protein, 10 aa, Artificial Sequence
  Synthetic Peptide
SMDEANQPLL

SEQ ID NO: 156 - protein, 10 aa, Artificial Sequence
  Synthetic Peptide
LLTDQYQCYA

SEQ ID NO: 157 - protein, 10 aa, Artificial Sequence
  Synthetic Peptide
SLGCIFFPLV

SEQ ID NO: 158 - protein, 10 aa, Artificial Sequence
  Synthetic Peptide
FLMLFYQVWV

SEQ ID NO: 159 - protein, 10 aa, Artificial Sequence
  Synthetic Peptide
ALCDQRVLIV

SEQ ID NO: 160 - protein, 10 aa, Artificial Sequence
  Synthetic Peptide
ALCNQKILTV

SEQ ID NO: 161 - protein, 10 aa, Artificial Sequence
  Synthetic Peptide
FLTWHRYHLV

SEQ ID NO: 162 - protein, 10 aa, Artificial Sequence
  Synthetic Peptide
SLHNLAHLFV

SEQ ID NO: 163 - protein, 10 aa, Artificial Sequence
  Synthetic Peptide
NLAHLFLNGV

SEQ ID NO: 164 - protein, 10 aa, Artificial Sequence
  Synthetic Peptide
NMVPFWPPVV

SEQ ID NO: 165 - protein, 10 aa, Artificial Sequence
  Synthetic Peptide
ILVVAALLLV

SEQ ID NO: 166 - protein, 10 aa, Artificial Sequence
  Synthetic Peptide
LLVALIFGTV

SEQ ID NO: 167 - protein, 10 aa, Artificial Sequence
  Synthetic Peptide
ALIFGTASYV

SEQ ID NO: 168 - protein, 10 aa, Artificial Sequence
  Synthetic Peptide
SMDEANQPLV

SEQ ID NO: 169 - protein, 10 aa, Artificial Sequence
  Synthetic Peptide
LLTDQYQCYV

SEQ ID NO: 170 - protein, 11 aa, Artificial Sequence
  Synthetic Peptide
LLIQNIIQNDT

SEQ ID NO: 171 - protein, 11 aa, Artificial Sequence
  Synthetic Peptide
IIQNDTGFYTL

SEQ ID NO: 172 - protein, 11 aa, Artificial Sequence
  Synthetic Peptide
TLFNVTRNDTA

SEQ ID NO: 173 - protein, 11 aa, Artificial Sequence
  Synthetic Peptide
LTLLSVTRNDV

SEQ ID NO: 174 - protein, 11 aa, Artificial Sequence
  Synthetic Peptide
GLYTCQANNSA

SEQ ID NO: 175 - protein, 11 aa, Artificial Sequence
  Synthetic Peptide
ATVGIMIGVLV

SEQ ID NO: 176 - protein, 11 aa, Artificial Sequence
  Synthetic Peptide
GLVPPQHLIRV

SEQ ID NO: 177 - protein, 11 aa, Artificial Sequence
  Synthetic Peptide
GLAPPVHLIRV

SEQ ID NO: 178 - protein, 11 aa, Artificial Sequence
  Synthetic Peptide
GLAPPEHLIRV

SEQ ID NO: 179 - protein, 9 aa, Artificial Sequence
  Synthetic Peptide
ILIGVLVGV

SEQ ID NO: 180 - protein, 10 aa, Artificial Sequence
  Synthetic Peptide
YLIMVKCWMV

SEQ ID NO: 181 - protein, 9 aa, Artificial Sequence
  Synthetic Peptide
LLGRDSFEV

SEQ ID NO: 182 - protein, 9 aa, Artificial Sequence
  Synthetic Peptide
FMYSDFHFI

SEQ ID NO: 183 - protein, 9 aa, Artificial Sequence
  Synthetic Peptide
NMLSTVLGV

SEQ ID NO: 184 - protein, 9 aa, Artificial Sequence
  Synthetic Peptide
SLENFRAYV

SEQ ID NO: 185 - protein, 9 aa, Artificial Sequence
  Synthetic Peptide
KMAELVHFV

SEQ ID NO: 186 - protein, 9 aa, Artificial Sequence
  Synthetic Peptide
KLAELVHFV

SEQ ID NO: 187 - protein, 9 aa, Artificial Sequence
  Synthetic Peptide
VLIQRNPQV

SEQ ID NO: 188 - protein, 9 aa, Artificial Sequence
  Synthetic Peptide
VLLGVVFGV

SEQ ID NO: 189 - protein, 9 aa, Artificial Sequence
  Synthetic Peptide
SLISAVVGV

SEQ ID NO: 190 - protein, 10 aa, Artificial Sequence
  Synthetic Peptide
YMIMVKBWMI

SEQ ID NO: 191 - protein, 10 aa, Artificial Sequence
  Synthetic Peptide
YLIMVKBWMV

SEQ ID NO: 192 - protein, 9 aa, Artificial Sequence
  Synthetic Peptide
KLWEELSVV

SEQ ID NO: 193 - protein, 9 aa, Artificial Sequence
  Synthetic Peptide
AMBRWGLLV

SEQ ID NO: 194 - protein, 8 aa, Artificial Sequence
  Synthetic Peptide
IIGVLVGV

SEQ ID NO: 195 - protein, 8 aa, Artificial Sequence
  Synthetic Peptide
ATVGIIGV

SEQ ID NO: 196 - protein, 8 aa, Artificial Sequence
  Synthetic Peptide
SPPPGTRV

SEQ ID NO: 197 - protein, 9 aa, Artificial Sequence
  Synthetic Peptide
LVFGIELEV

SEQ ID NO: 198 - protein, 8 aa, Artificial Sequence
  Synthetic Peptide
ILGFVFTL

SEQ ID NO: 199 - protein, 9 aa, Artificial Sequence
  Synthetic Peptide
KIFGSLAFL

SEQ ID NO: 200 - protein, 10 aa, Artificial Sequence
  Synthetic Peptide
YLQLVFGIEV

SEQ ID NO: 201 - protein, 9 aa, Artificial Sequence
  Synthetic Peptide
MMNDQLMFL

SEQ ID NO: 202 - protein, 10 aa, Artificial Sequence
  Synthetic Peptide
ALVLAGGFFL

SEQ ID NO: 203 - protein, 9 aa, Artificial Sequence
  Synthetic Peptide
WLCAGALVL

SEQ ID NO: 204 - protein, 9 aa, Artificial Sequence
  Synthetic Peptide
MVFELANSI

SEQ ID NO: 205 - protein, 10 aa, Artificial Sequence
  Synthetic Peptide
RMMNDQLMFL

SEQ ID NO: 206 - protein, 9 aa, Artificial Sequence
  Synthetic Peptide
LVLAGGFFL

SEQ ID NO: 207 - protein, 9 aa, Artificial Sequence
  Synthetic Peptide
VLAGGFFLL

SEQ ID NO: 208 - protein, 9 aa, Artificial Sequence
  Synthetic Peptide
LLHETDSAV

SEQ ID NO: 209 - protein, 9 aa, Artificial Sequence
  Synthetic Peptide
LMYSLVHNL

SEQ ID NO: 210 - protein, 10 aa, Artificial Sequence
  Synthetic Peptide
QLMFLERAFI

SEQ ID NO: 211 - protein, 9 aa, Artificial Sequence
  Synthetic Peptide
LMFLERAFI

SEQ ID NO: 212 - protein, 10 aa, Artificial Sequence
  Synthetic Peptide
KLGSGNDFEV

SEQ ID NO: 213 - protein, 10 aa, Artificial Sequence
  Synthetic Peptide
LLQERGVAYI

SEQ ID NO: 214 - protein, 10 aa, Artificial Sequence
  Synthetic Peptide
GMPEGDLVYV

SEQ ID NO: 215 - protein, 10 aa, Artificial Sequence
  Synthetic Peptide
FLDELKAENI

SEQ ID NO: 216 - protein, 9 aa, Artificial Sequence
  Synthetic Peptide
ALFDIESKV

SEQ ID NO: 217 - protein, 10 aa, Artificial Sequence
  Synthetic Peptide
GLPSIPVHPI

SEQ ID NO: 218 - protein, 9 aa, Artificial Sequence
  Synthetic Peptide
AYGPGPGKF

SEQ ID NO: 219 - protein, 9 aa, Artificial Sequence
  Synthetic Peptide
AEIPYLAKY

SEQ ID NO: 220 - protein, 9 aa, Artificial Sequence
  Synthetic Peptide
AADAAAAKY

SEQ ID NO: 221 - protein, 9 aa, Artificial Sequence
  Synthetic Peptide
AYSSWMYSY

SEQ ID NO: 222 - protein, 9 aa, Artificial Sequence
  Synthetic Peptide
LAEKTMKEY

SEQ ID NO: 223 - protein, 9 aa, Artificial Sequence
  Synthetic Peptide
GTYDYWAGY

SEQ ID NO: 224 - protein, 10 aa, Artificial Sequence
  Synthetic Peptide
LSVHSIQNDY

SEQ ID NO: 225 - protein, 10 aa, Artificial Sequence
  Synthetic Peptide
DTGQCPELVY

SEQ ID NO: 226 - protein, 10 aa, Artificial Sequence
  Synthetic Peptide
DLLDTASALY

SEQ ID NO: 227 - protein, 9 aa, Artificial Sequence
  Synthetic Peptide
WFHISCLTF

SEQ ID NO: 228 - protein, 10 aa, Artificial Sequence
  Synthetic Peptide
LSLDVSAAFY

SEQ ID NO: 229 - protein, 10 aa, Artificial Sequence
  Synthetic Peptide
LSGPGPGAFY

SEQ ID NO: 230 - protein, 10 aa, Artificial Sequence
  Synthetic Peptide
LSLGPGPGFY

SEQ ID NO: 231 - protein, 10 aa, Artificial Sequence
  Synthetic Peptide
LSLDGPGPGY

SEQ ID NO: 232 - protein, 10 aa, Artificial Sequence
  Synthetic Peptide
KTYGRKLHLY

SEQ ID NO: 233 - protein, 10 aa, Artificial Sequence
  Synthetic Peptide
KTGPGPGHLY

SEQ ID NO: 234 - protein, 10 aa, Artificial Sequence
  Synthetic Peptide
KTYGPGPGLY

SEQ ID NO: 235 - protein, 10 aa, Artificial Sequence
  Synthetic Peptide
KTYGGPGPGY

SEQ ID NO: 236 - protein, 8 aa, Artificial Sequence
  Synthetic Peptide
KYTSFPWL

SEQ ID NO: 237 - protein, 10 aa, Artificial Sequence
  Synthetic Peptide
FAAPFTQCGY

SEQ ID NO: 238 - protein, 10 aa, Artificial Sequence
  Synthetic Peptide
SYQHFRKLLL

SEQ ID NO: 239 - protein, 10 aa, Artificial Sequence
  Synthetic Peptide
LYSHPIILGF

SEQ ID NO: 240 - protein, 9 aa, Artificial Sequence
  Synthetic Peptide
MSTTDLEAY

SEQ ID NO: 241 - protein, 11 aa, Artificial Sequence
  Synthetic Peptide
MYVGGPGPGVF

SEQ ID NO: 242 - protein, 8 aa, Artificial Sequence
  Synthetic Peptide
VMGSSYGF

SEQ ID NO: 243 - protein, 10 aa, Artificial Sequence
  Synthetic Peptide
EVDGVRLHRY

SEQ ID NO: 244 - protein, 10 aa, Artificial Sequence
  Synthetic Peptide
RTEILDLWVY

SEQ ID NO: 245 - protein, 10 aa, Artificial Sequence
  Synthetic Peptide
RQDILDLWVY

SEQ ID NO: 246 - protein, 10 aa, Artificial Sequence
  Synthetic Peptide
RTDILDLWVY

SEQ ID NO: 247 - protein, 9 aa, Artificial Sequence
  Synthetic Peptide
YTDGPGIRY

SEQ ID NO: 248 - protein, 9 aa, Artificial Sequence
  Synthetic Peptide
ATELHPEYY

SEQ ID NO: 249 - protein, 11 aa, Artificial Sequence
  Synthetic Peptide
DLWVYHTQGYY

SEQ ID NO: 250 - protein, 9 aa, Artificial Sequence
  Synthetic Peptide
WVYHTQGYY

SEQ ID NO: 251 - protein, 9 aa, Artificial Sequence
  Synthetic Peptide
FFLKEKGGF

SEQ ID NO: 252 - protein, 9 aa, Artificial Sequence
  Synthetic Peptide
LYVYHTQGY

SEQ ID NO: 253 - protein, 11 aa, Artificial Sequence
  Synthetic Peptide
ITKILYQSNPY

SEQ ID NO: 254 - protein, 9 aa, Artificial Sequence
  Synthetic Peptide
KTLYQSNPY

SEQ ID NO: 255 - protein, 9 aa, Artificial Sequence
  Synthetic Peptide
PVDPNLEPY

SEQ ID NO: 256 - protein, 8 aa, Artificial Sequence
  Synthetic Peptide
STVKHHMY

SEQ ID NO: 257 - protein, 10 aa, Artificial Sequence
  Synthetic Peptide
LSKISEYRHY

SEQ ID NO: 258 - protein, 9 aa, Artificial Sequence
  Synthetic Peptide
ISEYRHYNY

SEQ ID NO: 259 - protein, 9 aa, Artificial Sequence
  Synthetic Peptide
RFHNIRGRW

SEQ ID NO: 260 - protein, 9 aa, Artificial Sequence
  Synthetic Peptide
RFLSKISEY

SEQ ID NO: 261 - protein, 9 aa, Artificial Sequence
  Synthetic Peptide
RFHNISGRW

SEQ ID NO: 262 - protein, 11 aa, Artificial Sequence
  Synthetic Peptide
TLEKLTNTGLY

SEQ ID NO: 263 - protein, 11 aa, Artificial Sequence
  Synthetic Peptide
TLGPGPGTGLY

SEQ ID NO: 264 - protein, 11 aa, Artificial Sequence
  Synthetic Peptide
TLEGPGPGGLY

SEQ ID NO: 265 - protein, 11 aa, Artificial Sequence
  Synthetic Peptide
TLEKGPGPGLY

SEQ ID NO: 266 - protein, 11 aa, Artificial Sequence
  Synthetic Peptide
TLEKLGPGPGY

SEQ ID NO: 267 - protein, 11 aa, Artificial Sequence
  Synthetic Peptide
TLEKLTNTGLY

SEQ ID NO: 268 - protein, 11 aa, Artificial Sequence
  Synthetic Peptide
TLEKITNTELY

SEQ ID NO: 269 - protein, 11 aa, Artificial Sequence
  Synthetic Peptide
PYGVCIMCLRF

SEQ ID NO: 270 - protein, 10 aa, Artificial Sequence
  Synthetic Peptide
ITDIILECVY

SEQ ID NO: 271 - protein, 10 aa, Artificial Sequence
  Synthetic Peptide
YSDISEYRHY

SEQ ID NO: 272 - protein, 10 aa, Artificial Sequence
  Synthetic Peptide
LTDIEITCVY

SEQ ID NO: 273 - protein, 10 aa, Artificial Sequence
  Synthetic Peptide
YSDIRELRHY

SEQ ID NO: 274 - protein, 10 aa, Artificial Sequence
  Synthetic Peptide
ELSSALEIPY

SEQ ID NO: 275 - protein, 10 aa, Artificial Sequence
  Synthetic Peptide
ETSSALEIPY

SEQ ID NO: 276 - protein, 10 aa, Artificial Sequence
  Synthetic Peptide
ELDSALEIPY

SEQ ID NO: 277 - protein, 10 aa, Artificial Sequence
  Synthetic Peptide
YTKVSEFRWY

SEQ ID NO: 278 - protein, 10 aa, Artificial Sequence
  Synthetic Peptide
YSDVSEFRWY

SEQ ID NO: 279 - protein, 10 aa, Artificial Sequence
  Synthetic Peptide
LTDVSIACVY

SEQ ID NO: 280 - protein, 10 aa, Artificial Sequence
  Synthetic Peptide
FTSRIRELRY

SEQ ID NO: 281 - protein, 10 aa, Artificial Sequence
  Synthetic Peptide
YSDIRELRYY

SEQ ID NO: 282 - protein, 10 aa, Artificial Sequence
  Synthetic Peptide
LTDLRLSCVY

SEQ ID NO: 283 - protein, 10 aa, Artificial Sequence
  Synthetic Peptide
FTSKVRKYRY

SEQ ID NO: 284 - protein, 10 aa, Artificial Sequence
  Synthetic Peptide
YSDVRKYRYY

SEQ ID NO: 285 - protein, 10 aa, Artificial Sequence
  Synthetic Peptide
FYSKVSEFRF

SEQ ID NO: 286 - protein, 10 aa, Artificial Sequence
  Synthetic Peptide
FYSRIRELRF

SEQ ID NO: 287 - protein, 10 aa, Artificial Sequence
  Synthetic Peptide
PYAVCRVCLF

SEQ ID NO: 288 - protein, 9 aa, Artificial Sequence
  Synthetic Peptide
ITEYRHYNY

SEQ ID NO: 289 - protein, 9 aa, Artificial Sequence
  Synthetic Peptide
ISDYRHYNY

SEQ ID NO: 290 - protein, 9 aa, Artificial Sequence
  Synthetic Peptide
ITEYRHYQY

SEQ ID NO: 291 - protein, 9 aa, Artificial Sequence
  Synthetic Peptide
ISDYRHYQY

SEQ ID NO: 292 - protein, 9 aa, Artificial Sequence
  Synthetic Peptide
LTDLLIRCY

SEQ ID NO: 293 - protein, 9 aa, Artificial Sequence
  Synthetic Peptide
KTDQRSEVY

SEQ ID NO: 294 - protein, 9 aa, Artificial Sequence
  Synthetic Peptide
AYRDLCIVY

SEQ ID NO: 295 - protein, 9 aa, Artificial Sequence
  Synthetic Peptide
KYYSKISEY

SEQ ID NO: 296 - protein, 9 aa, Artificial Sequence
  Synthetic Peptide
KFYSKISEF

SEQ ID NO: 297 - protein, 9 aa, Artificial Sequence
  Synthetic Peptide
RYHNIRGRW

SEQ ID NO: 298 - protein, 9 aa, Artificial Sequence
  Synthetic Peptide
RFHNIRGRF

SEQ ID NO: 299 - protein, 9 aa, Artificial Sequence
  Synthetic Peptide
AYKDLFVVY

SEQ ID NO: 300 - protein, 9 aa, Artificial Sequence
  Synthetic Peptide
LFVVYRDSF

SEQ ID NO: 301 - protein, 9 aa, Artificial Sequence
  Synthetic Peptide
RYHNIAGHY

SEQ ID NO: 302 - protein, 9 aa, Artificial Sequence
  Synthetic Peptide
RFHNIAGHF

SEQ ID NO: 303 - protein, 9 aa, Artificial Sequence
  Synthetic Peptide
VYGTTLEKF

SEQ ID NO: 304 - protein, 9 aa, Artificial Sequence
  Synthetic Peptide
AYADLTVVY

SEQ ID NO: 305 - protein, 9 aa, Artificial Sequence
  Synthetic Peptide
AFADLTVVF

SEQ ID NO: 306 - protein, 9 aa, Artificial Sequence
  Synthetic Peptide
RYLSKISEY

SEQ ID NO: 307 - protein, 9 aa, Artificial Sequence
  Synthetic Peptide
RYHNISGRW

SEQ ID NO: 308 - protein, 9 aa, Artificial Sequence
  Synthetic Peptide
AYKDLCIVY

SEQ ID NO: 309 - protein, 9 aa, Artificial Sequence
  Synthetic Peptide
RYHSIAGQY

SEQ ID NO: 310 - protein, 9 aa, Artificial Sequence
  Synthetic Peptide
RFHSIAGQF

SEQ ID NO: 311 - protein, 9 aa, Artificial Sequence
  Synthetic Peptide
KYLFTDLRI

SEQ ID NO: 312 - protein, 9 aa, Artificial Sequence
  Synthetic Peptide
KFLFTDLRF

SEQ ID NO: 313 - protein, 9 aa, Artificial Sequence
  Synthetic Peptide
LYTDLRIVY

SEQ ID NO: 314 - protein, 9 aa, Artificial Sequence
  Synthetic Peptide
LFTDLRIVF

SEQ ID NO: 315 - protein, 9 aa, Artificial Sequence
  Synthetic Peptide
RFLSKISEF

SEQ ID NO: 316 - protein, 9 aa, Artificial Sequence
  Synthetic Peptide
EYRHYQYSF

SEQ ID NO: 317 - protein, 9 aa, Artificial Sequence
  Synthetic Peptide
RYHNIMGRW

SEQ ID NO: 318 - protein, 9 aa, Artificial Sequence
  Synthetic Peptide
RFHNIMGRF

SEQ ID NO: 319 - protein, 9 aa, Artificial Sequence
  Synthetic Peptide
NFACTELKF

SEQ ID NO: 320 - protein, 9 aa, Artificial Sequence
  Synthetic Peptide
PYAVCRVCF

SEQ ID NO: 321 - protein, 9 aa, Artificial Sequence
  Synthetic Peptide
LYYSKVRKY

SEQ ID NO: 322 - protein, 9 aa, Artificial Sequence
  Synthetic Peptide
VYADLRIVY

SEQ ID NO: 323 - protein, 9 aa, Artificial Sequence
  Synthetic Peptide
VFADLRIVF

SEQ ID NO: 324 - protein, 9 aa, Artificial Sequence
  Synthetic Peptide
NYSLYGDTF

SEQ ID NO: 325 - protein, 9 aa, Artificial Sequence
  Synthetic Peptide
RFHNISGRF

SEQ ID NO: 326 - protein, 8 aa, Artificial Sequence
  Synthetic Peptide
FTDLTIVY

SEQ ID NO: 327 - protein, 8 aa, Artificial Sequence
  Synthetic Peptide
FTDLRIVY

SEQ ID NO: 328 - protein, 11 aa, Artificial Sequence
  Synthetic Peptide
TLEKLTNTGLY

SEQ ID NO: 329 - protein, 10 aa, Artificial Sequence
  Synthetic Peptide
LTDIEITCVY

SEQ ID NO: 330 - protein, 10 aa, Artificial Sequence
  Synthetic Peptide
LTDVSIACVY

SEQ ID NO: 331 - protein, 10 aa, Artificial Sequence
  Synthetic Peptide
ITDIILECVY

SEQ ID NO: 332 - protein, 9 aa, Artificial Sequence
  Synthetic Peptide
KTDQRSEVY

SEQ ID NO: 333 - protein, 8 aa, Artificial Sequence
  Synthetic Peptide
FTDLTIVY

SEQ ID NO: 334 - protein, 10 aa, Artificial Sequence
  Synthetic Peptide
YSDIRELRYY

SEQ ID NO: 335 - protein, 10 aa, Artificial Sequence
  Synthetic Peptide
YTKVSEFRWY

SEQ ID NO: 336 - protein, 10 aa, Artificial Sequence
  Synthetic Peptide
FTSRIRELRY

SEQ ID NO: 337 - protein, 10 aa, Artificial Sequence
  Synthetic Peptide
FTSKVRKYRY

SEQ ID NO: 338 - protein, 9 aa, Artificial Sequence
  Synthetic Peptide
ISDYRHYNY

SEQ ID NO: 339 - protein, 9 aa, Artificial Sequence
  Synthetic Peptide
ISEYRHYQY

SEQ ID NO: 340 - protein, 9 aa, Artificial Sequence
  Synthetic Peptide
ISDYRHYQY

SEQ ID NO: 341 - protein, 10 aa, Artificial Sequence
  Synthetic Peptide
EYRHYCYSLY

SEQ ID NO: 342 - protein, 10 aa, Artificial Sequence
  Synthetic Peptide
EYRHYNYSLY

SEQ ID NO: 343 - protein, 9 aa, Artificial Sequence
  Synthetic Peptide
LTDLLIRCY

SEQ ID NO: 344 - protein, 10 aa, Artificial Sequence
  Synthetic Peptide
ETRHYCYSLY

SEQ ID NO: 345 - protein, 10 aa, Artificial Sequence
  Synthetic Peptide
EYDHYCYSLY

SEQ ID NO: 346 - protein, 10 aa, Artificial Sequence
  Synthetic Peptide
KTRYYDYSVY

SEQ ID NO: 347 - protein, 10 aa, Artificial Sequence
  Synthetic Peptide
KYDYYDYSVY

SEQ ID NO: 348 - protein, 10 aa, Artificial Sequence
  Synthetic Peptide
ETRHYNYSLY

SEQ ID NO: 349 - protein, 10 aa, Artificial Sequence
  Synthetic Peptide
EYDHYNYSLY

SEQ ID NO: 350 - protein, 11 aa, Artificial Sequence
  Synthetic Peptide
PTLKEYVLDLY

SEQ ID NO: 351 - protein, 10 aa, Artificial Sequence
  Synthetic Peptide
HTDTPTLHEY

SEQ ID NO: 352 - protein, 10 aa, Artificial Sequence
  Synthetic Peptide
RTETPTLQDY

SEQ ID NO: 353 - protein, 10 aa, Artificial Sequence
  Synthetic Peptide
ETDPVDLLCY

SEQ ID NO: 354 - protein, 10 aa, Artificial Sequence
  Synthetic Peptide
QTEQATSNYY

SEQ ID NO: 355 - protein, 10 aa, Artificial Sequence
  Synthetic Peptide
ATDNYYIVTY

SEQ ID NO: 356 - protein, 9 aa, Artificial Sequence
  Synthetic Peptide
LTEYVLDLY

SEQ ID NO: 357 - protein, 9 aa, Artificial Sequence
  Synthetic Peptide
QTEQATSNY

SEQ ID NO: 358 - protein, 9 aa, Artificial Sequence
  Synthetic Peptide
RQAKQHTCY

SEQ ID NO: 359 - protein, 9 aa, Artificial Sequence
  Synthetic Peptide
RTAKQHTCY

SEQ ID NO: 360 - protein, 10 aa, Artificial Sequence
  Synthetic Peptide
HTDTPTLHEY

SEQ ID NO: 361 - protein, 10 aa, Artificial Sequence
  Synthetic Peptide
RTETPTLQDY

SEQ ID NO: 362 - protein, 11 aa, Artificial Sequence
  Synthetic Peptide
PTLKEYVLDLY

SEQ ID NO: 363 - protein, 9 aa, Artificial Sequence
  Synthetic Peptide
LTEYVLDLY

SEQ ID NO: 364 - protein, 9 aa, Artificial Sequence
  Synthetic Peptide
QAEQATSNY

SEQ ID NO: 365 - protein, 10 aa, Artificial Sequence
  Synthetic Peptide
ATSNYYIVTY

SEQ ID NO: 366 - protein, 10 aa, Artificial Sequence
  Synthetic Peptide
ATDNYYIVTY

SEQ ID NO: 367 - protein, 9 aa, Artificial Sequence
  Synthetic Peptide
RVLPPNWKY

SEQ ID NO: 368 - protein, 10 aa, Artificial Sequence
  Synthetic Peptide
RLAHEVGWKY

SEQ ID NO: 369 - protein, 9 aa, Artificial Sequence
  Synthetic Peptide
AYKKQFSQY

SEQ ID NO: 370 - protein, 9 aa, Artificial Sequence
  Synthetic Peptide
AADNPPAQY

SEQ ID NO: 371 - protein, 11 aa, Artificial Sequence
  Synthetic Peptide
RSGPGPGNVLY

SEQ ID NO: 372 - protein, 11 aa, Artificial Sequence
  Synthetic Peptide
RSDGPGPGVLY

SEQ ID NO: 373 - protein, 11 aa, Artificial Sequence
  Synthetic Peptide
RSDSGPGPGLY

SEQ ID NO: 374 - protein, 11 aa, Artificial Sequence
  Synthetic Peptide
RSDSVGPGPGY

SEQ ID NO: 375 - protein, 9 aa, Artificial Sequence
  Synthetic Peptide
SLFVSNHAY

SEQ ID NO: 376 - protein, 9 aa, Artificial Sequence
  Synthetic Peptide
RWGLLLALL

SEQ ID NO: 377 - protein, 9 aa, Artificial Sequence
  Synthetic Peptide
YTGPGPGVY

SEQ ID NO: 378 - protein, 9 aa, Artificial Sequence
  Synthetic Peptide
YTAGPGPGY

SEQ ID NO: 379 - protein, 9 aa, Artificial Sequence
  Synthetic Peptide
TQDLVQEKY

SEQ ID NO: 380 - protein, 9 aa, Artificial Sequence
  Synthetic Peptide
TQGPGPGKY

SEQ ID NO: 381 - protein, 9 aa, Artificial Sequence
  Synthetic Peptide
TQDGPGPGY

SEQ ID NO: 382 - protein, 9 aa, Artificial Sequence
  Synthetic Peptide
EVGPGPGLY

SEQ ID NO: 383 - protein, 9 aa, Artificial Sequence
  Synthetic Peptide
EVDGPGPGY

SEQ ID NO: 384 - protein, 10 aa, Artificial Sequence
  Synthetic Peptide
IYGPGPGLIF

SEQ ID NO: 385 - protein, 9 aa, Artificial Sequence
  Synthetic Peptide
RISGVDRYY

SEQ ID NO: 386 - protein, 8 aa, Artificial Sequence
  Synthetic Peptide
IMVLSFLF

SEQ ID NO: 387 - protein, 9 aa, Artificial Sequence
  Synthetic Peptide
ALFQEYQCY

SEQ ID NO: 388 - protein, 10 aa, Artificial Sequence
  Synthetic Peptide
  VARIANT 7: Xaa = Any Amino Acid
LSEYYDXDIY

SEQ ID NO: 389 - protein, 10 aa, Artificial Sequence
  Synthetic Peptide
FQAAESNERY

SEQ ID NO: 390 - protein, 10 aa, Artificial Sequence
  Synthetic Peptide
ELEASISGKY

SEQ ID NO: 391 - protein, 10 aa, Artificial Sequence
  Synthetic Peptide
FVSSIFISFY

SEQ ID NO: 392 - protein, 9 aa, Artificial Sequence
  Synthetic Peptide
KVSDEIWNY

SEQ ID NO: 393 - protein, 9 aa, Artificial Sequence
  Synthetic Peptide
IMNHLMTLY

SEQ ID NO: 394 - protein, 9 aa, Artificial Sequence
  Synthetic Peptide
LIENELMNY

SEQ ID NO: 395 - protein, 9 aa, Artificial Sequence
  Synthetic Peptide
NVDQQNDMY

SEQ ID NO: 396 - protein, 9 aa, Artificial Sequence
  Synthetic Peptide
SSFFMNRFY

SEQ ID NO: 397 - protein, 9 aa, Artificial Sequence
  Synthetic Peptide
QAAESNERY

SEQ ID NO: 398 - protein, 9 aa, Artificial Sequence
  Synthetic Peptide
LEASISGKY

SEQ ID NO: 399 - protein, 9 aa, Artificial Sequence
  Synthetic Peptide
NLALLYGEY

SEQ ID NO: 400 - protein, 9 aa, Artificial Sequence
  Synthetic Peptide
SSPLFNNFY

SEQ ID NO: 401 - protein, 9 aa, Artificial Sequence
  Synthetic Peptide
QNADKNFLY

SEQ ID NO: 402 - protein, 9 aa, Artificial Sequence
  Synthetic Peptide
VSSIFISFY

SEQ ID NO: 403 - protein, 10 aa, Artificial Sequence
  Synthetic Peptide
SYKSSKRDKF

SEQ ID NO: 404 - protein, 10 aa, Artificial Sequence
  Synthetic Peptide
RYQDPQNYEL

SEQ ID NO: 405 - protein, 10 aa, Artificial Sequence
  Synthetic Peptide
DFFLKSKFNI

SEQ ID NO: 406 - protein, 9 aa, Artificial Sequence
  Synthetic Peptide
NYMKIMNHL

SEQ ID NO: 407 - protein, 9 aa, Artificial Sequence
  Synthetic Peptide
TYKKKNNHI

SEQ ID NO: 408 - protein, 9 aa, Artificial Sequence
  Synthetic Peptide
SFFMNRFYI

SEQ ID NO: 409 - protein, 9 aa, Artificial Sequence
  Synthetic Peptide
FYITTRYKY

SEQ ID NO: 410 - protein, 9 aa, Artificial Sequence
  Synthetic Peptide
KYINFINFI

SEQ ID NO: 411 - protein, 9 aa, Artificial Sequence
  Synthetic Peptide
TWKPTIFLL

SEQ ID NO: 412 - protein, 9 aa, Artificial Sequence
  Synthetic Peptide
KYNYFIHFF

SEQ ID NO: 413 - protein, 9 aa, Artificial Sequence
  Synthetic Peptide
HFFTWGTMF

SEQ ID NO: 414 - protein, 9 aa, Artificial Sequence
  Synthetic Peptide
RMTSLKNEL

SEQ ID NO: 415 - protein, 9 aa, Artificial Sequence
  Synthetic Peptide
YYNNFNNNY

SEQ ID NO: 416 - protein, 9 aa, Artificial Sequence
  Synthetic Peptide
  VARIANT 5, 8: Xaa = Any Amino Acid
GTDEXRNXY

SEQ ID NO: 417 - protein, 11 aa, Artificial Sequence
  Synthetic Peptide
  VARIANT 4, 5, 6: Xaa = Any Amino Acid
ETDXXXDRSEY

SEQ ID NO: 418 - protein, 10 aa, Artificial Sequence
  Synthetic Peptide
  VARIANT 7, 8: Xaa = Any Amino Acid
FTDVNSXXRY

SEQ ID NO: 419 - protein, 9 aa, Artificial Sequence
  Synthetic Peptide
  VARIANT 2, 7: Xaa = Any Amino Acid
VXDPYNXKY

SEQ ID NO: 420 - protein, 9 aa, Artificial Sequence
  Synthetic Peptide
  VARIANT 7: Xaa = Any Amino Acid
VADKVHXMY

SEQ ID NO: 421 - protein, 9 aa, Artificial Sequence
  Synthetic Peptide
  VARIANT 3, 4: Xaa = Any Amino Acid
ETXXPDWSY

SEQ ID NO: 422 - protein, 9 aa, Artificial Sequence
  Synthetic Peptide
  VARIANT 1, 5, 8: Xaa = Any Amino Acid
XTHNXVDXY

SEQ ID NO: 423 - protein, 10 aa, Artificial Sequence
  Synthetic Peptide
ILEQWVAGRK

SEQ ID NO: 424 - protein, 10 aa, Artificial Sequence
  Synthetic Peptide
LSAGGKNLSK

SEQ ID NO: 425 - protein, 11 aa, Artificial Sequence
  Synthetic Peptide
STDTVDTVLEK

SEQ ID NO: 426 - protein, 9 aa, Artificial Sequence
  Synthetic Peptide
GIAPLQLGK

SEQ ID NO: 427 - protein, 10 aa, Artificial Sequence
  Synthetic Peptide
VTAACSHAGK

SEQ ID NO: 428 - protein, 9 aa, Artificial Sequence
  Synthetic Peptide
GIHHPSNSK

SEQ ID NO: 429 - protein, 10 aa, Artificial Sequence
  Synthetic Peptide
RMNYYWTLLK

SEQ ID NO: 430 - protein, 11 aa, Artificial Sequence
  Synthetic Peptide
ITNKVNSVIEK

SEQ ID NO: 431 - protein, 11 aa, Artificial Sequence
  Synthetic Peptide
KMNIQFTAVGK

SEQ ID NO: 432 - protein, 9 aa, Artificial Sequence
  Synthetic Peptide
NIQFTAVGK

SEQ ID NO: 433 - protein, 11 aa, Artificial Sequence
  Synthetic Peptide
AVGKEFNKLEK

SEQ ID NO: 434 - protein, 11 aa, Artificial Sequence
  Synthetic Peptide
KVKSQLKNNAK

SEQ ID NO: 435 - protein, 11 aa, Artificial Sequence
  Synthetic Peptide
SVRNGTYDYPK

SEQ ID NO: 436 - protein, 9 aa, Artificial Sequence
  Synthetic Peptide
SIIPSGPLK

SEQ ID NO: 437 - protein, 10 aa, Artificial Sequence
  Synthetic Peptide
RMVLASTTAK

SEQ ID NO: 438 - protein, 9 aa, Artificial Sequence
  Synthetic Peptide
MVLASTTAK

SEQ ID NO: 439 - protein, 10 aa, Artificial Sequence
  Synthetic Peptide
RMGVQMQRFK

SEQ ID NO: 440 - protein, 10 aa, Artificial Sequence
  Synthetic Peptide
ATEIRASVGK

SEQ ID NO: 441 - protein, 11 aa, Artificial Sequence
  Synthetic Peptide
TMVMELVRMIK

SEQ ID NO: 442 - protein, 10 aa, Artificial Sequence
  Synthetic Peptide
RVLSFIKGTK

SEQ ID NO: 443 - protein, 9 aa, Artificial Sequence
  Synthetic Peptide
MSLQRQFLR

SEQ ID NO: 444 - protein, 9 aa, Artificial Sequence
  Synthetic Peptide
LLGPGRPYR

SEQ ID NO: 445 - protein, 9 aa, Artificial Sequence
  Synthetic Peptide
LLGPGRPYK

SEQ ID NO: 446 - protein, 8 aa, Artificial Sequence
  Synthetic Peptide
RVYPELPK

SEQ ID NO: 447 - protein, 8 aa, Artificial Sequence
  Synthetic Peptide
TVSAELPK

SEQ ID NO: 448 - protein, 8 aa, Artificial Sequence
  Synthetic Peptide
TVYAEPPK

SEQ ID NO: 449 - protein, 8 aa, Artificial Sequence
  Synthetic Peptide
TINYTLWR

SEQ ID NO: 450 - protein, 8 aa, Artificial Sequence
  Synthetic Peptide
LVHFLLLK

SEQ ID NO: 451 - protein, 8 aa, Artificial Sequence
  Synthetic Peptide
SVFAHPRK

SEQ ID NO: 452 - protein, 8 aa, Artificial Sequence
  Synthetic Peptide
KVLHHMVK

SEQ ID NO: 453 - protein, 8 aa, Artificial Sequence
  Synthetic Peptide
RVCACPGR

SEQ ID NO: 454 - protein, 8 aa, Artificial Sequence
  Synthetic Peptide
KMFCQLAK

SEQ ID NO: 455 - protein, 8 aa, Artificial Sequence
  Synthetic Peptide
RAHSSHLK

SEQ ID NO: 456 - protein, 9 aa, Artificial Sequence
  Synthetic Peptide
FVSNLATGR

SEQ ID NO: 457 - protein, 9 aa, Artificial Sequence
  Synthetic Peptide
RLQLSNGNK

SEQ ID NO: 458 - protein, 9 aa, Artificial Sequence
  Synthetic Peptide
RINGIPQQK

SEQ ID NO: 459 - protein, 9 aa, Artificial Sequence
  Synthetic Peptide
KIRKYTMRK

SEQ ID NO: 460 - protein, 9 aa, Artificial Sequence
  Synthetic Peptide
LVHFLLLKK

SEQ ID NO: 461 - protein, 9 aa, Artificial Sequence
  Synthetic Peptide
SMLEVFEGK

SEQ ID NO: 462 - protein, 9 aa, Artificial Sequence
  Synthetic Peptide
SSFSTTINK

SEQ ID NO: 463 - protein, 9 aa, Artificial Sequence
  Synthetic Peptide
TSYVKVLHK

SEQ ID NO: 464 - protein, 9 aa, Artificial Sequence
  Synthetic Peptide
VIFSKASEK

SEQ ID NO: 465 - protein, 9 aa, Artificial Sequence
  Synthetic Peptide
GSVVGNWQK

SEQ ID NO: 466 - protein, 9 aa, Artificial Sequence
  Synthetic Peptide
SSLPTTMNK

SEQ ID NO: 467 - protein, 9 aa, Artificial Sequence
  Synthetic Peptide
SVLEVFEGK

SEQ ID NO: 468 - protein, 9 aa, Artificial Sequence
  Synthetic Peptide
SSBMGGMNK

SEQ ID NO: 469 - protein, 9 aa, Artificial Sequence
  Synthetic Peptide
SSCMGGMNK

SEQ ID NO: 470 - protein, 10 aa, Artificial Sequence
  Synthetic Peptide
RTLTLFNVTK

SEQ ID NO: 471 - protein, 10 aa, Artificial Sequence
  Synthetic Peptide
TISPLNTSYK

SEQ ID NO: 472 - protein, 10 aa, Artificial Sequence
  Synthetic Peptide
STTINYTLWK

SEQ ID NO: 473 - protein, 10 aa, Artificial Sequence
  Synthetic Peptide
ASSLPTTMNK

SEQ ID NO: 474 - protein, 10 aa, Artificial Sequence
  Synthetic Peptide
KTYQGSYGFK

SEQ ID NO: 475 - protein, 10 aa, Artificial Sequence
  Synthetic Peptide
VVRRBPHHEK

SEQ ID NO: 476 - protein, 10 aa, Artificial Sequence
  Synthetic Peptide
GLAPPQHLIK

SEQ ID NO: 477 - protein, 10 aa, Artificial Sequence
  Synthetic Peptide
NSSCMGGMNK

SEQ ID NO: 478 - protein, 10 aa, Artificial Sequence
  Synthetic Peptide
SSBMGGMNRK

SEQ ID NO: 479 - protein, 10 aa, Artificial Sequence
  Synthetic Peptide
RVCACPGRDK

SEQ ID NO: 480 - protein, 11 aa, Artificial Sequence
  Synthetic Peptide
KTITVSAELPK

SEQ ID NO: 481 - protein, 11 aa, Artificial Sequence
  Synthetic Peptide
TTITVYAEPPK

SEQ ID NO: 482 - protein, 11 aa, Artificial Sequence
  Synthetic Peptide
PTISPSYTYYR

SEQ ID NO: 483 - protein, 11 aa, Artificial Sequence
  Synthetic Peptide
GLLGDNQVMPK

SEQ ID NO: 484 - protein, 11 aa, Artificial Sequence
  Synthetic Peptide
MVELVHFLLLK

SEQ ID NO: 485 - protein, 11 aa, Artificial Sequence
  Synthetic Peptide
FSTTINYTLWR

SEQ ID NO: 486 - protein, 11 aa, Artificial Sequence
  Synthetic Peptide
GLLGDNQIMPK

SEQ ID NO: 487 - protein, 11 aa, Artificial Sequence
  Synthetic Peptide
RLGFLHSGTAK

SEQ ID NO: 488 - protein, 11 aa, Artificial Sequence
  Synthetic Peptide
ALNKMFCQLAK

SEQ ID NO: 489 - protein, 11 aa, Artificial Sequence
  Synthetic Peptide
RVCACPGRDRR

SEQ ID NO: 490 - protein, 11 aa, Artificial Sequence
  Synthetic Peptide
LSQETFSDLWK

SEQ ID NO: 491 - protein, 11 aa, Artificial Sequence
  Synthetic Peptide
RAHSSHLKSKK

SEQ ID NO: 492 - protein, 11 aa, Artificial Sequence
  Synthetic Peptide
VTCTYSPALNK

SEQ ID NO: 493 - protein, 11 aa, Artificial Sequence
  Synthetic Peptide
GTRVRAMAIYK

SEQ ID NO: 494 - protein, 11 aa, Artificial Sequence
  Synthetic Peptide
STSRHKKLMFK

SEQ ID NO: 495 - protein, 9 aa, Artificial Sequence
  Synthetic Peptide
LAARNVLVK

SEQ ID NO: 496 - protein, 9 aa, Artificial Sequence
  Synthetic Peptide
MALESILRR

SEQ ID NO: 497 - protein, 10 aa, Artificial Sequence
  Synthetic Peptide
ISWLGLRSLR

SEQ ID NO: 498 - protein, 10 aa, Artificial Sequence
  Synthetic Peptide
GSGAFGTVYK

SEQ ID NO: 499 - protein, 10 aa, Artificial Sequence
  Synthetic Peptide
ASPLDSTFYR

SEQ ID NO: 500 - protein, 8 aa, Artificial Sequence
  Synthetic Peptide
SPGLSAGI

SEQ ID NO: 501 - protein, 8 aa, Artificial Sequence
  Synthetic Peptide
KPYDGIPA

SEQ ID NO: 502 - protein, 8 aa, Artificial Sequence
  Synthetic Peptide
KPYDGIPI

SEQ ID NO: 503 - protein, 8 aa, Artificial Sequence
  Synthetic Peptide
APRMPEAA

SEQ ID NO: 504 - protein, 8 aa, Artificial Sequence
  Synthetic Peptide
APRMPEAI

SEQ ID NO: 505 - protein, 8 aa, Artificial Sequence
  Synthetic Peptide
APAAPTPI

SEQ ID NO: 506 - protein, 8 aa, Artificial Sequence
  Synthetic Peptide
APTPAAPI

SEQ ID NO: 507 - protein, 8 aa, Artificial Sequence
  Synthetic Peptide
TPAAPAPI

SEQ ID NO: 508 - protein, 8 aa, Artificial Sequence
  Synthetic Peptide
APAPAPSI

SEQ ID NO: 509 - protein, 8 aa, Artificial Sequence
  Synthetic Peptide
SPALNKMF

SEQ ID NO: 510 - protein, 8 aa, Artificial Sequence
  Synthetic Peptide
SPALNKMI

SEQ ID NO: 511 - protein, 9 aa, Artificial Sequence
  Synthetic Peptide
SPSAPPHRI

SEQ ID NO: 512 - protein, 9 aa, Artificial Sequence
  Synthetic Peptide
PPHRWCIPI

SEQ ID NO: 513 - protein, 9 aa, Artificial Sequence
  Synthetic Peptide
GPAYSGREI

SEQ ID NO: 514 - protein, 11 aa, Artificial Sequence
  Synthetic Peptide
MPNQAQMRILI

SEQ ID NO: 515 - protein, 11 aa, Artificial Sequence
  Synthetic Peptide
MPYGCLLDHVI

SEQ ID NO: 516 - protein, 10 aa, Artificial Sequence
  Synthetic Peptide
APPHRWCIPW

SEQ ID NO: 517 - protein, 10 aa, Artificial Sequence
  Synthetic Peptide
APPHRWCIPI

SEQ ID NO: 518 - protein, 10 aa, Artificial Sequence
  Synthetic Peptide
IPWQRLLLTA

SEQ ID NO: 519 - protein, 10 aa, Artificial Sequence
  Synthetic Peptide
IPWQRLLLTI

SEQ ID NO: 520 - protein, 10 aa, Artificial Sequence
  Synthetic Peptide
LPQHLFGYSI

SEQ ID NO: 521 - protein, 11 aa, Artificial Sequence
  Synthetic Peptide
RPRFRELVSEF

SEQ ID NO: 522 - protein, 11 aa, Artificial Sequence
  Synthetic Peptide
RPRFRELVSEI

SEQ ID NO: 523 - protein, 11 aa, Artificial Sequence
  Synthetic Peptide
PPSPREGPLPA

SEQ ID NO: 524 - protein, 11 aa, Artificial Sequence
  Synthetic Peptide
PPSPREGPLPI

SEQ ID NO: 525 - protein, 11 aa, Artificial Sequence
  Synthetic Peptide
GPLPAARPAGA

SEQ ID NO: 526 - protein, 11 aa, Artificial Sequence
  Synthetic Peptide
GPLPAARPAGI

SEQ ID NO: 527 - protein, 11 aa, Artificial Sequence
  Synthetic Peptide
APAPAAPTPAA

SEQ ID NO: 528 - protein, 11 aa, Artificial Sequence
  Synthetic Peptide
APAPAAPTPAI

SEQ ID NO: 529 - protein, 11 aa, Artificial Sequence
  Synthetic Peptide
APAAPTPAAPA

SEQ ID NO: 530 - protein, 11 aa, Artificial Sequence
  Synthetic Peptide
APAAPTPAAPI

SEQ ID NO: 531 - protein, 8 aa, Artificial Sequence
  Synthetic Peptide
IPWQRLLI

SEQ ID NO: 532 - protein, 8 aa, Artificial Sequence
  Synthetic Peptide
LPQHLFGI

SEQ ID NO: 533 - protein, 8 aa, Artificial Sequence
  Synthetic Peptide
RPGVNLSI

SEQ ID NO: 534 - protein, 8 aa, Artificial Sequence
  Synthetic Peptide
IPQQHTQI

SEQ ID NO: 535 - protein, 8 aa, Artificial Sequence
  Synthetic Peptide
TPNNNGTI

SEQ ID NO: 536 - protein, 8 aa, Artificial Sequence
  Synthetic Peptide
CPLHNQEI

SEQ ID NO: 537 - protein, 8 aa, Artificial Sequence
  Synthetic Peptide
KPCARVCI

SEQ ID NO: 538 - protein, 8 aa, Artificial Sequence
  Synthetic Peptide
WPDSLPDI

SEQ ID NO: 539 - protein, 8 aa, Artificial Sequence
  Synthetic Peptide
SPYVSRLI

SEQ ID NO: 540 - protein, 8 aa, Artificial Sequence
  Synthetic Peptide
VPIKWMAI

SEQ ID NO: 541 - protein, 8 aa, Artificial Sequence
  Synthetic Peptide
RPRFRELI

SEQ ID NO: 542 - protein, 8 aa, Artificial Sequence
  Synthetic Peptide
APGAGGMI

SEQ ID NO: 543 - protein, 8 aa, Artificial Sequence
  Synthetic Peptide
SPGKNGVI

SEQ ID NO: 544 - protein, 8 aa, Artificial Sequence
  Synthetic Peptide
SPQGASSI

SEQ ID NO: 545 - protein, 8 aa, Artificial Sequence
  Synthetic Peptide
YPLWSQSI

SEQ ID NO: 546 - protein, 8 aa, Artificial Sequence
  Synthetic Peptide
SPLPSQAI

SEQ ID NO: 547 - protein, 8 aa, Artificial Sequence
  Synthetic Peptide
MPEAAPPI

SEQ ID NO: 548 - protein, 8 aa, Artificial Sequence
  Synthetic Peptide
APAPSWPI

SEQ ID NO: 549 - protein, 9 aa, Artificial Sequence
  Synthetic Peptide
KPVEDKDAI

SEQ ID NO: 550 - protein, 9 aa, Artificial Sequence
  Synthetic Peptide
IPQQHTQVI

SEQ ID NO: 551 - protein, 9 aa, Artificial Sequence
  Synthetic Peptide
APPVAPAPI

SEQ ID NO: 552 - protein, 9 aa, Artificial Sequence
  Synthetic Peptide
APAAPTPAI

SEQ ID NO: 553 - protein, 9 aa, Artificial Sequence
  Synthetic Peptide
PPGTRVRAI

SEQ ID NO: 554 - protein, 9 aa, Artificial Sequence
  Synthetic Peptide
APPQHLIRI

SEQ ID NO: 555 - protein, 10 aa, Artificial Sequence
  Synthetic Peptide
IPQQHTQVLI

SEQ ID NO: 556 - protein, 10 aa, Artificial Sequence
  Synthetic Peptide
SPGLSAGATI

SEQ ID NO: 557 - protein, 10 aa, Artificial Sequence
  Synthetic Peptide
SPMCKGSRCI

SEQ ID NO: 558 - protein, 10 aa, Artificial Sequence
  Synthetic Peptide
MPNPEGRYTI

SEQ ID NO: 559 - protein, 10 aa, Artificial Sequence
  Synthetic Peptide
CPLHNQEVTI

SEQ ID NO: 560 - protein, 10 aa, Artificial Sequence
  Synthetic Peptide
KPDLSYMPII

SEQ ID NO: 561 - protein, 10 aa, Artificial Sequence
  Synthetic Peptide
TPSGAMPNQI

SEQ ID NO: 562 - protein, 10 aa, Artificial Sequence
  Synthetic Peptide
GPASPLDSTI

SEQ ID NO: 563 - protein, 10 aa, Artificial Sequence
  Synthetic Peptide
APPVAPAPAI

SEQ ID NO: 564 - protein, 10 aa, Artificial Sequence
  Synthetic Peptide
APAPAAPTPI

SEQ ID NO: 565 - protein, 10 aa, Artificial Sequence
  Synthetic Peptide
APTPAAPAPI

SEQ ID NO: 566 - protein, 10 aa, Artificial Sequence
  Synthetic Peptide
APSWPLSSSI

SEQ ID NO: 567 - protein, 11 aa, Artificial Sequence
  Synthetic Peptide
APTISPLNTSI

SEQ ID NO: 568 - protein, 11 aa, Artificial Sequence
  Synthetic Peptide
SPSYTYYRPGI

SEQ ID NO: 569 - protein, 11 aa, Artificial Sequence
  Synthetic Peptide
CPSGVKPDLSI

SEQ ID NO: 570 - protein, 11 aa, Artificial Sequence
  Synthetic Peptide
SPLTSIISAVI

SEQ ID NO: 571 - protein, 11 aa, Artificial Sequence
  Synthetic Peptide
IPDGENVKIPI

SEQ ID NO: 572 - protein, 11 aa, Artificial Sequence
  Synthetic Peptide
SPLDSTFYRSI

SEQ ID NO: 573 - protein, 11 aa, Artificial Sequence
  Synthetic Peptide
LPAARPAGATI

SEQ ID NO: 574 - protein, 11 aa, Artificial Sequence
  Synthetic Peptide
HPRKLLMQDLI

SEQ ID NO: 575 - protein, 11 aa, Artificial Sequence
  Synthetic Peptide
GPRALIETSYI

SEQ ID NO: 576 - protein, 11 aa, Artificial Sequence
  Synthetic Peptide
GPRALVETSYI

SEQ ID NO: 577 - protein, 11 aa, Artificial Sequence
  Synthetic Peptide
APRMPEAAPPI

SEQ ID NO: 578 - protein, 11 aa, Artificial Sequence
  Synthetic Peptide
VPSQKTYQGSI

SEQ ID NO: 579 - protein, 9 aa, Artificial Sequence
  Synthetic Peptide
FPHCLAFAY

SEQ ID NO: 580 - protein, 9 aa, Artificial Sequence
  Synthetic Peptide
FPVCLAFSY

SEQ ID NO: 581 - protein, 11 aa, Artificial Sequence
  Synthetic Peptide
YPALMPLYACI

SEQ ID NO: 582 - protein, 9 aa, Artificial Sequence
  Synthetic Peptide
FPFKYAAAV

SEQ ID NO: 583 - protein, 9 aa, Artificial Sequence
  Synthetic Peptide
AMAKAAAAV

SEQ ID NO: 584 - protein, 9 aa, Artificial Sequence
  Synthetic Peptide
AMAKAAAAL

SEQ ID NO: 585 - protein, 9 aa, Artificial Sequence
  Synthetic Peptide
AMAKAAAAT

SEQ ID NO: 586 - protein, 9 aa, Artificial Sequence
  Synthetic Peptide
  VARIANT 2: Xaa = Any Amino Acid
AXAKAAAAL

SEQ ID NO: 587 - protein, 10 aa, Artificial Sequence
  Synthetic Peptide
FVYGGSKTSL

SEQ ID NO: 588 - protein, 8 aa, Artificial Sequence
  Synthetic Peptide
ILGPGPGL

SEQ ID NO: 589 - protein, 9 aa, Artificial Sequence
  Synthetic Peptide
GILGFVFTL

SEQ ID NO: 590 - protein, 10 aa, Artificial Sequence
  Synthetic Peptide
GLIYNRMGAV

SEQ ID NO: 591 - protein, 11 aa, Artificial Sequence
  Synthetic Peptide
VLMEWLKTRPI

SEQ ID NO: 592 - protein, 10 aa, Artificial Sequence
  Synthetic Peptide
FLPSDYFPSV

SEQ ID NO: 593 - protein, 10 aa, Artificial Sequence
  Synthetic Peptide
FLGPGPGPSV

SEQ ID NO: 594 - protein, 10 aa, Artificial Sequence
  Synthetic Peptide
FLPGPGPGSV

SEQ ID NO: 595 - protein, 10 aa, Artificial Sequence
  Synthetic Peptide
FLPSGPGPGV

SEQ ID NO: 596 - protein, 9 aa, Artificial Sequence
  Synthetic Peptide
WLGPGPGFV

SEQ ID NO: 597 - protein, 9 aa, Artificial Sequence
  Synthetic Peptide
WLSGPGPGV

SEQ ID NO: 598 - protein, 9 aa, Artificial Sequence
  Synthetic Peptide
GVLGWSPQV

SEQ ID NO: 599 - protein, 9 aa, Artificial Sequence
  Synthetic Peptide
PVLPIFFCV

SEQ ID NO: 600 - protein, 9 aa, Artificial Sequence
  Synthetic Peptide
VVQAGFFLV

SEQ ID NO: 601 - protein, 10 aa, Artificial Sequence
  Synthetic Peptide
FLLAQFTSAI

SEQ ID NO: 602 - protein, 10 aa, Artificial Sequence
  Synthetic Peptide
YLLTLWKAGI

SEQ ID NO: 603 - protein, 10 aa, Artificial Sequence
  Synthetic Peptide
YLGPGPGAGI

SEQ ID NO: 604 - protein, 10 aa, Artificial Sequence
  Synthetic Peptide
YLLGPGPGGI

SEQ ID NO: 605 - protein, 10 aa, Artificial Sequence
  Synthetic Peptide
YLLTGPGPGI

SEQ ID NO: 606 - protein, 9 aa, Artificial Sequence
  Synthetic Peptide
HVYSHPIIV

SEQ ID NO: 607 - protein, 9 aa, Artificial Sequence
  Synthetic Peptide
FVLSLGIHV

SEQ ID NO: 608 - protein, 9 aa, Artificial Sequence
  Synthetic Peptide
YVDDVVLGV

SEQ ID NO: 609 - protein, 10 aa, Artificial Sequence
  Synthetic Peptide
IVRGTSFVYV

SEQ ID NO: 610 - protein, 10 aa, Artificial Sequence
  Synthetic Peptide
SLGPGPGIAV

SEQ ID NO: 611 - protein, 10 aa, Artificial Sequence
  Synthetic Peptide
SLLGPGPGAV

SEQ ID NO: 612 - protein, 10 aa, Artificial Sequence
  Synthetic Peptide
SLLNGPGPGV

SEQ ID NO: 613 - protein, 9 aa, Artificial Sequence
  Synthetic Peptide
KITPLCVTL

SEQ ID NO: 614 - protein, 9 aa, Artificial Sequence
  Synthetic Peptide
KLTPLCVTM

SEQ ID NO: 615 - protein, 9 aa, Artificial Sequence
  Synthetic Peptide
KLTPLCVPL

SEQ ID NO: 616 - protein, 9 aa, Artificial Sequence
  Synthetic Peptide
KLTPLCVSL

SEQ ID NO: 617 - protein, 9 aa, Artificial Sequence
  Synthetic Peptide
KLTPLCITL

SEQ ID NO: 618 - protein, 9 aa, Artificial Sequence
  Synthetic Peptide
QLTPLCVTL

SEQ ID NO: 619 - protein, 9 aa, Artificial Sequence
  Synthetic Peptide
KLTPRCVTL

SEQ ID NO: 620 - protein, 9 aa, Artificial Sequence
  Synthetic Peptide
ELTPLCVTL

SEQ ID NO: 621 - protein, 9 aa, Artificial Sequence
  Synthetic Peptide
QMTFLCVQM

SEQ ID NO: 622 - protein, 9 aa, Artificial Sequence
  Synthetic Peptide
KMTFLCVQM

SEQ ID NO: 623 - protein, 9 aa, Artificial Sequence
  Synthetic Peptide
KLTPLCVAL

SEQ ID NO: 624 - protein, 9 aa, Artificial Sequence
  Synthetic Peptide
KLTPFCVTL

SEQ ID NO: 625 - protein, 9 aa, Artificial Sequence
  Synthetic Peptide
SLYNTVATL

SEQ ID NO: 626 - protein, 9 aa, Artificial Sequence
  Synthetic Peptide
VLAEAMSQT

SEQ ID NO: 627 - protein, 9 aa, Artificial Sequence
  Synthetic Peptide
VLAEAMSQA

SEQ ID NO: 628 - protein, 9 aa, Artificial Sequence
  Synthetic Peptide
VLAEAMSQI

SEQ ID NO: 629 - protein, 9 aa, Artificial Sequence
  Synthetic Peptide
ILAEAMSQV

SEQ ID NO: 630 - protein, 9 aa, Artificial Sequence
  Synthetic Peptide
VLAEAMSKV

SEQ ID NO: 631 - protein, 9 aa, Artificial Sequence
  Synthetic Peptide
VLAEAMSHA

SEQ ID NO: 632 - protein, 9 aa, Artificial Sequence
  Synthetic Peptide
ILAEAMSQA

SEQ ID NO: 633 - protein, 9 aa, Artificial Sequence
  Synthetic Peptide
VLAEAMSRA

SEQ ID NO: 634 - protein, 9 aa, Artificial Sequence
  Synthetic Peptide
VLAEAMATA

SEQ ID NO: 635 - protein, 9 aa, Artificial Sequence
  Synthetic Peptide
ILAEAMASA

SEQ ID NO: 636 - protein, 9 aa, Artificial Sequence
  Synthetic Peptide
MTHNPPIPV

SEQ ID NO: 637 - protein, 9 aa, Artificial Sequence
  Synthetic Peptide
MTNNPPVPV

SEQ ID NO: 638 - protein, 9 aa, Artificial Sequence
  Synthetic Peptide
MTSNPPIPV

SEQ ID NO: 639 - protein, 9 aa, Artificial Sequence
  Synthetic Peptide
MTSNPPVPV

SEQ ID NO: 640 - protein, 9 aa, Artificial Sequence
  Synthetic Peptide
MTSDPPIPV

SEQ ID NO: 641 - protein, 9 aa, Artificial Sequence
  Synthetic Peptide
MTGNPPIPV

SEQ ID NO: 642 - protein, 9 aa, Artificial Sequence
  Synthetic Peptide
MTGNPPVPV

SEQ ID NO: 643 - protein, 9 aa, Artificial Sequence
  Synthetic Peptide
MTGNPAIPV

SEQ ID NO: 644 - protein, 9 aa, Artificial Sequence
  Synthetic Peptide
MTGNPSIPV

SEQ ID NO: 645 - protein, 9 aa, Artificial Sequence
  Synthetic Peptide
MTANPPVPV

SEQ ID NO: 646 - protein, 9 aa, Artificial Sequence
  Synthetic Peptide
SLYNTVATL

SEQ ID NO: 647 - protein, 9 aa, Artificial Sequence
  Synthetic Peptide
QAHCNISRA

SEQ ID NO: 648 - protein, 8 aa, Artificial Sequence
  Synthetic Peptide
FLKEKGGV

SEQ ID NO: 649 - protein, 9 aa, Artificial Sequence
  Synthetic Peptide
GLGAVSRDL

SEQ ID NO: 650 - protein, 9 aa, Artificial Sequence
  Synthetic Peptide
GLITSSNTA

SEQ ID NO: 651 - protein, 11 aa, Artificial Sequence
  Synthetic Peptide
ALEEEEVGFPV

SEQ ID NO: 652 - protein, 11 aa, Artificial Sequence
  Synthetic Peptide
FLKEKGGLEGV

SEQ ID NO: 653 - protein, 11 aa, Artificial Sequence
  Synthetic Peptide
FLKEKGGLDGV

SEQ ID NO: 654 - protein, 11 aa, Artificial Sequence
  Synthetic Peptide
GLIYSKKRQEV

SEQ ID NO: 655 - protein, 10 aa, Artificial Sequence
  Synthetic Peptide
LLYSKKRQEI

SEQ ID NO: 656 - protein, 11 aa, Artificial Sequence
  Synthetic Peptide
LLYSKKRQEIL

SEQ ID NO: 657 - protein, 9 aa, Artificial Sequence
  Synthetic Peptide
RLDILDLWV

SEQ ID NO: 658 - protein, 10 aa, Artificial Sequence
  Synthetic Peptide
EILDLWVYHV

SEQ ID NO: 659 - protein, 9 aa, Artificial Sequence
  Synthetic Peptide
ILDLWVYHV

SEQ ID NO: 660 - protein, 9 aa, Artificial Sequence
  Synthetic Peptide
ILDLWVYNV

SEQ ID NO: 661 - protein, 10 aa, Artificial Sequence
  Synthetic Peptide
WLNYTPGPGT

SEQ ID NO: 662 - protein, 10 aa, Artificial Sequence
  Synthetic Peptide
WQNYTPGPGV

SEQ ID NO: 663 - protein, 10 aa, Artificial Sequence
  Synthetic Peptide
WLNYTPGPGI

SEQ ID NO: 664 - protein, 11 aa, Artificial Sequence
  Synthetic Peptide
YLPGPGIRYPL

SEQ ID NO: 665 - protein, 11 aa, Artificial Sequence
  Synthetic Peptide
YTPGPGIRYPV

SEQ ID NO: 666 - protein, 9 aa, Artificial Sequence
  Synthetic Peptide
LLFGWCFKL

SEQ ID NO: 667 - protein, 9 aa, Artificial Sequence
  Synthetic Peptide
LTFGWCFKV

SEQ ID NO: 668 - protein, 10 aa, Artificial Sequence
  Synthetic Peptide
LLFGWCFKLV

SEQ ID NO: 669 - protein, 9 aa, Artificial Sequence
  Synthetic Peptide
FGVRPQVPL

SEQ ID NO: 670 - protein, 9 aa, Artificial Sequence
  Synthetic Peptide
FTVRPQVPL

SEQ ID NO: 671 - protein, 9 aa, Artificial Sequence
  Synthetic Peptide
FSVRPQVPL

SEQ ID NO: 672 - protein, 9 aa, Artificial Sequence
  Synthetic Peptide
YLKEPVHGV

SEQ ID NO: 673 - protein, 9 aa, Artificial Sequence
  Synthetic Peptide
FLKEPVHGV

SEQ ID NO: 674 - protein, 9 aa, Artificial Sequence
  Synthetic Peptide
PVPLQLPPV

SEQ ID NO: 675 - protein, 9 aa, Artificial Sequence
  Synthetic Peptide
LQLPPLERV

SEQ ID NO: 676 - protein, 11 aa, Artificial Sequence
  Synthetic Peptide
LLLPPLERLTL

SEQ ID NO: 677 - protein, 11 aa, Artificial Sequence
  Synthetic Peptide
LQLPPLERLTV

SEQ ID NO: 678 - protein, 8 aa, Artificial Sequence
  Synthetic Peptide
ILWQVDRM

SEQ ID NO: 679 - protein, 8 aa, Artificial Sequence
  Synthetic Peptide
KLGSLQYL

SEQ ID NO: 680 - protein, 8 aa, Artificial Sequence
  Synthetic Peptide
KVGSLQYV

SEQ ID NO: 681 - protein, 9 aa, Artificial Sequence
  Synthetic Peptide
TLHDLCQAV

SEQ ID NO: 682 - protein, 9 aa, Artificial Sequence
  Synthetic Peptide
TLQDIVLHL

SEQ ID NO: 683 - protein, 9 aa, Artificial Sequence
  Synthetic Peptide
TLGPGPGHL

SEQ ID NO: 684 - protein, 9 aa, Artificial Sequence
  Synthetic Peptide
TLQGPGPGL

SEQ ID NO: 685 - protein, 10 aa, Artificial Sequence
  Synthetic Peptide
TLSFVCPWCV

SEQ ID NO: 686 - protein, 10 aa, Artificial Sequence
  Synthetic Peptide
TLSFVCPWCA

SEQ ID NO: 687 - protein, 9 aa, Artificial Sequence
  Synthetic Peptide
RTLHDLCQA

SEQ ID NO: 688 - protein, 9 aa, Artificial Sequence
  Synthetic Peptide
TLHDLCQAL

SEQ ID NO: 689 - protein, 9 aa, Artificial Sequence
  Synthetic Peptide
YLSGADLNL

SEQ ID NO: 690 - protein, 9 aa, Artificial Sequence
  Synthetic Peptide
YLEPGPVTA

SEQ ID NO: 691 - protein, 10 aa, Artificial Sequence
  Synthetic Peptide
LLDGTATLRL

SEQ ID NO: 692 - protein, 9 aa, Artificial Sequence
  Synthetic Peptide
KVYGLSAFV

SEQ ID NO: 693 - protein, 9 aa, Artificial Sequence
  Synthetic Peptide
IISAVVAIL

SEQ ID NO: 694 - protein, 9 aa, Artificial Sequence
  Synthetic Peptide
ILSAVVGIL

SEQ ID NO: 695 - protein, 9 aa, Artificial Sequence
  Synthetic Peptide
IISAVVGFL

SEQ ID NO: 696 - protein, 9 aa, Artificial Sequence
  Synthetic Peptide
IISAVVGIV

SEQ ID NO: 697 - protein, 9 aa, Artificial Sequence
  Synthetic Peptide
KISAVVGIL

SEQ ID NO: 698 - protein, 9 aa, Artificial Sequence
  Synthetic Peptide
KIFAVVGIL

SEQ ID NO: 699 - protein, 9 aa, Artificial Sequence
  Synthetic Peptide
KIFASVAIL

SEQ ID NO: 700 - protein, 9 aa, Artificial Sequence
  Synthetic Peptide
ELVSEFSRV

SEQ ID NO: 701 - protein, 9 aa, Artificial Sequence
  Synthetic Peptide
VLVHPQWVV

SEQ ID NO: 702 - protein, 11 aa, Artificial Sequence
  Synthetic Peptide
VLVHPQWVLTV

SEQ ID NO: 703 - protein, 11 aa, Artificial Sequence
  Synthetic Peptide
DLMLLRLSEPV

SEQ ID NO: 704 - protein, 11 aa, Artificial Sequence
  Synthetic Peptide
PLVCNGVLQGV

SEQ ID NO: 705 - protein, 11 aa, Artificial Sequence
  Synthetic Peptide
VLVHPQWVLTV

SEQ ID NO: 706 - protein, 11 aa, Artificial Sequence
  Synthetic Peptide
PLVCNGVLQGV

SEQ ID NO: 707 - protein, 11 aa, Artificial Sequence
  Synthetic Peptide
QLGPGPGLMEV

SEQ ID NO: 708 - protein, 11 aa, Artificial Sequence
  Synthetic Peptide
QLVGPGPGMEV

SEQ ID NO: 709 - protein, 11 aa, Artificial Sequence
  Synthetic Peptide
QLVFGPGPGEV

SEQ ID NO: 710 - protein, 11 aa, Artificial Sequence
  Synthetic Peptide
QLVFGGPGPGV

SEQ ID NO: 711 - protein, 9 aa, Artificial Sequence
  Synthetic Peptide
ALGIGILTV

SEQ ID NO: 712 - protein, 9 aa, Artificial Sequence
  Synthetic Peptide
AMGIGILTV

SEQ ID NO: 713 - protein, 8 aa, Artificial Sequence
  Synthetic Peptide
LLWQPIPV

SEQ ID NO: 714 - protein, 8 aa, Artificial Sequence
  Synthetic Peptide
LLGPGPGV

SEQ ID NO: 715 - protein, 11 aa, Artificial Sequence
  Synthetic Peptide
VLAKELKFVTL

SEQ ID NO: 716 - protein, 11 aa, Artificial Sequence
  Synthetic Peptide
VLGPGPGFVTL

SEQ ID NO: 717 - protein, 11 aa, Artificial Sequence
  Synthetic Peptide
VLAGPGPGVTL

SEQ ID NO: 718 - protein, 11 aa, Artificial Sequence
  Synthetic Peptide
VLAKGPGPGTL

SEQ ID NO: 719 - protein, 11 aa, Artificial Sequence
  Synthetic Peptide
VLAKEGPGPGL

SEQ ID NO: 720 - protein, 9 aa, Artificial Sequence
  Synthetic Peptide
TLMSAMTNV

SEQ ID NO: 721 - protein, 10 aa, Artificial Sequence
  Synthetic Peptide
ILYSAHDTTV

SEQ ID NO: 722 - protein, 10 aa, Artificial Sequence
  Synthetic Peptide
IVYSAHDTTV

SEQ ID NO: 723 - protein, 9 aa, Artificial Sequence
  Synthetic Peptide
VTAKELKFV

SEQ ID NO: 724 - protein, 10 aa, Artificial Sequence
  Synthetic Peptide
ITYSAHDTTV

SEQ ID NO: 725 - protein, 9 aa, Artificial Sequence
  Synthetic Peptide
SLSLGFLFV

SEQ ID NO: 726 - protein, 10 aa, Artificial Sequence
  Synthetic Peptide
SLSLGFLFLV

SEQ ID NO: 727 - protein, 10 aa, Artificial Sequence
  Synthetic Peptide
LLALFPPEGV

SEQ ID NO: 728 - protein, 10 aa, Artificial Sequence
  Synthetic Peptide
LVALFPPEGV

SEQ ID NO: 729 - protein, 10 aa, Artificial Sequence
  Synthetic Peptide
ALFPPEGVSV

SEQ ID NO: 730 - protein, 10 aa, Artificial Sequence
  Synthetic Peptide
GLHGQDLFGV

SEQ ID NO: 731 - protein, 10 aa, Artificial Sequence
  Synthetic Peptide
LLPPYASCHV

SEQ ID NO: 732 - protein, 10 aa, Artificial Sequence
  Synthetic Peptide
LLWQPIPVHV

SEQ ID NO: 733 - protein, 9 aa, Artificial Sequence
  Synthetic Peptide
MLLRLSEPV

SEQ ID NO: 734 - protein, 8 aa, Artificial Sequence
  Synthetic Peptide
ALGTTCYV

SEQ ID NO: 735 - protein, 10 aa, Artificial Sequence
  Synthetic Peptide
VLRLFVCFLI

SEQ ID NO: 736 - protein, 10 aa, Artificial Sequence
  Synthetic Peptide
FLIFHFFLFL

SEQ ID NO: 737 - protein, 10 aa, Artificial Sequence
  Synthetic Peptide
LIFHFFLFLL

SEQ ID NO: 738 - protein, 10 aa, Artificial Sequence
  Synthetic Peptide
FLFLLYILFL

SEQ ID NO: 739 - protein, 10 aa, Artificial Sequence
  Synthetic Peptide
RLPVICSFLV

SEQ ID NO: 740 - protein, 10 aa, Artificial Sequence
  Synthetic Peptide
VICSFLVFLV

SEQ ID NO: 741 - protein, 10 aa, Artificial Sequence
  Synthetic Peptide
FLVFLVFSNV

SEQ ID NO: 742 - protein, 10 aa, Artificial Sequence
  Synthetic Peptide
MMIMIKFMGV

SEQ ID NO: 743 - protein, 9 aa, Artificial Sequence
  Synthetic Peptide
FLLYILFLV

SEQ ID NO: 744 - protein, 9 aa, Artificial Sequence
  Synthetic Peptide
VICSFLVFL

SEQ ID NO: 745 - protein, 9 aa, Artificial Sequence
  Synthetic Peptide
ATYGIIVPV

SEQ ID NO: 746 - protein, 9 aa, Artificial Sequence
  Synthetic Peptide
KIYKIIIWI

SEQ ID NO: 747 - protein, 9 aa, Artificial Sequence
  Synthetic Peptide
YMIKKLLKI

SEQ ID NO: 748 - protein, 9 aa, Artificial Sequence
  Synthetic Peptide
LMTLYQIQV

SEQ ID NO: 749 - protein, 9 aa, Artificial Sequence
  Synthetic Peptide
FMGVIYIMI

SEQ ID NO: 750 - protein, 9 aa, Artificial Sequence
  Synthetic Peptide
FMNRFYITT

SEQ ID NO: 751 - protein, 9 aa, Artificial Sequence
  Synthetic Peptide
YQDPQNYEL

SEQ ID NO: 752 - protein, 9 aa, Artificial Sequence
  Synthetic Peptide
KTWKPTIFL

SEQ ID NO: 753 - protein, 9 aa, Artificial Sequence
  Synthetic Peptide
LLNESNIFL

SEQ ID NO: 754 - protein, 9 aa, Artificial Sequence
  Synthetic Peptide
FIHFFTWGT

SEQ ID NO: 755 - protein, 9 aa, Artificial Sequence
  Synthetic Peptide
VLFLQMMNV

SEQ ID NO: 756 - protein, 9 aa, Artificial Sequence
  Synthetic Peptide
NQMIFVSSI

SEQ ID NO: 757 - protein, 9 aa, Artificial Sequence
  Synthetic Peptide
MIFVSSIFI

SEQ ID NO: 758 - protein, 9 aa, Artificial Sequence
  Synthetic Peptide
SIFISFYLI

SEQ ID NO: 759 - protein, 9 aa, Artificial Sequence
  Synthetic Peptide
RLFEESLGI

SEQ ID NO: 760 - protein, 9 aa, Artificial Sequence
  Synthetic Peptide
ALWGFFPVL

SEQ ID NO: 761 - protein, 9 aa, Artificial Sequence
  Synthetic Peptide
SVYDFFVWL

SEQ ID NO: 762 - protein, 9 aa, Artificial Sequence
  Synthetic Peptide
FAPGFFPYL

SEQ ID NO: 763 - protein, 9 aa, Artificial Sequence
  Synthetic Peptide
QLFEDKYAL

SEQ ID NO: 764 - protein, 9 aa, Artificial Sequence
  Synthetic Peptide
MLLSVPLLL

SEQ ID NO: 765 - protein, 9 aa, Artificial Sequence
  Synthetic Peptide
ALNAAAAAK

SEQ ID NO: 766 - protein, 9 aa, Artificial Sequence
  Synthetic Peptide
ALAAGAAAK

SEQ ID NO: 767 - protein, 9 aa, Artificial Sequence
  Synthetic Peptide
ALQAAAAAK

SEQ ID NO: 768 - protein, 11 aa, Artificial Sequence
  Synthetic Peptide
STGPGPGVVRR

SEQ ID NO: 769 - protein, 11 aa, Artificial Sequence
  Synthetic Peptide
STLGPGPGVRR

SEQ ID NO: 770 - protein, 11 aa, Artificial Sequence
  Synthetic Peptide
STLPGPGPGRR

SEQ ID NO: 771 - protein, 11 aa, Artificial Sequence
  Synthetic Peptide
STLPEGPGPGR

SEQ ID NO: 772 - protein, 9 aa, Artificial Sequence
  Synthetic Peptide
QAGFFLLTR

SEQ ID NO: 773 - protein, 9 aa, Artificial Sequence
  Synthetic Peptide
RVHFASPLH

SEQ ID NO: 774 - protein, 9 aa, Artificial Sequence
  Synthetic Peptide
AAYAAQGYK

SEQ ID NO: 775 - protein, 9 aa, Artificial Sequence
  Synthetic Peptide
KSKFGYGAK

SEQ ID NO: 776 - protein, 10 aa, Artificial Sequence
  Synthetic Peptide
PAAYAAQGYK

SEQ ID NO: 777 - protein, 9 aa, Artificial Sequence
  Synthetic Peptide
RMYVGGVEH

SEQ ID NO: 778 - protein, 9 aa, Artificial Sequence
  Synthetic Peptide
SQLSAPSLK

SEQ ID NO: 779 - protein, 10 aa, Artificial Sequence
  Synthetic Peptide
TSCGNTLTCY

SEQ ID NO: 780 - protein, 11 aa, Artificial Sequence
  Synthetic Peptide
VTGPGPGPVWK

SEQ ID NO: 781 - protein, 11 aa, Artificial Sequence
  Synthetic Peptide
VTVGPGPGVWK

SEQ ID NO: 782 - protein, 11 aa, Artificial Sequence
  Synthetic Peptide
VTVYGPGPGWK

SEQ ID NO: 783 - protein, 11 aa, Artificial Sequence
  Synthetic Peptide
VTVYYGPGPGK

SEQ ID NO: 784 - protein, 9 aa, Artificial Sequence
  Synthetic Peptide
PVRPQVPLR

SEQ ID NO: 785 - protein, 10 aa, Artificial Sequence
  Synthetic Peptide
HGAITSSNTK

SEQ ID NO: 786 - protein, 9 aa, Artificial Sequence
  Synthetic Peptide
AVDLSFFLK

SEQ ID NO: 787 - protein, 9 aa, Artificial Sequence
  Synthetic Peptide
DVSHFLKEK

SEQ ID NO: 788 - protein, 10 aa, Artificial Sequence
  Synthetic Peptide
GVLDGLIYSK

SEQ ID NO: 789 - protein, 9 aa, Artificial Sequence
  Synthetic Peptide
GVDGLIYSK

SEQ ID NO: 790 - protein, 9 aa, Artificial Sequence
  Synthetic Peptide
EILDLWVYK

SEQ ID NO: 791 - protein, 8 aa, Artificial Sequence
  Synthetic Peptide
ILDLWVYK

SEQ ID NO: 792 - protein, 11 aa, Artificial Sequence
  Synthetic Peptide
RVPLTFGWCFK

SEQ ID NO: 793 - protein, 10 aa, Artificial Sequence
  Synthetic Peptide
QVYTPGPGTR

SEQ ID NO: 794 - protein, 9 aa, Artificial Sequence
  Synthetic Peptide
AVGPGPGLK

SEQ ID NO: 795 - protein, 9 aa, Artificial Sequence
  Synthetic Peptide
AVDGPGPGK

SEQ ID NO: 796 - protein, 10 aa, Artificial Sequence
  Synthetic Peptide
QMGPGPGNFK

SEQ ID NO: 797 - protein, 10 aa, Artificial Sequence
  Synthetic Peptide
QMAGPGPGFK

SEQ ID NO: 798 - protein, 10 aa, Artificial Sequence
  Synthetic Peptide
QMAVGPGPGK

SEQ ID NO: 799 - protein, 10 aa, Artificial Sequence
  Synthetic Peptide
TVGPGPGPEK

SEQ ID NO: 800 - protein, 10 aa, Artificial Sequence
  Synthetic Peptide
TVQGPGPGEK

SEQ ID NO: 801 - protein, 10 aa, Artificial Sequence
  Synthetic Peptide
TVQPGPGPGK

SEQ ID NO: 802 - protein, 10 aa, Artificial Sequence
  Synthetic Peptide
VAIKIGGQLK

SEQ ID NO: 803 - protein, 10 aa, Artificial Sequence
  Synthetic Peptide
VTVKIGGQLK

SEQ ID NO: 804 - protein, 10 aa, Artificial Sequence
  Synthetic Peptide
VTIKVGGQLK

SEQ ID NO: 805 - protein, 10 aa, Artificial Sequence
  Synthetic Peptide
VTIRIGGQLK

SEQ ID NO: 806 - protein, 10 aa, Artificial Sequence
  Synthetic Peptide
VTVRIGGQLK

SEQ ID NO: 807 - protein, 10 aa, Artificial Sequence
  Synthetic Peptide
VTVKVGGQLK

SEQ ID NO: 808 - protein, 10 aa, Artificial Sequence
  Synthetic Peptide
VTIRVGGQLK

SEQ ID NO: 809 - protein, 10 aa, Artificial Sequence
  Synthetic Peptide
VTVRVGGQLK

SEQ ID NO: 810 - protein, 10 aa, Artificial Sequence
  Synthetic Peptide
VTVKIGGQLR

SEQ ID NO: 811 - protein, 10 aa, Artificial Sequence
  Synthetic Peptide
VTIRIGGQLR

SEQ ID NO: 812 - protein, 10 aa, Artificial Sequence
  Synthetic Peptide
VTIKLGGQIR

SEQ ID NO: 813 - protein, 10 aa, Artificial Sequence
  Synthetic Peptide
VSIKVGGQIK

SEQ ID NO: 814 - protein, 10 aa, Artificial Sequence
  Synthetic Peptide
VSIRVGGQIK

SEQ ID NO: 815 - protein, 10 aa, Artificial Sequence
  Synthetic Peptide
VTVKIEGQLK

SEQ ID NO: 816 - protein, 10 aa, Artificial Sequence
  Synthetic Peptide
VTIKIEGQLK

SEQ ID NO: 817 - protein, 10 aa, Artificial Sequence
  Synthetic Peptide
VTVKIEGQLR

SEQ ID NO: 818 - protein, 10 aa, Artificial Sequence
  Synthetic Peptide
VSIRVGGQTK

SEQ ID NO: 819 - protein, 10 aa, Artificial Sequence
  Synthetic Peptide
VSIRVGGQTR

SEQ ID NO: 820 - protein, 10 aa, Artificial Sequence
  Synthetic Peptide
VTVRIGGMQK

SEQ ID NO: 821 - protein, 10 aa, Artificial Sequence
  Synthetic Peptide
ITVKIGKEVR

SEQ ID NO: 822 - protein, 9 aa, Artificial Sequence
  Synthetic Peptide
GTRQARRNK

SEQ ID NO: 823 - protein, 10 aa, Artificial Sequence
  Synthetic Peptide
GTRQARRNRK

SEQ ID NO: 824 - protein, 11 aa, Artificial Sequence
  Synthetic Peptide
GTRQARRNRRK

SEQ ID NO: 825 - protein, 9 aa, Artificial Sequence
  Synthetic Peptide
GTRQTRKNK

SEQ ID NO: 826 - protein, 10 aa, Artificial Sequence
  Synthetic Peptide
GTRQTRKNRK

SEQ ID NO: 827 - protein, 11 aa, Artificial Sequence
  Synthetic Peptide
GTRQTRKNRRK

SEQ ID NO: 828 - protein, 10 aa, Artificial Sequence
  Synthetic Peptide
RVRRRRWRAR

SEQ ID NO: 829 - protein, 10 aa, Artificial Sequence
  Synthetic Peptide
KVRRRRWRAR

SEQ ID NO: 830 - protein, 8 aa, Artificial Sequence
  Synthetic Peptide
LTISYGRK

SEQ ID NO: 831 - protein, 9 aa, Artificial Sequence
  Synthetic Peptide
KTLGISYGR

SEQ ID NO: 832 - protein, 9 aa, Artificial Sequence
  Synthetic Peptide
LTISYGRKK

SEQ ID NO: 833 - protein, 9 aa, Artificial Sequence
  Synthetic Peptide
GTSYGRKKR

SEQ ID NO: 834 - protein, 9 aa, Artificial Sequence
  Synthetic Peptide
GTGISYGRK

SEQ ID NO: 835 - protein, 10 aa, Artificial Sequence
  Synthetic Peptide
KTLGISYGRK

SEQ ID NO: 836 - protein, 10 aa, Artificial Sequence
  Synthetic Peptide
LTISYGRKKR

SEQ ID NO: 837 - protein, 11 aa, Artificial Sequence
  Synthetic Peptide
KTLGISYGRKK

SEQ ID NO: 838 - protein, 9 aa, Artificial Sequence
  Synthetic Peptide
TVCNNCYCK

SEQ ID NO: 839 - protein, 11 aa, Artificial Sequence
  Synthetic Peptide
LVISYGRKKRR

SEQ ID NO: 840 - protein, 11 aa, Artificial Sequence
  Synthetic Peptide
ISYGRKKRRQK

SEQ ID NO: 841 - protein, 10 aa, Artificial Sequence
  Synthetic Peptide
ETGPSGQPCK

SEQ ID NO: 842 - protein, 10 aa, Artificial Sequence
  Synthetic Peptide
KVGPGGYPRR

SEQ ID NO: 843 - protein, 10 aa, Artificial Sequence
  Synthetic Peptide
KAGPGGYPRK

SEQ ID NO: 844 - protein, 11 aa, Artificial Sequence
  Synthetic Peptide
KVGPGGYPRRK

SEQ ID NO: 845 - protein, 9 aa, Artificial Sequence
  Synthetic Peptide
AVPGGYPRR

SEQ ID NO: 846 - protein, 10 aa, Artificial Sequence
  Synthetic Peptide
AVPGGYPRRK

SEQ ID NO: 847 - protein, 9 aa, Artificial Sequence
  Synthetic Peptide
KVGSLQYLK

SEQ ID NO: 848 - protein, 8 aa, Artificial Sequence
  Synthetic Peptide
ETVRHFPR

SEQ ID NO: 849 - protein, 10 aa, Artificial Sequence
  Synthetic Peptide
AACHKCIDFY

SEQ ID NO: 850 - protein, 10 aa, Artificial Sequence
  Synthetic Peptide
LLIRCLRCQK

SEQ ID NO: 851 - protein, 10 aa, Artificial Sequence
  Synthetic Peptide
KISEYRHYNY

SEQ ID NO: 852 - protein, 10 aa, Artificial Sequence
  Synthetic Peptide
AVCRVCLLFY

SEQ ID NO: 853 - protein, 10 aa, Artificial Sequence
  Synthetic Peptide
FAFTDLTIVY

SEQ ID NO: 854 - protein, 10 aa, Artificial Sequence
  Synthetic Peptide
FAFADLTVVY

SEQ ID NO: 855 - protein, 10 aa, Artificial Sequence
  Synthetic Peptide
RFLSKISEYR

SEQ ID NO: 856 - protein, 10 aa, Artificial Sequence
  Synthetic Peptide
ILIRCIICQR

SEQ ID NO: 857 - protein, 11 aa, Artificial Sequence
  Synthetic Peptide
RTAMFQDPQER

SEQ ID NO: 858 - protein, 11 aa, Artificial Sequence
  Synthetic Peptide
AMFQDPQERPR

SEQ ID NO: 859 - protein, 11 aa, Artificial Sequence
  Synthetic Peptide
MFQDPQERPRK

SEQ ID NO: 860 - protein, 11 aa, Artificial Sequence
  Synthetic Peptide
DLLIRCINCQK

SEQ ID NO: 861 - protein, 11 aa, Artificial Sequence
  Synthetic Peptide
RFEDPTRRPYK

SEQ ID NO: 862 - protein, 11 aa, Artificial Sequence
  Synthetic Peptide
ELTEVFEFAFK

SEQ ID NO: 863 - protein, 11 aa, Artificial Sequence
  Synthetic Peptide
GLYNLLIRCLR

SEQ ID NO: 864 - protein, 11 aa, Artificial Sequence
  Synthetic Peptide
NLLIRCLRCQK

SEQ ID NO: 865 - protein, 11 aa, Artificial Sequence
  Synthetic Peptide
EVLEESVHEIR

SEQ ID NO: 866 - protein, 11 aa, Artificial Sequence
  Synthetic Peptide
EVYKFLFTDLR

SEQ ID NO: 867 - protein, 11 aa, Artificial Sequence
  Synthetic Peptide
FLFTDLRIVYR

SEQ ID NO: 868 - protein, 11 aa, Artificial Sequence
  Synthetic Peptide
EVLEIPLIDLR

SEQ ID NO: 869 - protein, 11 aa, Artificial Sequence
  Synthetic Peptide
DLRLSCVYCKK

SEQ ID NO: 870 - protein, 11 aa, Artificial Sequence
  Synthetic Peptide
EVYNFACTELK

SEQ ID NO: 871 - protein, 11 aa, Artificial Sequence
  Synthetic Peptide
RVCLLFYSKVR

SEQ ID NO: 872 - protein, 11 aa, Artificial Sequence
  Synthetic Peptide
LLFYSKVRKYR

SEQ ID NO: 873 - protein, 11 aa, Artificial Sequence
  Synthetic Peptide
QLCDLLIRCYR

SEQ ID NO: 874 - protein, 8 aa, Artificial Sequence
  Synthetic Peptide
TLEQTVKK

SEQ ID NO: 875 - protein, 10 aa, Artificial Sequence
  Synthetic Peptide
ATRDLCIVYR

SEQ ID NO: 876 - protein, 10 aa, Artificial Sequence
  Synthetic Peptide
AFRDLCIVYK

SEQ ID NO: 877 - protein, 10 aa, Artificial Sequence
  Synthetic Peptide
ATCDKCLKFY

SEQ ID NO: 878 - protein, 10 aa, Artificial Sequence
  Synthetic Peptide
AVCDKCLKFR

SEQ ID NO: 879 - protein, 10 aa, Artificial Sequence
  Synthetic Peptide
KLYSKISEYR

SEQ ID NO: 880 - protein, 10 aa, Artificial Sequence
  Synthetic Peptide
KFYSKISEYK

SEQ ID NO: 881 - protein, 10 aa, Artificial Sequence
  Synthetic Peptide
KFSEYRHYCY

SEQ ID NO: 882 - protein, 10 aa, Artificial Sequence
  Synthetic Peptide
KISEYRHYCR

SEQ ID NO: 883 - protein, 10 aa, Artificial Sequence
  Synthetic Peptide
LFIRCINCQK

SEQ ID NO: 884 - protein, 10 aa, Artificial Sequence
  Synthetic Peptide
LLIRCINCQR

SEQ ID NO: 885 - protein, 10 aa, Artificial Sequence
  Synthetic Peptide
KVRFHNIRGR

SEQ ID NO: 886 - protein, 10 aa, Artificial Sequence
  Synthetic Peptide
KQRFHNIRGK

SEQ ID NO: 887 - protein, 10 aa, Artificial Sequence
  Synthetic Peptide
WFGRCMSCCR

SEQ ID NO: 888 - protein, 10 aa, Artificial Sequence
  Synthetic Peptide
WTGRCMSCCK

SEQ ID NO: 889 - protein, 10 aa, Artificial Sequence
  Synthetic Peptide
MTCCRSSRTR

SEQ ID NO: 890 - protein, 10 aa, Artificial Sequence
  Synthetic Peptide
MSCCRSSRTK

SEQ ID NO: 891 - protein, 10 aa, Artificial Sequence
  Synthetic Peptide
STCRSSRTRR

SEQ ID NO: 892 - protein, 10 aa, Artificial Sequence
  Synthetic Peptide
SCCRSSRTRK

SEQ ID NO: 893 - protein, 10 aa, Artificial Sequence
  Synthetic Peptide
DIEITCVYCR

SEQ ID NO: 894 - protein, 10 aa, Artificial Sequence
  Synthetic Peptide
FTFKDLFVVY

SEQ ID NO: 895 - protein, 10 aa, Artificial Sequence
  Synthetic Peptide
FAFKDLFVVK

SEQ ID NO: 896 - protein, 10 aa, Artificial Sequence
  Synthetic Peptide
AVKDLFVVYR

SEQ ID NO: 897 - protein, 10 aa, Artificial Sequence
  Synthetic Peptide
AFKDLFVVYK

SEQ ID NO: 898 - protein, 10 aa, Artificial Sequence
  Synthetic Peptide
FVVYRDSIPK

SEQ ID NO: 899 - protein, 10 aa, Artificial Sequence
  Synthetic Peptide
DTIPHAACHK

SEQ ID NO: 900 - protein, 10 aa, Artificial Sequence
  Synthetic Peptide
DSIPHAACHR

SEQ ID NO: 901 - protein, 10 aa, Artificial Sequence
  Synthetic Peptide
KFIDFYSRIR

SEQ ID NO: 902 - protein, 10 aa, Artificial Sequence
  Synthetic Peptide
DTVYGDTLEK

SEQ ID NO: 903 - protein, 10 aa, Artificial Sequence
  Synthetic Peptide
DSVYGDTLER

SEQ ID NO: 904 - protein, 10 aa, Artificial Sequence
  Synthetic Peptide
LFIRCLRCQK

SEQ ID NO: 905 - protein, 10 aa, Artificial Sequence
  Synthetic Peptide
LLIRCLRCQR

SEQ ID NO: 906 - protein, 10 aa, Artificial Sequence
  Synthetic Peptide
RVHNIAGHYR

SEQ ID NO: 907 - protein, 10 aa, Artificial Sequence
  Synthetic Peptide
RFHNIAGHYK

SEQ ID NO: 908 - protein, 10 aa, Artificial Sequence
  Synthetic Peptide
RTQCHSCCNR

SEQ ID NO: 909 - protein, 10 aa, Artificial Sequence
  Synthetic Peptide
RGQCHSCCNK

SEQ ID NO: 910 - protein, 10 aa, Artificial Sequence
  Synthetic Peptide
ATTDLTIVYR

SEQ ID NO: 911 - protein, 10 aa, Artificial Sequence
  Synthetic Peptide
AFTDLTIVYK

SEQ ID NO: 912 - protein, 10 aa, Artificial Sequence
  Synthetic Peptide
RLYSKVSEFR

SEQ ID NO: 913 - protein, 10 aa, Artificial Sequence
  Synthetic Peptide
RFYSKVSEFK

SEQ ID NO: 914 - protein, 10 aa, Artificial Sequence
  Synthetic Peptide
KFSEFRWYRY

SEQ ID NO: 915 - protein, 10 aa, Artificial Sequence
  Synthetic Peptide
KVSEFRWYRR

SEQ ID NO: 916 - protein, 10 aa, Artificial Sequence
  Synthetic Peptide
YFVYGTTLEK

SEQ ID NO: 917 - protein, 10 aa, Artificial Sequence
  Synthetic Peptide
YSVYGTTLER

SEQ ID NO: 918 - protein, 10 aa, Artificial Sequence
  Synthetic Peptide
GTTLEKLTNR

SEQ ID NO: 919 - protein, 10 aa, Artificial Sequence
  Synthetic Peptide
LVIRCITCQR

SEQ ID NO: 920 - protein, 10 aa, Artificial Sequence
  Synthetic Peptide
LLIRCITCQK

SEQ ID NO: 921 - protein, 10 aa, Artificial Sequence
  Synthetic Peptide
WVGRCIACWR

SEQ ID NO: 922 - protein, 10 aa, Artificial Sequence
  Synthetic Peptide
WTGRCIACWK

SEQ ID NO: 923 - protein, 10 aa, Artificial Sequence
  Synthetic Peptide
RTIACWRRPR

SEQ ID NO: 924 - protein, 10 aa, Artificial Sequence
  Synthetic Peptide
RCIACWRRPK

SEQ ID NO: 925 - protein, 10 aa, Artificial Sequence
  Synthetic Peptide
AVADLTVVYR

SEQ ID NO: 926 - protein, 10 aa, Artificial Sequence
  Synthetic Peptide
AFADLTVVYK

SEQ ID NO: 927 - protein, 10 aa, Artificial Sequence
  Synthetic Peptide
RVLSKISEYR

SEQ ID NO: 928 - protein, 10 aa, Artificial Sequence
  Synthetic Peptide
RFLSKISEYK

SEQ ID NO: 929 - protein, 10 aa, Artificial Sequence
  Synthetic Peptide
KFSEYRHYNY

SEQ ID NO: 930 - protein, 10 aa, Artificial Sequence
  Synthetic Peptide
KISEYRHYNR

SEQ ID NO: 931 - protein, 10 aa, Artificial Sequence
  Synthetic Peptide
ITIRCIICQR

SEQ ID NO: 932 - protein, 10 aa, Artificial Sequence
  Synthetic Peptide
ILIRCIICQK

SEQ ID NO: 933 - protein, 10 aa, Artificial Sequence
  Synthetic Peptide
WVGRCAACWR

SEQ ID NO: 934 - protein, 10 aa, Artificial Sequence
  Synthetic Peptide
WAGRCAACWK

SEQ ID NO: 935 - protein, 10 aa, Artificial Sequence
  Synthetic Peptide
CFACWRSRRR

SEQ ID NO: 936 - protein, 10 aa, Artificial Sequence
  Synthetic Peptide
DTSIACVYCK

SEQ ID NO: 937 - protein, 10 aa, Artificial Sequence
  Synthetic Peptide
DVSIACVYCR

SEQ ID NO: 938 - protein, 10 aa, Artificial Sequence
  Synthetic Peptide
CVYCKATLEK

SEQ ID NO: 939 - protein, 10 aa, Artificial Sequence
  Synthetic Peptide
RFEVYQFAFK

SEQ ID NO: 940 - protein, 10 aa, Artificial Sequence
  Synthetic Peptide
RTEVYQFAFR

SEQ ID NO: 941 - protein, 10 aa, Artificial Sequence
  Synthetic Peptide
AVKDLCIVYR

SEQ ID NO: 942 - protein, 10 aa, Artificial Sequence
  Synthetic Peptide
AFKDLCIVYK

SEQ ID NO: 943 - protein, 10 aa, Artificial Sequence
  Synthetic Peptide
ATCHKCIDFY

SEQ ID NO: 944 - protein, 10 aa, Artificial Sequence
  Synthetic Peptide
AACHKCIDFK

SEQ ID NO: 945 - protein, 10 aa, Artificial Sequence
  Synthetic Peptide
NLVYGETLEK

SEQ ID NO: 946 - protein, 10 aa, Artificial Sequence
  Synthetic Peptide
NSVYGETLER

SEQ ID NO: 947 - protein, 10 aa, Artificial Sequence
  Synthetic Peptide
LSIRCLRCQK

SEQ ID NO: 948 - protein, 10 aa, Artificial Sequence
  Synthetic Peptide
LLIRCLRCQY

SEQ ID NO: 949 - protein, 10 aa, Artificial Sequence
  Synthetic Peptide
RVHSIAGQYR

SEQ ID NO: 950 - protein, 10 aa, Artificial Sequence
  Synthetic Peptide
RFHSIAGQYK

SEQ ID NO: 951 - protein, 10 aa, Artificial Sequence
  Synthetic Peptide
LVTDLRIVYR

SEQ ID NO: 952 - protein, 10 aa, Artificial Sequence
  Synthetic Peptide
LFTDLRIVYK

SEQ ID NO: 953 - protein, 10 aa, Artificial Sequence
  Synthetic Peptide
CTMCLRFLSK

SEQ ID NO: 954 - protein, 10 aa, Artificial Sequence
  Synthetic Peptide
CIMCLRFLSR

SEQ ID NO: 955 - protein, 10 aa, Artificial Sequence
  Synthetic Peptide
RLLSKISEYR

SEQ ID NO: 956 - protein, 10 aa, Artificial Sequence
  Synthetic Peptide
RFLSKISEYY

SEQ ID NO: 957 - protein, 10 aa, Artificial Sequence
  Synthetic Peptide
SFYGKTLEER

SEQ ID NO: 958 - protein, 10 aa, Artificial Sequence
  Synthetic Peptide
SLYGKTLEEK

SEQ ID NO: 959 - protein, 10 aa, Artificial Sequence
  Synthetic Peptide
WFGRCSECWR

SEQ ID NO: 960 - protein, 10 aa, Artificial Sequence
  Synthetic Peptide
WTGRCSECWK

SEQ ID NO: 961 - protein, 10 aa, Artificial Sequence
  Synthetic Peptide
AFCRVCLLFY

SEQ ID NO: 962 - protein, 10 aa, Artificial Sequence
  Synthetic Peptide
AVCRVCLLFR

SEQ ID NO: 963 - protein, 10 aa, Artificial Sequence
  Synthetic Peptide
CFLFYSKVRK

SEQ ID NO: 964 - protein, 10 aa, Artificial Sequence
  Synthetic Peptide
CLLFYSKVRR

SEQ ID NO: 965 - protein, 10 aa, Artificial Sequence
  Synthetic Peptide
LVYSKVRKYR

SEQ ID NO: 966 - protein, 10 aa, Artificial Sequence
  Synthetic Peptide
LFYSKVRKYK

SEQ ID NO: 967 - protein, 10 aa, Artificial Sequence
  Synthetic Peptide
GTTLESITKK

SEQ ID NO: 968 - protein, 10 aa, Artificial Sequence
  Synthetic Peptide
WVGSCLGCWR

SEQ ID NO: 969 - protein, 10 aa, Artificial Sequence
  Synthetic Peptide
WTGSCLGCWK

SEQ ID NO: 970 - protein, 10 aa, Artificial Sequence
  Synthetic Peptide
VVADLRIVYR

SEQ ID NO: 971 - protein, 10 aa, Artificial Sequence
  Synthetic Peptide
VFADLRIVYK

SEQ ID NO: 972 - protein, 10 aa, Artificial Sequence
  Synthetic Peptide
RTLSKISEYR

SEQ ID NO: 973 - protein, 10 aa, Artificial Sequence
  Synthetic Peptide
RLLSKISEYK

SEQ ID NO: 974 - protein, 10 aa, Artificial Sequence
  Synthetic Peptide
KVSEYRHYNY

SEQ ID NO: 975 - protein, 10 aa, Artificial Sequence
  Synthetic Peptide
KISEYRHYNK

SEQ ID NO: 976 - protein, 10 aa, Artificial Sequence
  Synthetic Peptide
IVIRCIICQR

SEQ ID NO: 977 - protein, 10 aa, Artificial Sequence
  Synthetic Peptide
WLGRCAVCWR

SEQ ID NO: 978 - protein, 10 aa, Artificial Sequence
  Synthetic Peptide
WTGRCAVCWK

SEQ ID NO: 979 - protein, 9 aa, Artificial Sequence
  Synthetic Peptide
YVVCDKCLK

SEQ ID NO: 980 - protein, 9 aa, Artificial Sequence
  Synthetic Peptide
YAVCDKCLR

SEQ ID NO: 981 - protein, 9 aa, Artificial Sequence
  Synthetic Peptide
SVCRSSRTR

SEQ ID NO: 982 - protein, 9 aa, Artificial Sequence
  Synthetic Peptide
SCCRSSRTK

SEQ ID NO: 983 - protein, 9 aa, Artificial Sequence
  Synthetic Peptide
SLPHAACHK

SEQ ID NO: 984 - protein, 9 aa, Artificial Sequence
  Synthetic Peptide
SIPHAACHR

SEQ ID NO: 985 - protein, 9 aa, Artificial Sequence
  Synthetic Peptide
FVDLTIVYR

SEQ ID NO: 986 - protein, 9 aa, Artificial Sequence
  Synthetic Peptide
FTDLTIVYK

SEQ ID NO: 987 - protein, 9 aa, Artificial Sequence
  Synthetic Peptide
SFYGTTLEK

SEQ ID NO: 988 - protein, 9 aa, Artificial Sequence
  Synthetic Peptide
SVYGTTLER

SEQ ID NO: 989 - protein, 9 aa, Artificial Sequence
  Synthetic Peptide
TFLEKLTNK

SEQ ID NO: 990 - protein, 9 aa, Artificial Sequence
  Synthetic Peptide
TTLEKLTNR

SEQ ID NO: 991 - protein, 9 aa, Artificial Sequence
  Synthetic Peptide
ETNPFGICK

SEQ ID NO: 992 - protein, 9 aa, Artificial Sequence
  Synthetic Peptide
EGNPFGICR

SEQ ID NO: 993 - protein, 9 aa, Artificial Sequence
  Synthetic Peptide
NTLEQTVKR

SEQ ID NO: 994 - protein, 9 aa, Artificial Sequence
  Synthetic Peptide
ALCWRSRRR

SEQ ID NO: 995 - protein, 9 aa, Artificial Sequence
  Synthetic Peptide
AACWRSRRK

SEQ ID NO: 996 - protein, 9 aa, Artificial Sequence
  Synthetic Peptide
VSIACVYCR

SEQ ID NO: 997 - protein, 9 aa, Artificial Sequence
  Synthetic Peptide
SIACVYCKK

SEQ ID NO: 998 - protein, 9 aa, Artificial Sequence
  Synthetic Peptide
ILYRDCIAY

SEQ ID NO: 999 - protein, 9 aa, Artificial Sequence
  Synthetic Peptide
IVYRDCIAR

SEQ ID NO: 1000 - protein, 9 aa, Artificial Sequence
  Synthetic Peptide
CTAYAACHK

SEQ ID NO: 1001 - protein, 9 aa, Artificial Sequence
  Synthetic Peptide
CIAYAACHR

SEQ ID NO: 1002 - protein, 9 aa, Artificial Sequence
  Synthetic Peptide
SFYGETLEK

SEQ ID NO: 1003 - protein, 9 aa, Artificial Sequence
  Synthetic Peptide
SVYGETLER

SEQ ID NO: 1004 - protein, 9 aa, Artificial Sequence
  Synthetic Peptide
LIRCLRCQR

SEQ ID NO: 1005 - protein, 9 aa, Artificial Sequence
  Synthetic Peptide
RTQCVQCKK

SEQ ID NO: 1006 - protein, 9 aa, Artificial Sequence
  Synthetic Peptide
RLQCVQCKR

SEQ ID NO: 1007 - protein, 9 aa, Artificial Sequence
  Synthetic Peptide
KFLEERVKK

SEQ ID NO: 1008 - protein, 9 aa, Artificial Sequence
  Synthetic Peptide
KTLEERVKR

SEQ ID NO: 1009 - protein, 9 aa, Artificial Sequence
  Synthetic Peptide
NVMGRWTGR

SEQ ID NO: 1010 - protein, 9 aa, Artificial Sequence
  Synthetic Peptide
NIMGRWTGK

SEQ ID NO: 1011 - protein, 9 aa, Artificial Sequence
  Synthetic Peptide
LTYRDDFPY

SEQ ID NO: 1012 - protein, 9 aa, Artificial Sequence
  Synthetic Peptide
LVYRDDFPK

SEQ ID NO: 1013 - protein, 9 aa, Artificial Sequence
  Synthetic Peptide
RFCLLFYSK

SEQ ID NO: 1014 - protein, 9 aa, Artificial Sequence
  Synthetic Peptide
RVCLLFYSR

SEQ ID NO: 1015 - protein, 9 aa, Artificial Sequence
  Synthetic Peptide
LTFYSKVRK

SEQ ID NO: 1016 - protein, 9 aa, Artificial Sequence
  Synthetic Peptide
LLFYSKVRR

SEQ ID NO: 1017 - protein, 9 aa, Artificial Sequence
  Synthetic Peptide
ATLESITKR

SEQ ID NO: 1018 - protein, 9 aa, Artificial Sequence
  Synthetic Peptide
KVLCDLLIR

SEQ ID NO: 1019 - protein, 9 aa, Artificial Sequence
  Synthetic Peptide
KQLCDLLIK

SEQ ID NO: 1020 - protein, 9 aa, Artificial Sequence
  Synthetic Peptide
TFVHEIELK

SEQ ID NO: 1021 - protein, 9 aa, Artificial Sequence
  Synthetic Peptide
TSVHEIELR

SEQ ID NO: 1022 - protein, 9 aa, Artificial Sequence
  Synthetic Peptide
YTFVFADLR

SEQ ID NO: 1023 - protein, 9 aa, Artificial Sequence
  Synthetic Peptide
DFLEQTLKK

SEQ ID NO: 1024 - protein, 9 aa, Artificial Sequence
  Synthetic Peptide
DTLEQTLKR

SEQ ID NO: 1025 - protein, 9 aa, Artificial Sequence
  Synthetic Peptide
LVRCIICQR

SEQ ID NO: 1026 - protein, 9 aa, Artificial Sequence
  Synthetic Peptide
LIRCIICQK

SEQ ID NO: 1027 - protein, 9 aa, Artificial Sequence
  Synthetic Peptide
RVAVCWRPR

SEQ ID NO: 1028 - protein, 9 aa, Artificial Sequence
  Synthetic Peptide
RCAVCWRPK

SEQ ID NO: 1029 - protein, 9 aa, Artificial Sequence
  Synthetic Peptide
AFCWRPRRR

SEQ ID NO: 1030 - protein, 9 aa, Artificial Sequence
  Synthetic Peptide
AVCWRPRRK

SEQ ID NO: 1031 - protein, 9 aa, Artificial Sequence
  Synthetic Peptide
LSFVCPWCA

SEQ ID NO: 1032 - protein, 11 aa, Artificial Sequence
  Synthetic Peptide
TFCCKCDSTLR

SEQ ID NO: 1033 - protein, 11 aa, Artificial Sequence
  Synthetic Peptide
LVVESSADDLR

SEQ ID NO: 1034 - protein, 11 aa, Artificial Sequence
  Synthetic Peptide
TLQVVCPGCAR

SEQ ID NO: 1035 - protein, 11 aa, Artificial Sequence
  Synthetic Peptide
YLIHVPCCECK

SEQ ID NO: 1036 - protein, 11 aa, Artificial Sequence
  Synthetic Peptide
FVVQLDIQSTK

SEQ ID NO: 1037 - protein, 8 aa, Artificial Sequence
  Synthetic Peptide
HTCNTTVR

SEQ ID NO: 1038 - protein, 10 aa, Artificial Sequence
  Synthetic Peptide
GLVCPICSQK

SEQ ID NO: 1039 - protein, 10 aa, Artificial Sequence
  Synthetic Peptide
GFNHQHLPAR

SEQ ID NO: 1040 - protein, 10 aa, Artificial Sequence
  Synthetic Peptide
GVNHQHLPAK

SEQ ID NO: 1041 - protein, 10 aa, Artificial Sequence
  Synthetic Peptide
NVVTFCCQCK

SEQ ID NO: 1042 - protein, 10 aa, Artificial Sequence
  Synthetic Peptide
NIVTFCCQCR

SEQ ID NO: 1043 - protein, 10 aa, Artificial Sequence
  Synthetic Peptide
GVSHAQLPAK

SEQ ID NO: 1044 - protein, 10 aa, Artificial Sequence
  Synthetic Peptide
LIHVPCCECR

SEQ ID NO: 1045 - protein, 9 aa, Artificial Sequence
  Synthetic Peptide
AVLQDIVLH

SEQ ID NO: 1046 - protein, 9 aa, Artificial Sequence
  Synthetic Peptide
ATLQDIVLK

SEQ ID NO: 1047 - protein, 9 aa, Artificial Sequence
  Synthetic Peptide
GVNHQHLPK

SEQ ID NO: 1048 - protein, 9 aa, Artificial Sequence
  Synthetic Peptide
HVMLCMCCK

SEQ ID NO: 1049 - protein, 9 aa, Artificial Sequence
  Synthetic Peptide
HTMLCMCCR

SEQ ID NO: 1050 - protein, 9 aa, Artificial Sequence
  Synthetic Peptide
LSFVCPWCR

SEQ ID NO: 1051 - protein, 9 aa, Artificial Sequence
  Synthetic Peptide
AQPATADYK

SEQ ID NO: 1052 - protein, 9 aa, Artificial Sequence
  Synthetic Peptide
VVHAQLPAR

SEQ ID NO: 1053 - protein, 9 aa, Artificial Sequence
  Synthetic Peptide
VSHAQLPAK

SEQ ID NO: 1054 - protein, 9 aa, Artificial Sequence
  Synthetic Peptide
QLARQAKQH

SEQ ID NO: 1055 - protein, 9 aa, Artificial Sequence
  Synthetic Peptide
KQHTCYLIR

SEQ ID NO: 1056 - protein, 9 aa, Artificial Sequence
  Synthetic Peptide
VTLDIQSTK

SEQ ID NO: 1057 - protein, 9 aa, Artificial Sequence
  Synthetic Peptide
VQLDIQSTR

SEQ ID NO: 1058 - protein, 9 aa, Artificial Sequence
  Synthetic Peptide
SLGPGPGTK

SEQ ID NO: 1059 - protein, 9 aa, Artificial Sequence
  Synthetic Peptide
SLFGPGPGK

SEQ ID NO: 1060 - protein, 8 aa, Artificial Sequence
  Synthetic Peptide
LVGPGPGK

SEQ ID NO: 1061 - protein, 8 aa, Artificial Sequence
  Synthetic Peptide
KMFLQLAK

SEQ ID NO: 1062 - protein, 8 aa, Artificial Sequence
  Synthetic Peptide
KMGPGPGK

SEQ ID NO: 1063 - protein, 10 aa, Artificial Sequence
  Synthetic Peptide
KQENWYSLKK

SEQ ID NO: 1064 - protein, 9 aa, Artificial Sequence
  Synthetic Peptide
GVGPGPGLK

SEQ ID NO: 1065 - protein, 9 aa, Artificial Sequence
  Synthetic Peptide
GVSGPGPGK

SEQ ID NO: 1066 - protein, 10 aa, Artificial Sequence
  Synthetic Peptide
FLLYILFLVK

SEQ ID NO: 1067 - protein, 10 aa, Artificial Sequence
  Synthetic Peptide
LVFSNVLCFR

SEQ ID NO: 1068 - protein, 10 aa, Artificial Sequence
  Synthetic Peptide
SSFDIKSEVK

SEQ ID NO: 1069 - protein, 10 aa, Artificial Sequence
  Synthetic Peptide
TLYQIQVMKR

SEQ ID NO: 1070 - protein, 10 aa, Artificial Sequence
  Synthetic Peptide
KQVQMMIMIK

SEQ ID NO: 1071 - protein, 10 aa, Artificial Sequence
  Synthetic Peptide
GVIYIMIISK

SEQ ID NO: 1072 - protein, 10 aa, Artificial Sequence
  Synthetic Peptide
ELFDKDTFFK

SEQ ID NO: 1073 - protein, 10 aa, Artificial Sequence
  Synthetic Peptide
ALERLLSLKK

SEQ ID NO: 1074 - protein, 10 aa, Artificial Sequence
  Synthetic Peptide
KILIKIPVTK

SEQ ID NO: 1075 - protein, 10 aa, Artificial Sequence
  Synthetic Peptide
RLPLLPKTWK

SEQ ID NO: 1076 - protein, 10 aa, Artificial Sequence
  Synthetic Peptide
SQVSNSDSYK

SEQ ID NO: 1077 - protein, 10 aa, Artificial Sequence
  Synthetic Peptide
QQNQESKIMK

SEQ ID NO: 1078 - protein, 10 aa, Artificial Sequence
  Synthetic Peptide
IIALLIIPPK

SEQ ID NO: 1079 - protein, 10 aa, Artificial Sequence
  Synthetic Peptide
SSPLFNNFYK

SEQ ID NO: 1080 - protein, 10 aa, Artificial Sequence
  Synthetic Peptide
FLYLLNKKNK

SEQ ID NO: 1081 - protein, 10 aa, Artificial Sequence
  Synthetic Peptide
LQMMNVNLQK

SEQ ID NO: 1082 - protein, 10 aa, Artificial Sequence
  Synthetic Peptide
LTNHLINTPK

SEQ ID NO: 1083 - protein, 10 aa, Artificial Sequence
  Synthetic Peptide
IFISFYLINK

SEQ ID NO: 1084 - protein, 10 aa, Artificial Sequence
  Synthetic Peptide
RLFEESLGIR

SEQ ID NO: 1085 - protein, 9 aa, Artificial Sequence
  Synthetic Peptide
LLYILFLVK

SEQ ID NO: 1086 - protein, 9 aa, Artificial Sequence
  Synthetic Peptide
KSMLKELIK

SEQ ID NO: 1087 - protein, 9 aa, Artificial Sequence
  Synthetic Peptide
PVLTSLFNK

SEQ ID NO: 1088 - protein, 9 aa, Artificial Sequence
  Synthetic Peptide
KTMNNYMIK

SEQ ID NO: 1089 - protein, 9 aa, Artificial Sequence
  Synthetic Peptide
LFDKDTFFK

SEQ ID NO: 1090 - protein, 9 aa, Artificial Sequence
  Synthetic Peptide
YLFNQHIKK

SEQ ID NO: 1091 - protein, 9 aa, Artificial Sequence
  Synthetic Peptide
MQSSFFMNR

SEQ ID NO: 1092 - protein, 9 aa, Artificial Sequence
  Synthetic Peptide
RFYITTRYK

SEQ ID NO: 1093 - protein, 9 aa, Artificial Sequence
  Synthetic Peptide
TTRYKYLNK

SEQ ID NO: 1094 - protein, 9 aa, Artificial Sequence
  Synthetic Peptide
AVIFTPIYY

SEQ ID NO: 1095 - protein, 9 aa, Artificial Sequence
  Synthetic Peptide
ALERLLSLK

SEQ ID NO: 1096 - protein, 9 aa, Artificial Sequence
  Synthetic Peptide
SISGKYDIK

SEQ ID NO: 1097 - protein, 9 aa, Artificial Sequence
  Synthetic Peptide
EQRLPLLPK

SEQ ID NO: 1098 - protein, 9 aa, Artificial Sequence
  Synthetic Peptide
IALLIIPPK

SEQ ID NO: 1099 - protein, 9 aa, Artificial Sequence
  Synthetic Peptide
PVVCSMEYK

SEQ ID NO: 1100 - protein, 9 aa, Artificial Sequence
  Synthetic Peptide
VVCSMEYKK

SEQ ID NO: 1101 - protein, 9 aa, Artificial Sequence
  Synthetic Peptide
FSYDLRLNK

SEQ ID NO: 1102 - protein, 9 aa, Artificial Sequence
  Synthetic Peptide
HLNIPIGFK

SEQ ID NO: 1103 - protein, 9 aa, Artificial Sequence
  Synthetic Peptide
PLFNNFYKR

SEQ ID NO: 1104 - protein, 9 aa, Artificial Sequence
  Synthetic Peptide
YQNFQNADK

SEQ ID NO: 1105 - protein, 9 aa, Artificial Sequence
  Synthetic Peptide
QMMNVNLQK

SEQ ID NO: 1106 - protein, 9 aa, Artificial Sequence
  Synthetic Peptide
AVSEIQNNK

SEQ ID NO: 1107 - protein, 9 aa, Artificial Sequence
  Synthetic Peptide
GTMYILLKK

SEQ ID NO: 1108 - protein, 9 aa, Artificial Sequence
  Synthetic Peptide
FISFYLINK

SEQ ID NO: 1109 - protein, 9 aa, Artificial Sequence
  Synthetic Peptide
YLINKHWQR

SEQ ID NO: 1110 - protein, 9 aa, Artificial Sequence
  Synthetic Peptide
ALKISQLQK

SEQ ID NO: 1111 - protein, 9 aa, Artificial Sequence
  Synthetic Peptide
KINSNFLLK

SEQ ID NO: 1112 - protein, 10 aa, Artificial Sequence
  Synthetic Peptide
  VARIANT 4: Xaa = Any Amino Acid
AAMXDPTTFK

SEQ ID NO: 1113 - protein, 9 aa, Artificial Sequence
  Synthetic Peptide
  VARIANT 7: Xaa = Any Amino Acid
GTMTTSXYK

SEQ ID NO: 1114 - protein, 9 aa, Artificial Sequence
  Synthetic Peptide
  VARIANT 2, 3, 6: Xaa = Any Amino Acid
SXXPAXFQK

SEQ ID NO: 1115 - protein, 12 aa, Artificial Sequence
  Synthetic Peptide
  VARIANT 7, 8, 10: Xaa = Any Amino Acid
ATAGDGXXEXRK

SEQ ID NO: 1116 - protein, 9 aa, Artificial Sequence
  Synthetic Peptide
AYGPGPGKF

SEQ ID NO: 1117 - protein, 9 aa, Artificial Sequence
  Synthetic Peptide
AYIGPGPGF

SEQ ID NO: 1118 - protein, 9 aa, Artificial Sequence
  Synthetic Peptide
AYAAAAAAL

SEQ ID NO: 1119 - protein, 9 aa, Artificial Sequence
  Synthetic Peptide
AYSSWMYSY

SEQ ID NO: 1120 - protein, 10 aa, Artificial Sequence
  Synthetic Peptide
DLLDTASALY

SEQ ID NO: 1121 - protein, 9 aa, Artificial Sequence
  Synthetic Peptide
WFHISCLTF

SEQ ID NO: 1122 - protein, 8 aa, Artificial Sequence
  Synthetic Peptide
KYTSFPWL

SEQ ID NO: 1123 - protein, 10 aa, Artificial Sequence
  Synthetic Peptide
FAAPFTQCGY

SEQ ID NO: 1124 - protein, 10 aa, Artificial Sequence
  Synthetic Peptide
SYQHFRKLLL

SEQ ID NO: 1125 - protein, 10 aa, Artificial Sequence
  Synthetic Peptide
LYSHPIILGF

SEQ ID NO: 1126 - protein, 9 aa, Artificial Sequence
  Synthetic Peptide
MSTTDLEAY

SEQ ID NO: 1127 - protein, 11 aa, Artificial Sequence
  Synthetic Peptide
MYVGDLCGSVF

SEQ ID NO: 1128 - protein, 11 aa, Artificial Sequence
  Synthetic Peptide
MYGPGPGGSVF

SEQ ID NO: 1129 - protein, 11 aa, Artificial Sequence
  Synthetic Peptide
MYVGPGPGSVF

SEQ ID NO: 1130 - protein, 11 aa, Artificial Sequence
  Synthetic Peptide
MYVGGPGPGVF

SEQ ID NO: 1131 - protein, 11 aa, Artificial Sequence
  Synthetic Peptide
MYVGDGPGPGF

SEQ ID NO: 1132 - protein, 8 aa, Artificial Sequence
  Synthetic Peptide
VMGSSYGF

SEQ ID NO: 1133 - protein, 10 aa, Artificial Sequence
  Synthetic Peptide
EVDGVRLHRY

SEQ ID NO: 1134 - protein, 10 aa, Artificial Sequence
  Synthetic Peptide
KYSKSSIVGW

SEQ ID NO: 1135 - protein, 10 aa, Artificial Sequence
  Synthetic Peptide
KWSKSSIVGF

SEQ ID NO: 1136 - protein, 9 aa, Artificial Sequence
  Synthetic Peptide
FFLKEKGGF

SEQ ID NO: 1137 - protein, 9 aa, Artificial Sequence
  Synthetic Peptide
IYSKKRQEF

SEQ ID NO: 1138 - protein, 10 aa, Artificial Sequence
  Synthetic Peptide
IYSKKRQEIF

SEQ ID NO: 1139 - protein, 10 aa, Artificial Sequence
  Synthetic Peptide
LYVYHTQGYF

SEQ ID NO: 1140 - protein, 11 aa, Artificial Sequence
  Synthetic Peptide
VYHTQGYFPDF

SEQ ID NO: 1141 - protein, 8 aa, Artificial Sequence
  Synthetic Peptide
RYPLTFGW

SEQ ID NO: 1142 - protein, 8 aa, Artificial Sequence
  Synthetic Peptide
RYPLTFGF

SEQ ID NO: 1143 - protein, 8 aa, Artificial Sequence
  Synthetic Peptide
RFPLTFGF

SEQ ID NO: 1144 - protein, 8 aa, Artificial Sequence
  Synthetic Peptide
TYGWCFKL

SEQ ID NO: 1145 - protein, 8 aa, Artificial Sequence
  Synthetic Peptide
TFGWCFKF

SEQ ID NO: 1146 - protein, 9 aa, Artificial Sequence
  Synthetic Peptide
LYVYHTQGY

SEQ ID NO: 1147 - protein, 10 aa, Artificial Sequence
  Synthetic Peptide
NYTPGPGIRF

SEQ ID NO: 1148 - protein, 10 aa, Artificial Sequence
  Synthetic Peptide
QYPPLERLTL

SEQ ID NO: 1149 - protein, 10 aa, Artificial Sequence
  Synthetic Peptide
QLPPLERLTF

SEQ ID NO: 1150 - protein, 10 aa, Artificial Sequence
  Synthetic Peptide
KYGSLQYLAL

SEQ ID NO: 1151 - protein, 10 aa, Artificial Sequence
  Synthetic Peptide
LSKISEYRHY

SEQ ID NO: 1152 - protein, 9 aa, Artificial Sequence
  Synthetic Peptide
ISEYRHYNY

SEQ ID NO: 1153 - protein, 9 aa, Artificial Sequence
  Synthetic Peptide
RFHNIRGRW

SEQ ID NO: 1154 - protein, 9 aa, Artificial Sequence
  Synthetic Peptide
RFLSKISEY

SEQ ID NO: 1155 - protein, 9 aa, Artificial Sequence
  Synthetic Peptide
RFHNISGRW

SEQ ID NO: 1156 - protein, 11 aa, Artificial Sequence
  Synthetic Peptide
VYDFAFRDLCI

SEQ ID NO: 1157 - protein, 11 aa, Artificial Sequence
  Synthetic Peptide
PYAVCDKCLKF

SEQ ID NO: 1158 - protein, 11 aa, Artificial Sequence
  Synthetic Peptide
QYNKPLCDLLI

SEQ ID NO: 1159 - protein, 11 aa, Artificial Sequence
  Synthetic Peptide
PFGICKLCLRF

SEQ ID NO: 1160 - protein, 11 aa, Artificial Sequence
  Synthetic Peptide
VYQFAFKDLCI

SEQ ID NO: 1161 - protein, 11 aa, Artificial Sequence
  Synthetic Peptide
AYAACHKCIDF

SEQ ID NO: 1162 - protein, 11 aa, Artificial Sequence
  Synthetic Peptide
VYKFLFTDLRI

SEQ ID NO: 1163 - protein, 11 aa, Artificial Sequence
  Synthetic Peptide
PYGVCIMCLRF

SEQ ID NO: 1164 - protein, 11 aa, Artificial Sequence
  Synthetic Peptide
PYAVCRVCLLF

SEQ ID NO: 1165 - protein, 11 aa, Artificial Sequence
  Synthetic Peptide
VYDFVFADLRI

SEQ ID NO: 1166 - protein, 10 aa, Artificial Sequence
  Synthetic Peptide
QYNKPLCDLF

SEQ ID NO: 1167 - protein, 10 aa, Artificial Sequence
  Synthetic Peptide
VYEFAFKDLF

SEQ ID NO: 1168 - protein, 10 aa, Artificial Sequence
  Synthetic Peptide
FYSKVSEFRF

SEQ ID NO: 1169 - protein, 10 aa, Artificial Sequence
  Synthetic Peptide
VYREGNPFGF

SEQ ID NO: 1170 - protein, 10 aa, Artificial Sequence
  Synthetic Peptide
FYSRIRELRF

SEQ ID NO: 1171 - protein, 10 aa, Artificial Sequence
  Synthetic Peptide
PYAVCRVCLF

SEQ ID NO: 1172 - protein, 10 aa, Artificial Sequence
  Synthetic Peptide
FYSKVRKYRF

SEQ ID NO: 1173 - protein, 10 aa, Artificial Sequence
  Synthetic Peptide
LYGDTLEQTF

SEQ ID NO: 1174 - protein, 9 aa, Artificial Sequence
  Synthetic Peptide
VYDFAFRDF

SEQ ID NO: 1175 - protein, 9 aa, Artificial Sequence
  Synthetic Peptide
AYRDLCIVY

SEQ ID NO: 1176 - protein, 9 aa, Artificial Sequence
  Synthetic Peptide
AFRDLCIVF

SEQ ID NO: 1177 - protein, 9 aa, Artificial Sequence
  Synthetic Peptide
PYAVCDKCF

SEQ ID NO: 1178 - protein, 9 aa, Artificial Sequence
  Synthetic Peptide
KYYSKISEY

SEQ ID NO: 1179 - protein, 9 aa, Artificial Sequence
  Synthetic Peptide
KFYSKISEF

SEQ ID NO: 1180 - protein, 9 aa, Artificial Sequence
  Synthetic Peptide
CYSLYGTTF

SEQ ID NO: 1181 - protein, 9 aa, Artificial Sequence
  Synthetic Peptide
RYHNIRGRW

SEQ ID NO: 1182 - protein, 9 aa, Artificial Sequence
  Synthetic Peptide
RFHNIRGRF

SEQ ID NO: 1183 - protein, 9 aa, Artificial Sequence
  Synthetic Peptide
VYCKTVLEF

SEQ ID NO: 1184 - protein, 9 aa, Artificial Sequence
  Synthetic Peptide
AYKDLFVVY

SEQ ID NO: 1185 - protein, 9 aa, Artificial Sequence
  Synthetic Peptide
AFKDLFVVF

SEQ ID NO: 1186 - protein, 9 aa, Artificial Sequence
  Synthetic Peptide
LYVVYRDSI

SEQ ID NO: 1187 - protein, 9 aa, Artificial Sequence
  Synthetic Peptide
LFVVYRDSF

SEQ ID NO: 1188 - protein, 9 aa, Artificial Sequence
  Synthetic Peptide
RYHNIAGHY

SEQ ID NO: 1189 - protein, 9 aa, Artificial Sequence
  Synthetic Peptide
RFHNIAGHF

SEQ ID NO: 1190 - protein, 9 aa, Artificial Sequence
  Synthetic Peptide
VYGTTLEKF

SEQ ID NO: 1191 - protein, 9 aa, Artificial Sequence
  Synthetic Peptide
AYADLTVVY

SEQ ID NO: 1192 - protein, 9 aa, Artificial Sequence
  Synthetic Peptide
AFADLTVVF

SEQ ID NO: 1193 - protein, 9 aa, Artificial Sequence
  Synthetic Peptide
RYLSKISEY

SEQ ID NO: 1194 - protein, 9 aa, Artificial Sequence
  Synthetic Peptide
NYSVYGNTF

SEQ ID NO: 1195 - protein, 9 aa, Artificial Sequence
  Synthetic Peptide
RYHNISGRW

SEQ ID NO: 1196 - protein, 9 aa, Artificial Sequence
  Synthetic Peptide
AYKDLCIVY

SEQ ID NO: 1197 - protein, 9 aa, Artificial Sequence
  Synthetic Peptide
AFKDLCIVF

SEQ ID NO: 1198 - protein, 9 aa, Artificial Sequence
  Synthetic Peptide
AYAACHKCF

SEQ ID NO: 1199 - protein, 9 aa, Artificial Sequence
  Synthetic Peptide
VYGETLEKF

SEQ ID NO: 1200 - protein, 9 aa, Artificial Sequence
  Synthetic Peptide
RYHSIAGQY

SEQ ID NO: 1201 - protein, 9 aa, Artificial Sequence
  Synthetic Peptide
RFHSIAGQF

SEQ ID NO: 1202 - protein, 9 aa, Artificial Sequence
  Synthetic Peptide
KYLFTDLRI

SEQ ID NO: 1203 - protein, 9 aa, Artificial Sequence
  Synthetic Peptide
KFLFTDLRF

SEQ ID NO: 1204 - protein, 9 aa, Artificial Sequence
  Synthetic Peptide
LYTDLRIVY

SEQ ID NO: 1205 - protein, 9 aa, Artificial Sequence
  Synthetic Peptide
LFTDLRIVF

SEQ ID NO: 1206 - protein, 9 aa, Artificial Sequence
  Synthetic Peptide
PYGVCIMCF

SEQ ID NO: 1207 - protein, 9 aa, Artificial Sequence
  Synthetic Peptide
RFLSKISEF

SEQ ID NO: 1208 - protein, 9 aa, Artificial Sequence
  Synthetic Peptide
EYRHYQYSF

SEQ ID NO: 1209 - protein, 9 aa, Artificial Sequence
  Synthetic Peptide
RYHNIMGRW

SEQ ID NO: 1210 - protein, 9 aa, Artificial Sequence
  Synthetic Peptide
RFHNIMGRF

SEQ ID NO: 1211 - protein, 9 aa, Artificial Sequence
  Synthetic Peptide
VYNFACTEF

SEQ ID NO: 1212 - protein, 9 aa, Artificial Sequence
  Synthetic Peptide
NYACTELKL

SEQ ID NO: 1213 - protein, 9 aa, Artificial Sequence
  Synthetic Peptide
NFACTELKF

SEQ ID NO: 1214 - protein, 9 aa, Artificial Sequence
  Synthetic Peptide
PYAVCRVCF

SEQ ID NO: 1215 - protein, 9 aa, Artificial Sequence
  Synthetic Peptide
LYYSKVRKY

SEQ ID NO: 1216 - protein, 9 aa, Artificial Sequence
  Synthetic Peptide
LFYSKVRKF

SEQ ID NO: 1217 - protein, 9 aa, Artificial Sequence
  Synthetic Peptide
VYDFVFADF

SEQ ID NO: 1218 - protein, 9 aa, Artificial Sequence
  Synthetic Peptide
VYADLRIVY

SEQ ID NO: 1219 - protein, 9 aa, Artificial Sequence
  Synthetic Peptide
VFADLRIVF

SEQ ID NO: 1220 - protein, 9 aa, Artificial Sequence
  Synthetic Peptide
NYSLYGDTF

SEQ ID NO: 1221 - protein, 9 aa, Artificial Sequence
  Synthetic Peptide
RFHNISGRF

SEQ ID NO: 1222 - protein, 9 aa, Artificial Sequence
  Synthetic Peptide
LYNLLIRCF

SEQ ID NO: 1223 - protein, 8 aa, Artificial Sequence
  Synthetic Peptide
FYSKVSEF

SEQ ID NO: 1224 - protein, 8 aa, Artificial Sequence
  Synthetic Peptide
VYREGNPF

SEQ ID NO: 1225 - protein, 10 aa, Artificial Sequence
  Synthetic Peptide
VFEFAFKDLF

SEQ ID NO: 1226 - protein, 10 aa, Artificial Sequence
  Synthetic Peptide
EYRHYCYSLY

SEQ ID NO: 1227 - protein, 10 aa, Artificial Sequence
  Synthetic Peptide
EYRHYNYSLY

SEQ ID NO: 1228 - protein, 10 aa, Artificial Sequence
  Synthetic Peptide
ETRHYCYSLY

SEQ ID NO: 1229 - protein, 10 aa, Artificial Sequence
  Synthetic Peptide
EYDHYCYSLY

SEQ ID NO: 1230 - protein, 10 aa, Artificial Sequence
  Synthetic Peptide
KTRYYDYSVY

SEQ ID NO: 1231 - protein, 10 aa, Artificial Sequence
  Synthetic Peptide
KYDYYDYSVY

SEQ ID NO: 1232 - protein, 10 aa, Artificial Sequence
  Synthetic Peptide
ETRHYNYSLY

SEQ ID NO: 1233 - protein, 10 aa, Artificial Sequence
  Synthetic Peptide
EYDHYNYSLY

SEQ ID NO: 1234 - protein, 10 aa, Artificial Sequence
  Synthetic Peptide
TYCCKCDSTL

SEQ ID NO: 1235 - protein, 10 aa, Artificial Sequence
  Synthetic Peptide
TFCCKCDSTF

SEQ ID NO: 1236 - protein, 10 aa, Artificial Sequence
  Synthetic Peptide
TYCHSCDSTF

SEQ ID NO: 1237 - protein, 10 aa, Artificial Sequence
  Synthetic Peptide
CYTCGTTVRF

SEQ ID NO: 1238 - protein, 9 aa, Artificial Sequence
  Synthetic Peptide
LYPEPTDLF

SEQ ID NO: 1239 - protein, 9 aa, Artificial Sequence
  Synthetic Peptide
NYYIVTCCF

SEQ ID NO: 1240 - protein, 8 aa, Artificial Sequence
  Synthetic Peptide
LFLNTLSF

SEQ ID NO: 1241 - protein, 8 aa, Artificial Sequence
  Synthetic Peptide
LFLSTLSF

SEQ ID NO: 1242 - protein, 9 aa, Artificial Sequence
  Synthetic Peptide
RVLPPNWKY

SEQ ID NO: 1243 - protein, 10 aa, Artificial Sequence
  Synthetic Peptide
RLAHEVGWKY

SEQ ID NO: 1244 - protein, 9 aa, Artificial Sequence
  Synthetic Peptide
AYKKQFSQY

SEQ ID NO: 1245 - protein, 9 aa, Artificial Sequence
  Synthetic Peptide
KTKDIVNGL

SEQ ID NO: 1246 - protein, 9 aa, Artificial Sequence
  Synthetic Peptide
SLFVSNHAY

SEQ ID NO: 1247 - protein, 11 aa, Artificial Sequence
  Synthetic Peptide
TYGPGPGSLSF

SEQ ID NO: 1248 - protein, 11 aa, Artificial Sequence
  Synthetic Peptide
TYLGPGPGLSF

SEQ ID NO: 1249 - protein, 11 aa, Artificial Sequence
  Synthetic Peptide
TYLPGPGPGSF

SEQ ID NO: 1250 - protein, 11 aa, Artificial Sequence
  Synthetic Peptide
TYLPTGPGPGF

SEQ ID NO: 1251 - protein, 9 aa, Artificial Sequence
  Synthetic Peptide
RWGLLLALL

SEQ ID NO: 1252 - protein, 9 aa, Artificial Sequence
  Synthetic Peptide
PYVSRLLGI

SEQ ID NO: 1253 - protein, 9 aa, Artificial Sequence
  Synthetic Peptide
TYLPTNASL

SEQ ID NO: 1254 - protein, 10 aa, Artificial Sequence
  Synthetic Peptide
IYGPGPGLIF

SEQ ID NO: 1255 - protein, 10 aa, Artificial Sequence
  Synthetic Peptide
IYPGPGPGIF

SEQ ID NO: 1256 - protein, 10 aa, Artificial Sequence
  Synthetic Peptide
IYPKGPGPGF

SEQ ID NO: 1257 - protein, 9 aa, Artificial Sequence
  Synthetic Peptide
RISGVDRYY

SEQ ID NO: 1258 - protein, 9 aa, Artificial Sequence
  Synthetic Peptide
LYSACFWWL

SEQ ID NO: 1259 - protein, 9 aa, Artificial Sequence
  Synthetic Peptide
LYSACFWWF

SEQ ID NO: 1260 - protein, 10 aa, Artificial Sequence
  Synthetic Peptide
TYSVSFDSLF

SEQ ID NO: 1261 - protein, 10 aa, Artificial Sequence
  Synthetic Peptide
TYGPGPGSLF

SEQ ID NO: 1262 - protein, 10 aa, Artificial Sequence
  Synthetic Peptide
TYSGPGPGLF

SEQ ID NO: 1263 - protein, 10 aa, Artificial Sequence
  Synthetic Peptide
TYSVGPGPGF

SEQ ID NO: 1264 - protein, 9 aa, Artificial Sequence
  Synthetic Peptide
AYPNVSAKI

SEQ ID NO: 1265 - protein, 9 aa, Artificial Sequence
  Synthetic Peptide
AYGPGPGKI

SEQ ID NO: 1266 - protein, 8 aa, Artificial Sequence
  Synthetic Peptide
IMVLSFLF

SEQ ID NO: 1267 - protein, 8 aa, Artificial Sequence
  Synthetic Peptide
YYGKQENW

SEQ ID NO: 1268 - protein, 9 aa, Artificial Sequence
  Synthetic Peptide
VFNVVNSSI

SEQ ID NO: 1269 - protein, 9 aa, Artificial Sequence
  Synthetic Peptide
ALFQEYQCY

SEQ ID NO: 1270 - protein, 11 aa, Artificial Sequence
  Synthetic Peptide
LYNTEKGRHPF

SEQ ID NO: 1271 - protein, 8 aa, Artificial Sequence
  Synthetic Peptide
YFILVNLL

SEQ ID NO: 1272 - protein, 9 aa, Artificial Sequence
  Synthetic Peptide
KFFDKDKEL

SEQ ID NO: 1273 - protein, 9 aa, Artificial Sequence
  Synthetic Peptide
KFIKSLFHI

SEQ ID NO: 1274 - protein, 10 aa, Artificial Sequence
  Synthetic Peptide
YFILVNLLIF

SEQ ID NO: 1275 - protein, 11 aa, Artificial Sequence
  Synthetic Peptide
FYFILVNLLIF

SEQ ID NO: 1276 - protein, 11 aa, Artificial Sequence
  Synthetic Peptide
SFYFILVNLLI

SEQ ID NO: 1277 - protein, 9 aa, Artificial Sequence
  Synthetic Peptide
VFLIFFDLF

SEQ ID NO: 1278 - protein, 11 aa, Artificial Sequence
  Synthetic Peptide
LYLLMDCSGSI

SEQ ID NO: 1279 - protein, 9 aa, Artificial Sequence
  Synthetic Peptide
KVSDEIWNY

SEQ ID NO: 1280 - protein, 10 aa, Artificial Sequence
  Synthetic Peptide
SYKSSKRDKF

SEQ ID NO: 1281 - protein, 10 aa, Artificial Sequence
  Synthetic Peptide
RYQDPQNYEL

SEQ ID NO: 1282 - protein, 10 aa, Artificial Sequence
  Synthetic Peptide
DFFLKSKFNI

SEQ ID NO: 1283 - protein, 9 aa, Artificial Sequence
  Synthetic Peptide
IFHFFLFLL

SEQ ID NO: 1284 - protein, 9 aa, Artificial Sequence
  Synthetic Peptide
VFLVFSNVL

SEQ ID NO: 1285 - protein, 9 aa, Artificial Sequence
  Synthetic Peptide
TYGIIVPVL

SEQ ID NO: 1286 - protein, 9 aa, Artificial Sequence
  Synthetic Peptide
NYMKIMNHL

SEQ ID NO: 1287 - protein, 9 aa, Artificial Sequence
  Synthetic Peptide
TYKKKNNHI

SEQ ID NO: 1288 - protein, 9 aa, Artificial Sequence
  Synthetic Peptide
VYYNILIVL

SEQ ID NO: 1289 - protein, 9 aa, Artificial Sequence
  Synthetic Peptide
LYYLFNQHI

SEQ ID NO: 1290 - protein, 9 aa, Artificial Sequence
  Synthetic Peptide
SFFMNRFYI

SEQ ID NO: 1291 - protein, 9 aa, Artificial Sequence
  Synthetic Peptide
FYITTRYKY

SEQ ID NO: 1292 - protein, 9 aa, Artificial Sequence
  Synthetic Peptide
KYINFINFI

SEQ ID NO: 1293 - protein, 9 aa, Artificial Sequence
  Synthetic Peptide
KYEALIKLL

SEQ ID NO: 1294 - protein, 9 aa, Artificial Sequence
  Synthetic Peptide
IYYFDGNSW

SEQ ID NO: 1295 - protein, 9 aa, Artificial Sequence
  Synthetic Peptide
VYRHCEYIL

SEQ ID NO: 1296 - protein, 9 aa, Artificial Sequence
  Synthetic Peptide
TWKPTIFLL

SEQ ID NO: 1297 - protein, 9 aa, Artificial Sequence
  Synthetic Peptide
SYKVNCINF

SEQ ID NO: 1298 - protein, 9 aa, Artificial Sequence
  Synthetic Peptide
KYNYFIHFF

SEQ ID NO: 1299 - protein, 9 aa, Artificial Sequence
  Synthetic Peptide
NYFIHFFTW

SEQ ID NO: 1300 - protein, 9 aa, Artificial Sequence
  Synthetic Peptide
HFFTWGTMF

SEQ ID NO: 1301 - protein, 9 aa, Artificial Sequence
  Synthetic Peptide
MFVPKYFEL

SEQ ID NO: 1302 - protein, 9 aa, Artificial Sequence
  Synthetic Peptide
IYTIIQDQL

SEQ ID NO: 1303 - protein, 9 aa, Artificial Sequence
  Synthetic Peptide
FFLKSKFNI

SEQ ID NO: 1304 - protein, 9 aa, Artificial Sequence
  Synthetic Peptide
RMTSLKNEL

SEQ ID NO: 1305 - protein, 9 aa, Artificial Sequence
  Synthetic Peptide
YYNNFNNNY

SEQ ID NO: 1306 - protein, 9 aa, Artificial Sequence
  Synthetic Peptide
YYNKSTEKL

SEQ ID NO: 1307 - protein, 9 aa, Artificial Sequence
  Synthetic Peptide
EYEPTANLL

SEQ ID NO: 1308 - protein, 9 aa, Artificial Sequence
  Synthetic Peptide
  VARIANT 3, 9: Xaa = Any Amino Acid
VYXKHPVSX

SEQ ID NO: 1309 - protein, 9 aa, Artificial Sequence
  Synthetic Peptide
  VARIANT 5: Xaa = Any Amino Acid
TYGNXTVTV

SEQ ID NO: 1310 - protein, 9 aa, Artificial Sequence
  Synthetic Peptide
  VARIANT 9: Xaa = Any Amino Acid
KYPDRVVPX

SEQ ID NO: 1311 - protein, 9 aa, Artificial Sequence
  Synthetic Peptide
  VARIANT 4, 6, 9: Xaa = Any Amino Acid
VYVXSXVTX

SEQ ID NO: 1312 - protein, 9 aa, Artificial Sequence
  Synthetic Peptide
  VARIANT 4, 5, 6, 9: Xaa = Any Amino Acid
DAQXXXNTX

SEQ ID NO: 1313 - protein, 9 aa, Artificial Sequence
  Synthetic Peptide
KYQAVTTTL

SEQ ID NO: 1314 - protein, 11 aa, Artificial Sequence
  Synthetic Peptide
KYGPGPGTTTL

SEQ ID NO: 1315 - protein, 11 aa, Artificial Sequence
  Synthetic Peptide
KYQGPGPGTTL

SEQ ID NO: 1316 - protein, 9 aa, Artificial Sequence
  Synthetic Peptide
APGPGPGLL

SEQ ID NO: 1317 - protein, 9 aa, Artificial Sequence
  Synthetic Peptide
APRGPGPGL

SEQ ID NO: 1318 - protein, 9 aa, Artificial Sequence
  Synthetic Peptide
QPRAPIRPI

SEQ ID NO: 1319 - protein, 9 aa, Artificial Sequence
  Synthetic Peptide
YPLHEQHGM

SEQ ID NO: 1320 - protein, 9 aa, Artificial Sequence
  Synthetic Peptide
CPTVQASKL

SEQ ID NO: 1321 - protein, 8 aa, Artificial Sequence
  Synthetic Peptide
SPTYKAFL

SEQ ID NO: 1322 - protein, 8 aa, Artificial Sequence
  Synthetic Peptide
SPGPGPGL

SEQ ID NO: 1323 - protein, 10 aa, Artificial Sequence
  Synthetic Peptide
TPAGPGPGVF

SEQ ID NO: 1324 - protein, 10 aa, Artificial Sequence
  Synthetic Peptide
TPARGPGPGF

SEQ ID NO: 1325 - protein, 9 aa, Artificial Sequence
  Synthetic Peptide
TPTGWGLAI

SEQ ID NO: 1326 - protein, 9 aa, Artificial Sequence
  Synthetic Peptide
APCNFFTSA

SEQ ID NO: 1327 - protein, 9 aa, Artificial Sequence
  Synthetic Peptide
GPGHKARVI

SEQ ID NO: 1328 - protein, 11 aa, Artificial Sequence
  Synthetic Peptide
RPQVPLRPMTI

SEQ ID NO: 1329 - protein, 9 aa, Artificial Sequence
  Synthetic Peptide
FPVRPQVPI

SEQ ID NO: 1330 - protein, 9 aa, Artificial Sequence
  Synthetic Peptide
RPQVPLRPI

SEQ ID NO: 1331 - protein, 11 aa, Artificial Sequence
  Synthetic Peptide
RPQVPLRPMTI

SEQ ID NO: 1332 - protein, 9 aa, Artificial Sequence
  Synthetic Peptide
YPLTFGWCI

SEQ ID NO: 1333 - protein, 9 aa, Artificial Sequence
  Synthetic Peptide
FPLTFGWCI

SEQ ID NO: 1334 - protein, 11 aa, Artificial Sequence
  Synthetic Peptide
FPLTFGWCFKI

SEQ ID NO: 1335 - protein, 9 aa, Artificial Sequence
  Synthetic Peptide
FPVRPQVPL

SEQ ID NO: 1336 - protein, 9 aa, Artificial Sequence
  Synthetic Peptide
FPGPGPGPL

SEQ ID NO: 1337 - protein, 9 aa, Artificial Sequence
  Synthetic Peptide
FPVGPGPGL

SEQ ID NO: 1338 - protein, 9 aa, Artificial Sequence
  Synthetic Peptide
GPKVKQWPI

SEQ ID NO: 1339 - protein, 9 aa, Artificial Sequence
  Synthetic Peptide
LPPLERLTI

SEQ ID NO: 1340 - protein, 9 aa, Artificial Sequence
  Synthetic Peptide
CPEEKQRHL

SEQ ID NO: 1341 - protein, 8 aa, Artificial Sequence
  Synthetic Peptide
VPGPGPGL

SEQ ID NO: 1342 - protein, 11 aa, Artificial Sequence
  Synthetic Peptide
RPGPGPGVSEF

SEQ ID NO: 1343 - protein, 11 aa, Artificial Sequence
  Synthetic Peptide
RPRGPGPGSEF

SEQ ID NO: 1344 - protein, 11 aa, Artificial Sequence
  Synthetic Peptide
RPRFGPGPGEF

SEQ ID NO: 1345 - protein, 11 aa, Artificial Sequence
  Synthetic Peptide
RPRFRGPGPGF

SEQ ID NO: 1346 - protein, 11 aa, Artificial Sequence
  Synthetic Peptide
APGPGPGAAPA

SEQ ID NO: 1347 - protein, 11 aa, Artificial Sequence
  Synthetic Peptide
APAGPGPGAPA

SEQ ID NO: 1348 - protein, 11 aa, Artificial Sequence
  Synthetic Peptide
APAAGPGPGPA

SEQ ID NO: 1349 - protein, 11 aa, Artificial Sequence
  Synthetic Peptide
APAAPGPGPGA

SEQ ID NO: 1350 - protein, 9 aa, Artificial Sequence
  Synthetic Peptide
RPRGDNFAV

SEQ ID NO: 1351 - protein, 9 aa, Artificial Sequence
  Synthetic Peptide
RPGPGPGAV

SEQ ID NO: 1352 - protein, 9 aa, Artificial Sequence
  Synthetic Peptide
RPRGPGPGV

SEQ ID NO: 1353 - protein, 10 aa, Artificial Sequence
  Synthetic Peptide
APRTVALTAL

SEQ ID NO: 1354 - protein, 10 aa, Artificial Sequence
  Synthetic Peptide
APGPGPGTAL

SEQ ID NO: 1355 - protein, 10 aa, Artificial Sequence
  Synthetic Peptide
APRGPGPGAL

SEQ ID NO: 1356 - protein, 10 aa, Artificial Sequence
  Synthetic Peptide
APRTGPGPGL

SEQ ID NO: 1357 - protein, 9 aa, Artificial Sequence
  Synthetic Peptide
  VARIANT 1, 3: Xaa = Any Amino Acid
XVXDNATEY

SEQ ID NO: 1358 - protein, 9 aa, Artificial Sequence
  Synthetic Peptide
LGFVFTLTV

SEQ ID NO: 1359 - protein, 9 aa, Artificial Sequence
  Synthetic Peptide
SEAAYAKKI

SEQ ID NO: 1360 - protein, 9 aa, Artificial Sequence
  Synthetic Peptide
GEFPYKAAA

SEQ ID NO: 1361 - protein, 9 aa, Artificial Sequence
  Synthetic Peptide
SEAPYKAIL

SEQ ID NO: 1362 - protein, 9 aa, Artificial Sequence
  Synthetic Peptide
SEAPKYAIL

SEQ ID NO: 1363 - protein, 9 aa, Artificial Sequence
  Synthetic Peptide
AEFKYIAAV

SEQ ID NO: 1364 - protein, 9 aa, Artificial Sequence
  Synthetic Peptide
AEIPYLAKY

SEQ ID NO: 1365 - protein, 9 aa, Artificial Sequence
  Synthetic Peptide
AEIPKLAYF

SEQ ID NO: 1366 - protein, 9 aa, Artificial Sequence
  Synthetic Peptide
FPFDYAAAF

SEQ ID NO: 1367 - protein, 9 aa, Artificial Sequence
  Synthetic Peptide
FPFKYKAAF

SEQ ID NO: 1368 - protein, 9 aa, Artificial Sequence
  Synthetic Peptide
FPFKYAKAF

SEQ ID NO: 1369 - protein, 9 aa, Artificial Sequence
  Synthetic Peptide
FPFKYAAAF

SEQ ID NO: 1370 - protein, 9 aa, Artificial Sequence
  Synthetic Peptide
FAFKYAAAF

SEQ ID NO: 1371 - protein, 9 aa, Artificial Sequence
  Synthetic Peptide
FQFKYAAAF

SEQ ID NO: 1372 - protein, 9 aa, Artificial Sequence
  Synthetic Peptide
FDFKYAAAF

SEQ ID NO: 1373 - protein, 9 aa, Artificial Sequence
  Synthetic Peptide
SENDRYRLL

SEQ ID NO: 1374 - protein, 9 aa, Artificial Sequence
  Synthetic Peptide
IEDPPYNSL

SEQ ID NO: 1375 - protein, 8 aa, Artificial Sequence
  Synthetic Peptide
YEANGNLI

SEQ ID NO: 1376 - protein, 9 aa, Artificial Sequence
  Synthetic Peptide
YEDLRVLSF

SEQ ID NO: 1377 - protein, 8 aa, Artificial Sequence
  Synthetic Peptide
SDYEGRLI

SEQ ID NO: 1378 - protein, 9 aa, Artificial Sequence
  Synthetic Peptide
GEISPYPSL

SEQ ID NO: 1379 - protein, 9 aa, Artificial Sequence
  Synthetic Peptide
MDIDPYKEF

SEQ ID NO: 1380 - protein, 8 aa, Artificial Sequence
  Synthetic Peptide
LDKGIKPY

SEQ ID NO: 1381 - protein, 9 aa, Artificial Sequence
  Synthetic Peptide
ADLMGYIPL

SEQ ID NO: 1382 - protein, 9 aa, Artificial Sequence
  Synthetic Peptide
LDPYARVAI

SEQ ID NO: 1383 - protein, 9 aa, Artificial Sequence
  Synthetic Peptide
AENLWVTVY

SEQ ID NO: 1384 - protein, 9 aa, Artificial Sequence
  Synthetic Peptide
KENLWVTVY

SEQ ID NO: 1385 - protein, 9 aa, Artificial Sequence
  Synthetic Peptide
AEKLWVTVY

SEQ ID NO: 1386 - protein, 9 aa, Artificial Sequence
  Synthetic Peptide
AENKWVTVY

SEQ ID NO: 1387 - protein, 9 aa, Artificial Sequence
  Synthetic Peptide
AENLKVTVY

SEQ ID NO: 1388 - protein, 9 aa, Artificial Sequence
  Synthetic Peptide
AENLWKTVY

SEQ ID NO: 1389 - protein, 9 aa, Artificial Sequence
  Synthetic Peptide
AENLWVKVY

SEQ ID NO: 1390 - protein, 9 aa, Artificial Sequence
  Synthetic Peptide
AENLWVTKY

SEQ ID NO: 1391 - protein, 9 aa, Artificial Sequence
  Synthetic Peptide
AENLWVTVK

SEQ ID NO: 1392 - protein, 9 aa, Artificial Sequence
  Synthetic Peptide
FENLWVTVY

SEQ ID NO: 1393 - protein, 9 aa, Artificial Sequence
  Synthetic Peptide
VENLWVTVY

SEQ ID NO: 1394 - protein, 9 aa, Artificial Sequence
  Synthetic Peptide
PENLWVTVY

SEQ ID NO: 1395 - protein, 9 aa, Artificial Sequence
  Synthetic Peptide
NENLWVTVY

SEQ ID NO: 1396 - protein, 9 aa, Artificial Sequence
  Synthetic Peptide
DENLWVTVY

SEQ ID NO: 1397 - protein, 9 aa, Artificial Sequence
  Synthetic Peptide
TENLWVTVY

SEQ ID NO: 1398 - protein, 9 aa, Artificial Sequence
  Synthetic Peptide
YENLWVTVY

SEQ ID NO: 1399 - protein, 9 aa, Artificial Sequence
  Synthetic Peptide
ATNLWVTVY

SEQ ID NO: 1400 - protein, 9 aa, Artificial Sequence
  Synthetic Peptide
AEFLWVTVY

SEQ ID NO: 1401 - protein, 9 aa, Artificial Sequence
  Synthetic Peptide
AEVLWVTVY

SEQ ID NO: 1402 - protein, 9 aa, Artificial Sequence
  Synthetic Peptide
AEPLWVTVY

SEQ ID NO: 1403 - protein, 9 aa, Artificial Sequence
  Synthetic Peptide
AEDLWVTVY

SEQ ID NO: 1404 - protein, 9 aa, Artificial Sequence
  Synthetic Peptide
AENLWVTVY

SEQ ID NO: 1405 - protein, 9 aa, Artificial Sequence
  Synthetic Peptide
AETLWVTVY

SEQ ID NO: 1406 - protein, 9 aa, Artificial Sequence
  Synthetic Peptide
AENFWVTVY

SEQ ID NO: 1407 - protein, 9 aa, Artificial Sequence
  Synthetic Peptide
AENVWVTVY

SEQ ID NO: 1408 - protein, 9 aa, Artificial Sequence
  Synthetic Peptide
AENPWVTVY

SEQ ID NO: 1409 - protein, 9 aa, Artificial Sequence
  Synthetic Peptide
AENDWVTVY

SEQ ID NO: 1410 - protein, 9 aa, Artificial Sequence
  Synthetic Peptide
AENNWVTVY

SEQ ID NO: 1411 - protein, 9 aa, Artificial Sequence
  Synthetic Peptide
AENTWVTVY

SEQ ID NO: 1412 - protein, 9 aa, Artificial Sequence
  Synthetic Peptide
AENLFVTVY

SEQ ID NO: 1413 - protein, 9 aa, Artificial Sequence
  Synthetic Peptide
AENLVVTVY

SEQ ID NO: 1414 - protein, 9 aa, Artificial Sequence
  Synthetic Peptide
AENLPVTVY

SEQ ID NO: 1415 - protein, 9 aa, Artificial Sequence
  Synthetic Peptide
AENLDVTVY

SEQ ID NO: 1416 - protein, 9 aa, Artificial Sequence
  Synthetic Peptide
AENLNVTVY

SEQ ID NO: 1417 - protein, 9 aa, Artificial Sequence
  Synthetic Peptide
AENLTVTVY

SEQ ID NO: 1418 - protein, 9 aa, Artificial Sequence
  Synthetic Peptide
AENLWFTVY

SEQ ID NO: 1419 - protein, 9 aa, Artificial Sequence
  Synthetic Peptide
AENLWLTVY

SEQ ID NO: 1420 - protein, 9 aa, Artificial Sequence
  Synthetic Peptide
AENLWPTVY

SEQ ID NO: 1421 - protein, 9 aa, Artificial Sequence
  Synthetic Peptide
AENLWDTVY

SEQ ID NO: 1422 - protein, 9 aa, Artificial Sequence
  Synthetic Peptide
AENLWNTVY

SEQ ID NO: 1423 - protein, 9 aa, Artificial Sequence
  Synthetic Peptide
AENLWTTVY

SEQ ID NO: 1424 - protein, 9 aa, Artificial Sequence
  Synthetic Peptide
AENLWVFVY

SEQ ID NO: 1425 - protein, 9 aa, Artificial Sequence
  Synthetic Peptide
AENLWVVVY

SEQ ID NO: 1426 - protein, 9 aa, Artificial Sequence
  Synthetic Peptide
AENLWVPVY

SEQ ID NO: 1427 - protein, 9 aa, Artificial Sequence
  Synthetic Peptide
AENLWVDVY

SEQ ID NO: 1428 - protein, 9 aa, Artificial Sequence
  Synthetic Peptide
AENLWVNVY

SEQ ID NO: 1429 - protein, 9 aa, Artificial Sequence
  Synthetic Peptide
AENLWVSVY

SEQ ID NO: 1430 - protein, 9 aa, Artificial Sequence
  Synthetic Peptide
AENLWVTFY

SEQ ID NO: 1431 - protein, 9 aa, Artificial Sequence
  Synthetic Peptide
AENLWVTLY

SEQ ID NO: 1432 - protein, 9 aa, Artificial Sequence
  Synthetic Peptide
AENLWVTPY

SEQ ID NO: 1433 - protein, 9 aa, Artificial Sequence
  Synthetic Peptide
AENLWVTDY

SEQ ID NO: 1434 - protein, 9 aa, Artificial Sequence
  Synthetic Peptide
AENLWVTNY

SEQ ID NO: 1435 - protein, 9 aa, Artificial Sequence
  Synthetic Peptide
AENLWVTTY

SEQ ID NO: 1436 - protein, 9 aa, Artificial Sequence
  Synthetic Peptide
AENLWVTVA

SEQ ID NO: 1437 - protein, 9 aa, Artificial Sequence
  Synthetic Peptide
AENLWVTVC

SEQ ID NO: 1438 - protein, 9 aa, Artificial Sequence
  Synthetic Peptide
AENLWVTVE

SEQ ID NO: 1439 - protein, 9 aa, Artificial Sequence
  Synthetic Peptide
AENLWVTVF

SEQ ID NO: 1440 - protein, 9 aa, Artificial Sequence
  Synthetic Peptide
AENLWVTVG

SEQ ID NO: 1441 - protein, 9 aa, Artificial Sequence
  Synthetic Peptide
AENLWVTVH

SEQ ID NO: 1442 - protein, 9 aa, Artificial Sequence
  Synthetic Peptide
AENLWVTVI

SEQ ID NO: 1443 - protein, 9 aa, Artificial Sequence
  Synthetic Peptide
AENLWVTVL

SEQ ID NO: 1444 - protein, 9 aa, Artificial Sequence
  Synthetic Peptide
AENLWVTVM

SEQ ID NO: 1445 - protein, 9 aa, Artificial Sequence
  Synthetic Peptide
AENLWVTVN

SEQ ID NO: 1446 - protein, 9 aa, Artificial Sequence
  Synthetic Peptide
AENLWVTVP

SEQ ID NO: 1447 - protein, 9 aa, Artificial Sequence
  Synthetic Peptide
AENLWVTVQ

SEQ ID NO: 1448 - protein, 9 aa, Artificial Sequence
  Synthetic Peptide
AENLWVTVR

SEQ ID NO: 1449 - protein, 9 aa, Artificial Sequence
  Synthetic Peptide
AENLWVTVS

SEQ ID NO: 1450 - protein, 9 aa, Artificial Sequence
  Synthetic Peptide
AENLWVTVT

SEQ ID NO: 1451 - protein, 9 aa, Artificial Sequence
  Synthetic Peptide
AENLWVTVV

SEQ ID NO: 1452 - protein, 9 aa, Artificial Sequence
  Synthetic Peptide
AENLWVTVW

SEQ ID NO: 1453 - protein, 9 aa, Artificial Sequence
  Synthetic Peptide
AENLWVTVY

SEQ ID NO: 1454 - protein, 9 aa, Artificial Sequence
  Synthetic Peptide
AENLYVTVF

SEQ ID NO: 1455 - protein, 11 aa, Artificial Sequence
  Synthetic Peptide
TEPAAVGVGAV

SEQ ID NO: 1456 - protein, 8 aa, Artificial Sequence
  Synthetic Peptide
AEPAAEGV

SEQ ID NO: 1457 - protein, 10 aa, Artificial Sequence
  Synthetic Peptide
AEPAAEGVGA

SEQ ID NO: 1458 - protein, 11 aa, Artificial Sequence
  Synthetic Peptide
AEPAAEGVGAV

SEQ ID NO: 1459 - protein, 10 aa, Artificial Sequence
  Synthetic Peptide
QEEEEVGFPV

SEQ ID NO: 1460 - protein, 9 aa, Artificial Sequence
  Synthetic Peptide
EEEEVGFPV

SEQ ID NO: 1461 - protein, 8 aa, Artificial Sequence
  Synthetic Peptide
EEEVGFPV

SEQ ID NO: 1462 - protein, 11 aa, Artificial Sequence
  Synthetic Peptide
EEVGFPVRPQV

SEQ ID NO: 1463 - protein, 8 aa, Artificial Sequence
  Synthetic Peptide
DEEVGFPV

SEQ ID NO: 1464 - protein, 9 aa, Artificial Sequence
  Synthetic Peptide
KEKGGLDGL

SEQ ID NO: 1465 - protein, 10 aa, Artificial Sequence
  Synthetic Peptide
KEKGGLDGLI

SEQ ID NO: 1466 - protein, 8 aa, Artificial Sequence
  Synthetic Peptide
QEILDLWV

SEQ ID NO: 1467 - protein, 9 aa, Artificial Sequence
  Synthetic Peptide
QEILDLWVY

SEQ ID NO: 1468 - protein, 9 aa, Artificial Sequence
  Synthetic Peptide
AETFYVDGA

SEQ ID NO: 1469 - protein, 10 aa, Artificial Sequence
  Synthetic Peptide
EEKPRTLHDL

SEQ ID NO: 1470 - protein, 9 aa, Artificial Sequence
  Synthetic Peptide
NEILIRCII

SEQ ID NO: 1471 - protein, 9 aa, Artificial Sequence
  Synthetic Peptide
QEKKRHVDL

SEQ ID NO: 1472 - protein, 8 aa, Artificial Sequence
  Synthetic Peptide
AEGKEVLL

SEQ ID NO: 1473 - protein, 8 aa, Artificial Sequence
  Synthetic Peptide
QELFIPNI

SEQ ID NO: 1474 - protein, 8 aa, Artificial Sequence
  Synthetic Peptide
QELFISNI

SEQ ID NO: 1475 - protein, 8 aa, Artificial Sequence
  Synthetic Peptide
TEKNSGLY

SEQ ID NO: 1476 - protein, 8 aa, Artificial Sequence
  Synthetic Peptide
AELPKPSI

SEQ ID NO: 1477 - protein, 8 aa, Artificial Sequence
  Synthetic Peptide
PEAQNTTY

SEQ ID NO: 1478 - protein, 9 aa, Artificial Sequence
  Synthetic Peptide
IESTPFNVA

SEQ ID NO: 1479 - protein, 9 aa, Artificial Sequence
  Synthetic Peptide
AEGKEVLLL

SEQ ID NO: 1480 - protein, 9 aa, Artificial Sequence
  Synthetic Peptide
EEATGQFRV

SEQ ID NO: 1481 - protein, 9 aa, Artificial Sequence
  Synthetic Peptide
VEDKDAVAF

SEQ ID NO: 1482 - protein, 9 aa, Artificial Sequence
  Synthetic Peptide
CEPETQDAT

SEQ ID NO: 1483 - protein, 9 aa, Artificial Sequence
  Synthetic Peptide
PETQDATYL

SEQ ID NO: 1484 - protein, 9 aa, Artificial Sequence
  Synthetic Peptide
CETQNPVSA

SEQ ID NO: 1485 - protein, 9 aa, Artificial Sequence
  Synthetic Peptide
QELFIPNIT

SEQ ID NO: 1486 - protein, 9 aa, Artificial Sequence
  Synthetic Peptide
AEPPKPFIT

SEQ ID NO: 1487 - protein, 9 aa, Artificial Sequence
  Synthetic Peptide
VEDEDAVAL

SEQ ID NO: 1488 - protein, 9 aa, Artificial Sequence
  Synthetic Peptide
CEPEIQNTT

SEQ ID NO: 1489 - protein, 9 aa, Artificial Sequence
  Synthetic Peptide
PEIQNTTYL

SEQ ID NO: 1490 - protein, 9 aa, Artificial Sequence
  Synthetic Peptide
YECGIQNEL

SEQ ID NO: 1491 - protein, 9 aa, Artificial Sequence
  Synthetic Peptide
QELFISNIT

SEQ ID NO: 1492 - protein, 9 aa, Artificial Sequence
  Synthetic Peptide
TEKNSGLYT

SEQ ID NO: 1493 - protein, 10 aa, Artificial Sequence
  Synthetic Peptide
AEGKEVLLLV

SEQ ID NO: 1494 - protein, 10 aa, Artificial Sequence
  Synthetic Peptide
KEVLLLVHNL

SEQ ID NO: 1495 - protein, 10 aa, Artificial Sequence
  Synthetic Peptide
GERVDGNRQI

SEQ ID NO: 1496 - protein, 10 aa, Artificial Sequence
  Synthetic Peptide
REIIYPNASL

SEQ ID NO: 1497 - protein, 10 aa, Artificial Sequence
  Synthetic Peptide
NEEATGQFRV

SEQ ID NO: 1498 - protein, 10 aa, Artificial Sequence
  Synthetic Peptide
EEATGQFRVY

SEQ ID NO: 1499 - protein, 10 aa, Artificial Sequence
  Synthetic Peptide
GENLNLSCHA

SEQ ID NO: 1500 - protein, 10 aa, Artificial Sequence
  Synthetic Peptide
QELFIPNITV

SEQ ID NO: 1501 - protein, 10 aa, Artificial Sequence
  Synthetic Peptide
CEPEIQNTTY

SEQ ID NO: 1502 - protein, 10 aa, Artificial Sequence
  Synthetic Peptide
PEIQNTTYLW

SEQ ID NO: 1503 - protein, 10 aa, Artificial Sequence
  Synthetic Peptide
CEPEAQNTTY

SEQ ID NO: 1504 - protein, 10 aa, Artificial Sequence
  Synthetic Peptide
PEAQNTTYLW

SEQ ID NO: 1505 - protein, 11 aa, Artificial Sequence
  Synthetic Peptide
MESPSAPPHRW

SEQ ID NO: 1506 - protein, 11 aa, Artificial Sequence
  Synthetic Peptide
IESTPFNVAEG

SEQ ID NO: 1507 - protein, 11 aa, Artificial Sequence
  Synthetic Peptide
GERVDGNRQII

SEQ ID NO: 1508 - protein, 11 aa, Artificial Sequence
  Synthetic Peptide
REIIYPNASLL

SEQ ID NO: 1509 - protein, 11 aa, Artificial Sequence
  Synthetic Peptide
NEEATGQFRVY

SEQ ID NO: 1510 - protein, 11 aa, Artificial Sequence
  Synthetic Peptide
CEPETQDATYL

SEQ ID NO: 1511 - protein, 11 aa, Artificial Sequence
  Synthetic Peptide
GENLNLSCHAA

SEQ ID NO: 1512 - protein, 11 aa, Artificial Sequence
  Synthetic Peptide
CEPEIQNTTYL

SEQ ID NO: 1513 - protein, 11 aa, Artificial Sequence
  Synthetic Peptide
PEIQNTTYLWW

SEQ ID NO: 1514 - protein, 11 aa, Artificial Sequence
  Synthetic Peptide
YECGIQNELSV

SEQ ID NO: 1515 - protein, 11 aa, Artificial Sequence
  Synthetic Peptide
NELSVDHSDPV

SEQ ID NO: 1516 - protein, 11 aa, Artificial Sequence
  Synthetic Peptide
CEPEAQNTTYL

SEQ ID NO: 1517 - protein, 11 aa, Artificial Sequence
  Synthetic Peptide
PEAQNTTYLWW

SEQ ID NO: 1518 - protein, 12 aa, Artificial Sequence
  Synthetic Peptide
PEIQNTTYLWWV

SEQ ID NO: 1519 - protein, 12 aa, Artificial Sequence
  Synthetic Peptide
PEAQNTTYLWWV

SEQ ID NO: 1520 - protein, 13 aa, Artificial Sequence
  Synthetic Peptide
CEPEIQNTTYLWW

SEQ ID NO: 1521 - protein, 10 aa, Artificial Sequence
  Synthetic Peptide
AEMGKGSFKY

SEQ ID NO: 1522 - protein, 7 aa, Artificial Sequence
  Synthetic Peptide
SEDCQSL

SEQ ID NO: 1523 - protein, 7 aa, Artificial Sequence
  Synthetic Peptide
REVRAVT

SEQ ID NO: 1524 - protein, 7 aa, Artificial Sequence
  Synthetic Peptide
FETLEEI

SEQ ID NO: 1525 - protein, 7 aa, Artificial Sequence
  Synthetic Peptide
TELVEPL

SEQ ID NO: 1526 - protein, 7 aa, Artificial Sequence
  Synthetic Peptide
SECRPRF

SEQ ID NO: 1527 - protein, 8 aa, Artificial Sequence
  Synthetic Peptide
PETHLDML

SEQ ID NO: 1528 - protein, 8 aa, Artificial Sequence
  Synthetic Peptide
QEVQGYVL

SEQ ID NO: 1529 - protein, 8 aa, Artificial Sequence
  Synthetic Peptide
RELQLRSL

SEQ ID NO: 1530 - protein, 8 aa, Artificial Sequence
  Synthetic Peptide
CELHCPAL

SEQ ID NO: 1531 - protein, 8 aa, Artificial Sequence
  Synthetic Peptide
LEEITGYL

SEQ ID NO: 1532 - protein, 8 aa, Artificial Sequence
  Synthetic Peptide
EEITGYLY

SEQ ID NO: 1533 - protein, 8 aa, Artificial Sequence
  Synthetic Peptide
DECVGEGL

SEQ ID NO: 1534 - protein, 8 aa, Artificial Sequence
  Synthetic Peptide
AEQRASPL

SEQ ID NO: 1535 - protein, 8 aa, Artificial Sequence
  Synthetic Peptide
KEILDEAY

SEQ ID NO: 1536 - protein, 8 aa, Artificial Sequence
  Synthetic Peptide
EEAPRSPL

SEQ ID NO: 1537 - protein, 8 aa, Artificial Sequence
  Synthetic Peptide
SEDPTVPL

SEQ ID NO: 1538 - protein, 9 aa, Artificial Sequence
  Synthetic Peptide
MELAALCRW

SEQ ID NO: 1539 - protein, 9 aa, Artificial Sequence
  Synthetic Peptide
QEVQGYVLI

SEQ ID NO: 1540 - protein, 9 aa, Artificial Sequence
  Synthetic Peptide
FEDNYALAV

SEQ ID NO: 1541 - protein, 9 aa, Artificial Sequence
  Synthetic Peptide
RELQLRSLT

SEQ ID NO: 1542 - protein, 9 aa, Artificial Sequence
  Synthetic Peptide
TEILKGGVL

SEQ ID NO: 1543 - protein, 9 aa, Artificial Sequence
  Synthetic Peptide
HEQCAAGCT

SEQ ID NO: 1544 - protein, 9 aa, Artificial Sequence
  Synthetic Peptide
CELHCPALV

SEQ ID NO: 1545 - protein, 9 aa, Artificial Sequence
  Synthetic Peptide
FESMPNPEG

SEQ ID NO: 1546 - protein, 9 aa, Artificial Sequence
  Synthetic Peptide
QEVTAEDGT

SEQ ID NO: 1547 - protein, 9 aa, Artificial Sequence
  Synthetic Peptide
CEKCSKPCA

SEQ ID NO: 1548 - protein, 9 aa, Artificial Sequence
  Synthetic Peptide
MEHLREVRA

SEQ ID NO: 1549 - protein, 9 aa, Artificial Sequence
  Synthetic Peptide
REVRAVTSA

SEQ ID NO: 1550 - protein, 9 aa, Artificial Sequence
  Synthetic Peptide
QEFAGCKKI

SEQ ID NO: 1551 - protein, 9 aa, Artificial Sequence
  Synthetic Peptide
EEITGYLYI

SEQ ID NO: 1552 - protein, 9 aa, Artificial Sequence
  Synthetic Peptide
RELGSGLAL

SEQ ID NO: 1553 - protein, 9 aa, Artificial Sequence
  Synthetic Peptide
GEGLACHQL

SEQ ID NO: 1554 - protein, 9 aa, Artificial Sequence
  Synthetic Peptide
QECVEECRV

SEQ ID NO: 1555 - protein, 9 aa, Artificial Sequence
  Synthetic Peptide
VEECRVLQG

SEQ ID NO: 1556 - protein, 9 aa, Artificial Sequence
  Synthetic Peptide
EECRVLQGL

SEQ ID NO: 1557 - protein, 9 aa, Artificial Sequence
  Synthetic Peptide
AEQRASPLT

SEQ ID NO: 1558 - protein, 9 aa, Artificial Sequence
  Synthetic Peptide
QETELVEPL

SEQ ID NO: 1559 - protein, 9 aa, Artificial Sequence
  Synthetic Peptide
VEPLTPSGA

SEQ ID NO: 1560 - protein, 9 aa, Artificial Sequence
  Synthetic Peptide
TELRKVKVL

SEQ ID NO: 1561 - protein, 9 aa, Artificial Sequence
  Synthetic Peptide
GENVKIPVA

SEQ ID NO: 1562 - protein, 9 aa, Artificial Sequence
  Synthetic Peptide
KEILDEAYV

SEQ ID NO: 1563 - protein, 9 aa, Artificial Sequence
  Synthetic Peptide
DEAYVMAGV

SEQ ID NO: 1564 - protein, 9 aa, Artificial Sequence
  Synthetic Peptide
DETEYHADG

SEQ ID NO: 1565 - protein, 9 aa, Artificial Sequence
  Synthetic Peptide
LESILRRRF

SEQ ID NO: 1566 - protein, 9 aa, Artificial Sequence
  Synthetic Peptide
GERLPQPPI

SEQ ID NO: 1567 - protein, 9 aa, Artificial Sequence
  Synthetic Peptide
LEDDDMGDL

SEQ ID NO: 1568 - protein, 9 aa, Artificial Sequence
  Synthetic Peptide
EEYLVPQQG

SEQ ID NO: 1569 - protein, 9 aa, Artificial Sequence
  Synthetic Peptide
EEEAPRSPL

SEQ ID NO: 1570 - protein, 9 aa, Artificial Sequence
  Synthetic Peptide
EEAPRSPLA

SEQ ID NO: 1571 - protein, 9 aa, Artificial Sequence
  Synthetic Peptide
SEGAGSDVF

SEQ ID NO: 1572 - protein, 9 aa, Artificial Sequence
  Synthetic Peptide
PEYVNQPDV

SEQ ID NO: 1573 - protein, 9 aa, Artificial Sequence
  Synthetic Peptide
PEYLTPQGG

SEQ ID NO: 1574 - protein, 9 aa, Artificial Sequence
  Synthetic Peptide
PERGAPPST

SEQ ID NO: 1575 - protein, 9 aa, Artificial Sequence
  Synthetic Peptide
AENPEYLGL

SEQ ID NO: 1576 - protein, 10 aa, Artificial Sequence
  Synthetic Peptide
MELAALCRWG

SEQ ID NO: 1577 - protein, 10 aa, Artificial Sequence
  Synthetic Peptide
LELTYLPTNA

SEQ ID NO: 1578 - protein, 10 aa, Artificial Sequence
  Synthetic Peptide
QEVQGYVLIA

SEQ ID NO: 1579 - protein, 10 aa, Artificial Sequence
  Synthetic Peptide
FEDNYALAVL

SEQ ID NO: 1580 - protein, 10 aa, Artificial Sequence
  Synthetic Peptide
TEILKGGVLI

SEQ ID NO: 1581 - protein, 10 aa, Artificial Sequence
  Synthetic Peptide
GESSEDCQSL

SEQ ID NO: 1582 - protein, 10 aa, Artificial Sequence
  Synthetic Peptide
SEDCQSLTRT

SEQ ID NO: 1583 - protein, 10 aa, Artificial Sequence
  Synthetic Peptide
CELHCPALVT

SEQ ID NO: 1584 - protein, 10 aa, Artificial Sequence
  Synthetic Peptide
MEHLREVRAV

SEQ ID NO: 1585 - protein, 10 aa, Artificial Sequence
  Synthetic Peptide
QEFAGCKKIF

SEQ ID NO: 1586 - protein, 10 aa, Artificial Sequence
  Synthetic Peptide
FETLEEITGY

SEQ ID NO: 1587 - protein, 10 aa, Artificial Sequence
  Synthetic Peptide
LEEITGYLYI

SEQ ID NO: 1588 - protein, 10 aa, Artificial Sequence
  Synthetic Peptide
RELGSGLALI

SEQ ID NO: 1589 - protein, 10 aa, Artificial Sequence
  Synthetic Peptide
PEDECVGEGL

SEQ ID NO: 1590 - protein, 10 aa, Artificial Sequence
  Synthetic Peptide
QECVEECRVL

SEQ ID NO: 1591 - protein, 10 aa, Artificial Sequence
  Synthetic Peptide
VEECRVLQGL

SEQ ID NO: 1592 - protein, 10 aa, Artificial Sequence
  Synthetic Peptide
REYVNARHCL

SEQ ID NO: 1593 - protein, 10 aa, Artificial Sequence
  Synthetic Peptide
PECQPQNGSV

SEQ ID NO: 1594 - protein, 10 aa, Artificial Sequence
  Synthetic Peptide
EEGACQPCPI

SEQ ID NO: 1595 - protein, 10 aa, Artificial Sequence
  Synthetic Peptide
QETELVEPLT

SEQ ID NO: 1596 - protein, 10 aa, Artificial Sequence
  Synthetic Peptide
VEPLTPSGAM

SEQ ID NO: 1597 - protein, 10 aa, Artificial Sequence
  Synthetic Peptide
KETELRKVKV

SEQ ID NO: 1598 - protein, 10 aa, Artificial Sequence
  Synthetic Peptide
TELRKVKVLG

SEQ ID NO: 1599 - protein, 10 aa, Artificial Sequence
  Synthetic Peptide
GENVKIPVAI

SEQ ID NO: 1600 - protein, 10 aa, Artificial Sequence
  Synthetic Peptide
KEILDEAYVM

SEQ ID NO: 1601 - protein, 10 aa, Artificial Sequence
  Synthetic Peptide
DEAYVMAGVG

SEQ ID NO: 1602 - protein, 10 aa, Artificial Sequence
  Synthetic Peptide
DETEYHADGG

SEQ ID NO: 1603 - protein, 10 aa, Artificial Sequence
  Synthetic Peptide
TEYHADGGKV

SEQ ID NO: 1604 - protein, 10 aa, Artificial Sequence
  Synthetic Peptide
LESILRRRFT

SEQ ID NO: 1605 - protein, 10 aa, Artificial Sequence
  Synthetic Peptide
REIPDLLEKG

SEQ ID NO: 1606 - protein, 10 aa, Artificial Sequence
  Synthetic Peptide
SECRPRFREL

SEQ ID NO: 1607 - protein, 10 aa, Artificial Sequence
  Synthetic Peptide
RELVSEFSRM

SEQ ID NO: 1608 - protein, 10 aa, Artificial Sequence
  Synthetic Peptide
NEDLGPASPL

SEQ ID NO: 1609 - protein, 10 aa, Artificial Sequence
  Synthetic Peptide
AEEYLVPQQG

SEQ ID NO: 1610 - protein, 10 aa, Artificial Sequence
  Synthetic Peptide
EEYLVPQQGF

SEQ ID NO: 1611 - protein, 10 aa, Artificial Sequence
  Synthetic Peptide
SEEEAPRSPL

SEQ ID NO: 1612 - protein, 10 aa, Artificial Sequence
  Synthetic Peptide
EEEAPRSPLA

SEQ ID NO: 1613 - protein, 10 aa, Artificial Sequence
  Synthetic Peptide
SETDGYVAPL

SEQ ID NO: 1614 - protein, 10 aa, Artificial Sequence
  Synthetic Peptide
PERGAPPSTF

SEQ ID NO: 1615 - protein, 10 aa, Artificial Sequence
  Synthetic Peptide
PEYLGLDVPV

SEQ ID NO: 1616 - protein, 11 aa, Artificial Sequence
  Synthetic Peptide
MELAALCRWGL

SEQ ID NO: 1617 - protein, 11 aa, Artificial Sequence
  Synthetic Peptide
PETHLDMLRHL

SEQ ID NO: 1618 - protein, 11 aa, Artificial Sequence
  Synthetic Peptide
RELQLRSLTEI

SEQ ID NO: 1619 - protein, 11 aa, Artificial Sequence
  Synthetic Peptide
GESSEDCQSLT

SEQ ID NO: 1620 - protein, 11 aa, Artificial Sequence
  Synthetic Peptide
SEDCQSLTRTV

SEQ ID NO: 1621 - protein, 11 aa, Artificial Sequence
  Synthetic Peptide
CELHCPALVTY

SEQ ID NO: 1622 - protein, 11 aa, Artificial Sequence
  Synthetic Peptide
FESMPNPEGRY

SEQ ID NO: 1623 - protein, 11 aa, Artificial Sequence
  Synthetic Peptide
CEKCSKPCARV

SEQ ID NO: 1624 - protein, 11 aa, Artificial Sequence
  Synthetic Peptide
MEHLREVRAVT

SEQ ID NO: 1625 - protein, 11 aa, Artificial Sequence
  Synthetic Peptide
REVRAVTSANI

SEQ ID NO: 1626 - protein, 11 aa, Artificial Sequence
  Synthetic Peptide
QEFAGCKKIFG

SEQ ID NO: 1627 - protein, 11 aa, Artificial Sequence
  Synthetic Peptide
FETLEEITGYL

SEQ ID NO: 1628 - protein, 11 aa, Artificial Sequence
  Synthetic Peptide
EEITGYLYISA

SEQ ID NO: 1629 - protein, 11 aa, Artificial Sequence
  Synthetic Peptide
GEGLACHQLCA

SEQ ID NO: 1630 - protein, 11 aa, Artificial Sequence
  Synthetic Peptide
DEEGACQPCPI

SEQ ID NO: 1631 - protein, 11 aa, Artificial Sequence
  Synthetic Peptide
AEQRASPLTSI

SEQ ID NO: 1632 - protein, 11 aa, Artificial Sequence
  Synthetic Peptide
TELVEPLTPSG

SEQ ID NO: 1633 - protein, 11 aa, Artificial Sequence
  Synthetic Peptide
KETELRKVKVL

SEQ ID NO: 1634 - protein, 11 aa, Artificial Sequence
  Synthetic Peptide
KEILDEAYVMA

SEQ ID NO: 1635 - protein, 11 aa, Artificial Sequence
  Synthetic Peptide
LEDVRLVHRDL

SEQ ID NO: 1636 - protein, 11 aa, Artificial Sequence
  Synthetic Peptide
WELMTFGAKPY

SEQ ID NO: 1637 - protein, 11 aa, Artificial Sequence
  Synthetic Peptide
GERLPQPPICT

SEQ ID NO: 1638 - protein, 11 aa, Artificial Sequence
  Synthetic Peptide
SECRPRFRELV

SEQ ID NO: 1639 - protein, 11 aa, Artificial Sequence
  Synthetic Peptide
RELVSEFSRMA

SEQ ID NO: 1640 - protein, 11 aa, Artificial Sequence
  Synthetic Peptide
AEEYLVPQQGF

SEQ ID NO: 1641 - protein, 11 aa, Artificial Sequence
  Synthetic Peptide
EEYLVPQQGFF

SEQ ID NO: 1642 - protein, 11 aa, Artificial Sequence
  Synthetic Peptide
SEEEAPRSPLA

SEQ ID NO: 1643 - protein, 11 aa, Artificial Sequence
  Synthetic Peptide
SEGAGSDVFDG

SEQ ID NO: 1644 - protein, 11 aa, Artificial Sequence
  Synthetic Peptide
SETDGYVAPLT

SEQ ID NO: 1645 - protein, 11 aa, Artificial Sequence
  Synthetic Peptide
REGPLPAARPA

SEQ ID NO: 1646 - protein, 11 aa, Artificial Sequence
  Synthetic Peptide
VENPEYLTPQG

SEQ ID NO: 1647 - protein, 11 aa, Artificial Sequence
  Synthetic Peptide
PEYLTPQGGAA

SEQ ID NO: 1648 - protein, 11 aa, Artificial Sequence
  Synthetic Peptide
AENPEYLGLDV

SEQ ID NO: 1649 - protein, 12 aa, Artificial Sequence
  Synthetic Peptide
LELTYLPTNASL

SEQ ID NO: 1650 - protein, 12 aa, Artificial Sequence
  Synthetic Peptide
RELQLRSLTEIL

SEQ ID NO: 1651 - protein, 12 aa, Artificial Sequence
  Synthetic Peptide
PEGRYTFGASCV

SEQ ID NO: 1652 - protein, 12 aa, Artificial Sequence
  Synthetic Peptide
LEEITGYLYISA

SEQ ID NO: 1653 - protein, 12 aa, Artificial Sequence
  Synthetic Peptide
EEITGYLYISAW

SEQ ID NO: 1654 - protein, 12 aa, Artificial Sequence
  Synthetic Peptide
PEADQCVACAHY

SEQ ID NO: 1655 - protein, 12 aa, Artificial Sequence
  Synthetic Peptide
TELVEPLTPSGA

SEQ ID NO: 1656 - protein, 12 aa, Artificial Sequence
  Synthetic Peptide
TEYHADGGKVPI

SEQ ID NO: 1657 - protein, 12 aa, Artificial Sequence
  Synthetic Peptide
GERLPQPPICTI

SEQ ID NO: 1658 - protein, 12 aa, Artificial Sequence
  Synthetic Peptide
AEEYLVPQQGFF

SEQ ID NO: 1659 - protein, 13 aa, Artificial Sequence
  Synthetic Peptide
PEGRYTFGASCVT

SEQ ID NO: 1660 - protein, 13 aa, Artificial Sequence
  Synthetic Peptide
CEKCSKPCARVCY

SEQ ID NO: 1661 - protein, 13 aa, Artificial Sequence
  Synthetic Peptide
MEHLREVRAVTSA

SEQ ID NO: 1662 - protein, 13 aa, Artificial Sequence
  Synthetic Peptide
DECVGEGLACHQL

SEQ ID NO: 1663 - protein, 13 aa, Artificial Sequence
  Synthetic Peptide
PECQPQNGSVTCF

SEQ ID NO: 1664 - protein, 13 aa, Artificial Sequence
  Synthetic Peptide
RENTSPKANKEIL

SEQ ID NO: 1665 - protein, 13 aa, Artificial Sequence
  Synthetic Peptide
REIPDLLEKGERL

SEQ ID NO: 1666 - protein, 13 aa, Artificial Sequence
  Synthetic Peptide
SEFSRMARDPQRF

SEQ ID NO: 1667 - protein, 13 aa, Artificial Sequence
  Synthetic Peptide
SEGAGSDVFDGDL

SEQ ID NO: 1668 - protein, 9 aa, Artificial Sequence
  Synthetic Peptide
GEFGGYGSV

SEQ ID NO: 1669 - protein, 15 aa, Artificial Sequence [sequence omitted]

SEQ ID NO: 1670 - protein, 7 aa, Artificial Sequence
  Synthetic Peptide
SEFQAAI

SEQ ID NO: 1671 - protein, 7 aa, Artificial Sequence
  Synthetic Peptide
SEYLQLV

SEQ ID NO: 1672 - protein, 7 aa, Artificial Sequence
  Synthetic Peptide
WEELSML

SEQ ID NO: 1673 - protein, 7 aa, Artificial Sequence
  Synthetic Peptide
GEPHISY

SEQ ID NO: 1674 - protein, 8 aa, Artificial Sequence
  Synthetic Peptide
LEARGEAL

SEQ ID NO: 1675 - protein, 8 aa, Artificial Sequence
  Synthetic Peptide
QEEEGPRM

SEQ ID NO: 1676 - protein, 8 aa, Artificial Sequence
  Synthetic Peptide
EEEGPRMF

SEQ ID NO: 1677 - protein, 8 aa, Artificial Sequence
  Synthetic Peptide
VELVHFLL

SEQ ID NO: 1678 - protein, 8 aa, Artificial Sequence
  Synthetic Peptide
AEMLESVL

SEQ ID NO: 1679 - protein, 8 aa, Artificial Sequence
  Synthetic Peptide
SEYLQLVF

SEQ ID NO: 1680 - protein, 8 aa, Artificial Sequence
  Synthetic Peptide
EEKIWEEL

SEQ ID NO: 1681 - protein, 9 aa, Artificial Sequence
  Synthetic Peptide
LEARGEALG

SEQ ID NO: 1682 - protein, 9 aa, Artificial Sequence
  Synthetic Peptide
GEALGLVGA

SEQ ID NO: 1683 - protein, 9 aa, Artificial Sequence
  Synthetic Peptide
QEEEGPRMF

SEQ ID NO: 1684 - protein, 9 aa, Artificial Sequence
  Synthetic Peptide
VELVHFLLL

SEQ ID NO: 1685 - protein, 9 aa, Artificial Sequence
  Synthetic Peptide
REPVTKAEM

SEQ ID NO: 1686 - protein, 9 aa, Artificial Sequence
  Synthetic Peptide
SEYLQLVFG

SEQ ID NO: 1687 - protein, 9 aa, Artificial Sequence
  Synthetic Peptide
PEEKIWEEL

SEQ ID NO: 1688 - protein, 9 aa, Artificial Sequence
  Synthetic Peptide
EELSMLEVF

SEQ ID NO: 1689 - protein, 9 aa, Artificial Sequence
  Synthetic Peptide
FEGREDSVF

SEQ ID NO: 1690 - protein, 9 aa, Artificial Sequence
  Synthetic Peptide
YEFLWGPRA

SEQ ID NO: 1691 - protein, 10 aa, Artificial Sequence
  Synthetic Peptide
EEGLEARGEA

SEQ ID NO: 1692 - protein, 10 aa, Artificial Sequence
  Synthetic Peptide
LEARGEALGL

SEQ ID NO: 1693 - protein, 10 aa, Artificial Sequence
  Synthetic Peptide
VEVTLGEVPA

SEQ ID NO: 1694 - protein, 10 aa, Artificial Sequence
  Synthetic Peptide
EEGPRMFPDL

SEQ ID NO: 1695 - protein, 10 aa, Artificial Sequence
  Synthetic Peptide
REPVTKAEML

SEQ ID NO: 1696 - protein, 10 aa, Artificial Sequence
  Synthetic Peptide
SEYLQLVFGI

SEQ ID NO: 1697 - protein, 10 aa, Artificial Sequence
  Synthetic Peptide
VEVVPISHLY

SEQ ID NO: 1698 - protein, 10 aa, Artificial Sequence
  Synthetic Peptide
EEKIWEELSM

SEQ ID NO: 1699 - protein, 10 aa, Artificial Sequence
  Synthetic Peptide
WEELSMLEVF

SEQ ID NO: 1700 - protein, 10 aa, Artificial Sequence
  Synthetic Peptide
FEGREDSVFA

SEQ ID NO: 1701 - protein, 10 aa, Artificial Sequence
  Synthetic Peptide
QENYLEYRQV

SEQ ID NO: 1702 - protein, 10 aa, Artificial Sequence
  Synthetic Peptide
YEFLWGPRAL

SEQ ID NO: 1703 - protein, 10 aa, Artificial Sequence
  Synthetic Peptide
GEPHISYPPL

SEQ ID NO: 1704 - protein, 11 aa, Artificial Sequence
  Synthetic Peptide
EEGLEARGEAL

SEQ ID NO: 1705 - protein, 11 aa, Artificial Sequence
  Synthetic Peptide
LEARGEALGLV

SEQ ID NO: 1706 - protein, 11 aa, Artificial Sequence
  Synthetic Peptide
GEALGLVGAQA

SEQ ID NO: 1707 - protein, 11 aa, Artificial Sequence
  Synthetic Peptide
EEQQTASSSST

SEQ ID NO: 1708 - protein, 11 aa, Artificial Sequence
  Synthetic Peptide
VEVTLGEVPAA

SEQ ID NO: 1709 - protein, 11 aa, Artificial Sequence
  Synthetic Peptide
EEEGPRMFPDL

SEQ ID NO: 1710 - protein, 11 aa, Artificial Sequence
  Synthetic Peptide
SEFQAAISRKM

SEQ ID NO: 1711 - protein, 11 aa, Artificial Sequence
  Synthetic Peptide
VELVHFLLLKY

SEQ ID NO: 1712 - protein, 11 aa, Artificial Sequence
  Synthetic Peptide
LESVLRNCQDF

SEQ ID NO: 1713 - protein, 11 aa, Artificial Sequence
  Synthetic Peptide
VEVVPISHLYI

SEQ ID NO: 1714 - protein, 11 aa, Artificial Sequence
  Synthetic Peptide
IEGDCAPEEKI

SEQ ID NO: 1715 - protein, 11 aa, Artificial Sequence
  Synthetic Peptide
EEKIWEELSML

SEQ ID NO: 1716 - protein, 11 aa, Artificial Sequence
  Synthetic Peptide
EELSMLEVFEG

SEQ ID NO: 1717 - protein, 11 aa, Artificial Sequence
  Synthetic Peptide
LEVFEGREDSV

SEQ ID NO: 1718 - protein, 11 aa, Artificial Sequence
  Synthetic Peptide
YEFLWGPRALI

SEQ ID NO: 1719 - protein, 12 aa, Artificial Sequence
  Synthetic Peptide
EEQQTASSSSTL

SEQ ID NO: 1720 - protein, 12 aa, Artificial Sequence
  Synthetic Peptide
QEEEGPRMFPDL

SEQ ID NO: 1721 - protein, 12 aa, Artificial Sequence
  Synthetic Peptide
SEFQAAISRKMV

SEQ ID NO: 1722 - protein, 12 aa, Artificial Sequence
  Synthetic Peptide
LESVLRNCQDFF

SEQ ID NO: 1723 - protein, 12 aa, Artificial Sequence
  Synthetic Peptide
VEVVPISHLYIL

SEQ ID NO: 1724 - protein, 13 aa, Artificial Sequence
  Synthetic Peptide
EEGLEARGEALGL

SEQ ID NO: 1725 - protein, 13 aa, Artificial Sequence
  Synthetic Peptide
LEARGEALGLVGA

SEQ ID NO: 1726 - protein, 13 aa, Artificial Sequence
  Synthetic Peptide
LESEFQAAISRKM

SEQ ID NO: 1727 - protein, 13 aa, Artificial Sequence
  Synthetic Peptide
REPVTKAEMLESV

SEQ ID NO: 1728 - protein, 13 aa, Artificial Sequence
  Synthetic Peptide
SEYLQLVFGIEVV

SEQ ID NO: 1729 - protein, 13 aa, Artificial Sequence
  Synthetic Peptide
IEVVEVVPISHLY

SEQ ID NO: 1730 - protein, 13 aa, Artificial Sequence
  Synthetic Peptide
VEVVPISHLYILV

SEQ ID NO: 1731 - protein, 10 aa, Artificial Sequence
  Synthetic Peptide
MEVDPIGHLY

SEQ ID NO: 1732 - protein, 8 aa, Artificial Sequence
  Synthetic Peptide
EEEGPSTF

SEQ ID NO: 1733 - protein, 8 aa, Artificial Sequence
  Synthetic Peptide
AELVHFLL

SEQ ID NO: 1734 - protein, 8 aa, Artificial Sequence
  Synthetic Peptide
FEGREDSI

SEQ ID NO: 1735 - protein, 9 aa, Artificial Sequence
  Synthetic Peptide
QEAASSSST

SEQ ID NO: 1736 - protein, 9 aa, Artificial Sequence
  Synthetic Peptide
AELVHFLLL

SEQ ID NO: 1737 - protein, 9 aa, Artificial Sequence
  Synthetic Peptide
AEMLGSVVG

SEQ ID NO: 1738 - protein, 9 aa, Artificial Sequence
  Synthetic Peptide
EELSVLEVF

SEQ ID NO: 1739 - protein, 9 aa, Artificial Sequence
  Synthetic Peptide
FEGREDSIL

SEQ ID NO: 1740 - protein, 10 aa, Artificial Sequence
  Synthetic Peptide
QEAASSSSTL

SEQ ID NO: 1741 - protein, 10 aa, Artificial Sequence
  Synthetic Peptide
EEGPSTFPDL

SEQ ID NO: 1742 - protein, 10 aa, Artificial Sequence
  Synthetic Peptide
IELMEVDPIG

SEQ ID NO: 1743 - protein, 10 aa, Artificial Sequence
  Synthetic Peptide
MEVDPIGHLY

SEQ ID NO: 1744 - protein, 10 aa, Artificial Sequence
  Synthetic Peptide
EEKIWEELSV

SEQ ID NO: 1745 - protein, 10 aa, Artificial Sequence
  Synthetic Peptide
WEELSVLEVF

SEQ ID NO: 1746 - protein, 10 aa, Artificial Sequence
  Synthetic Peptide
FEGREDSILG

SEQ ID NO: 1747 - protein, 11 aa, Artificial Sequence
  Synthetic Peptide
EEEGPSTFPDL

SEQ ID NO: 1748 - protein, 11 aa, Artificial Sequence
  Synthetic Peptide
AELVHFLLLKY

SEQ ID NO: 1749 - protein, 11 aa, Artificial Sequence
  Synthetic Peptide
MEVDPIGHLYI

SEQ ID NO: 1750 - protein, 11 aa, Artificial Sequence
  Synthetic Peptide
REGDCAPEEKI

SEQ ID NO: 1751 - protein, 11 aa, Artificial Sequence
  Synthetic Peptide
EEKIWEELSVL

SEQ ID NO: 1752 - protein, 11 aa, Artificial Sequence
  Synthetic Peptide
LEVFEGREDSI

SEQ ID NO: 1753 - protein, 7 aa, Artificial Sequence
  Synthetic Peptide
RERFEMF

SEQ ID NO: 1754 - protein, 8 aa, Artificial Sequence
  Synthetic Peptide
LEDSSGNL

SEQ ID NO: 1755 - protein, 8 aa, Artificial Sequence
  Synthetic Peptide
GEYFTLQI

SEQ ID NO: 1756 - protein, 9 aa, Artificial Sequence
  Synthetic Peptide
VEPPLSQET

SEQ ID NO: 1757 - protein, 9 aa, Artificial Sequence
  Synthetic Peptide
PENNVLSPL

SEQ ID NO: 1758 - protein, 9 aa, Artificial Sequence
  Synthetic Peptide
DEAPRMPEA

SEQ ID NO: 1759 - protein, 9 aa, Artificial Sequence
  Synthetic Peptide
HERCSDSDG

SEQ ID NO: 1760 - protein, 9 aa, Artificial Sequence
  Synthetic Peptide
VEGNLRVEY

SEQ ID NO: 1761 - protein, 9 aa, Artificial Sequence
  Synthetic Peptide
VEYLDDRNT

SEQ ID NO: 1762 - protein, 9 aa, Artificial Sequence
  Synthetic Peptide
LEDSSGNLL

SEQ ID NO: 1763 - protein, 9 aa, Artificial Sequence
  Synthetic Peptide
RELNEALEL

SEQ ID NO: 1764 - protein, 9 aa, Artificial Sequence
  Synthetic Peptide
NEALELKDA

SEQ ID NO: 1765 - protein, 9 aa, Artificial Sequence
  Synthetic Peptide
LELKDAQAG

SEQ ID NO: 1766 - protein, 10 aa, Artificial Sequence
  Synthetic Peptide
MEEPQSDPSV

SEQ ID NO: 1767 - protein, 10 aa, Artificial Sequence
  Synthetic Peptide
VEPPLSQETF

SEQ ID NO: 1768 - protein, 10 aa, Artificial Sequence
  Synthetic Peptide
QETFSDLWKL

SEQ ID NO: 1769 - protein, 10 aa, Artificial Sequence
  Synthetic Peptide
IEQWFTEDPG

SEQ ID NO: 1770 - protein, 10 aa, Artificial Sequence
  Synthetic Peptide
DEAPRMPEAA

SEQ ID NO: 1771 - protein, 10 aa, Artificial Sequence
  Synthetic Peptide
HERCSDSDGL

SEQ ID NO: 1772 - protein, 10 aa, Artificial Sequence
  Synthetic Peptide
VEGNLRVEYL

SEQ ID NO: 1773 - protein, 10 aa, Artificial Sequence
  Synthetic Peptide
VEYLDDRNTF

SEQ ID NO: 1774 - protein, 10 aa, Artificial Sequence
  Synthetic Peptide
PEVGSDCTTI

SEQ ID NO: 1775 - protein, 10 aa, Artificial Sequence
  Synthetic Peptide
LEDSSGNLLG

SEQ ID NO: 1776 - protein, 10 aa, Artificial Sequence
  Synthetic Peptide
FEVRVCACPG

SEQ ID NO: 1777 - protein, 10 aa, Artificial Sequence
  Synthetic Peptide
TEEENLRKKG

SEQ ID NO: 1778 - protein, 10 aa, Artificial Sequence
  Synthetic Peptide
GEPHHELPPG

SEQ ID NO: 1779 - protein, 10 aa, Artificial Sequence
  Synthetic Peptide
GEYFTLQIRG

SEQ ID NO: 1780 - protein, 10 aa, Artificial Sequence
  Synthetic Peptide
RERFEMFREL

SEQ ID NO: 1781 - protein, 10 aa, Artificial Sequence
  Synthetic Peptide
FEMFRELNEA

SEQ ID NO: 1782 - protein, 11 aa, Artificial Sequence
  Synthetic Peptide
QETFSDLWKLL

SEQ ID NO: 1783 - protein, 11 aa, Artificial Sequence
  Synthetic Peptide
HERCSDSDGLA

SEQ ID NO: 1784 - protein, 11 aa, Artificial Sequence
  Synthetic Peptide
YEPPEVGSDCT

SEQ ID NO: 1785 - protein, 11 aa, Artificial Sequence
  Synthetic Peptide
HELPPGSTKRA

SEQ ID NO: 1786 - protein, 11 aa, Artificial Sequence
  Synthetic Peptide
FEMFRELNEAL

SEQ ID NO: 1787 - protein, 11 aa, Artificial Sequence
  Synthetic Peptide
NEALELKDAQA

SEQ ID NO: 1788 - protein, 12 aa, Artificial Sequence
  Synthetic Peptide
TEDPGPDEAPRM

SEQ ID NO: 1789 - protein, 12 aa, Artificial Sequence
  Synthetic Peptide
GEPHHELPPGST

SEQ ID NO: 1790 - protein, 13 aa, Artificial Sequence
  Synthetic Peptide
DEAPRMPEAAPPV

SEQ ID NO: 1791 - protein, 13 aa, Artificial Sequence
  Synthetic Peptide
YEPPEVGSDCTTI

SEQ ID NO: 1792 - protein, 8 aa, Artificial Sequence
  Synthetic Peptide
RERRDNYV

SEQ ID NO: 1793 - protein, 9 aa, Artificial Sequence
  Synthetic Peptide
SEIDLILGY

SEQ ID NO: 1794 - protein, 9 aa, Artificial Sequence
  Synthetic Peptide
AEIPTRVNY

SEQ ID NO: 1795 - protein, 10 aa, Artificial Sequence
  Synthetic Peptide
AEMGKFKFSY

SEQ ID NO: 1796 - protein, 9 aa, Artificial Sequence
  Synthetic Peptide
DEIGVIDLY

SEQ ID NO: 1797 - protein, 10 aa, Artificial Sequence
  Synthetic Peptide
AEMGKFKYSF

SEQ ID NO: 1798 - protein, 9 aa, Artificial Sequence
  Synthetic Peptide
SEAIHTFQY

SEQ ID NO: 1799 - protein, 9 aa, Artificial Sequence
  Synthetic Peptide
SEAIYTFQF

SEQ ID NO: 1800 - protein, 9 aa, Artificial Sequence
  Synthetic Peptide
AEGIVTGQY

SEQ ID NO: 1801 - protein, 8 aa, Artificial Sequence
  Synthetic Peptide
HETTYNSI

SEQ ID NO: 1802 - protein, 8 aa, Artificial Sequence
  Synthetic Peptide
GELSYLNV

SEQ ID NO: 1803 - protein, 8 aa, Artificial Sequence
  Synthetic Peptide
YEDTGKTI

SEQ ID NO: 1804 - protein, 9 aa, Artificial Sequence
  Synthetic Peptide
YENDIEKKI

SEQ ID NO: 1805 - protein, 13 aa, Artificial Sequence
  Synthetic Peptide
AAAKAAAAAAYAA

SEQ ID NO: 1806 - protein, 11 aa, Artificial Sequence
  Synthetic Peptide
YAAAAAAKAAA

SEQ ID NO: 1807 - protein, 13 aa, Artificial Sequence
  Synthetic Peptide
AAFAAAKTAAAFA

SEQ ID NO: 1808 - protein, 14 aa, Artificial Sequence
  Synthetic Peptide
YAAFAAAKTAAAFA

SEQ ID NO: 1809 - protein, 14 aa, Artificial Sequence
  Synthetic Peptide
YAAFAAAKTAAAFA

SEQ ID NO: 1810 - protein, 16 aa, Artificial Sequence
  Synthetic Peptide
AHAAHAAHAAHAAHAA

SEQ ID NO: 1811 - protein, 15 aa, Artificial Sequence
  Synthetic Peptide
VLERYLLEAKEAENI

SEQ ID NO: 1812 - protein, 15 aa, Artificial Sequence
  Synthetic Peptide
VPDTKVNFYAWKRME

SEQ ID NO: 1813 - protein, 15 aa, Artificial Sequence
  Synthetic Peptide
WKRMEVGQQAVEVWQ

SEQ ID NO: 1814 - protein, 15 aa, Artificial Sequence
  Synthetic Peptide
VGQQAVEVWQGLALL

SEQ ID NO: 1815 - protein, 15 aa, Artificial Sequence
  Synthetic Peptide
VEVWQGLALLSEAVL

SEQ ID NO: 1816 - protein, 15 aa, Artificial Sequence
  Synthetic Peptide
GLALLSEAVLRGQAL

SEQ ID NO: 1817 - protein, 15 aa, Artificial Sequence
  Synthetic Peptide
SEAVLRGQALLVNSS

SEQ ID NO: 1818 - protein, 15 aa, Artificial Sequence
  Synthetic Peptide
RGQALLVNSSQPWEP

SEQ ID NO: 1819 - protein, 15 aa, Artificial Sequence
  Synthetic Peptide
LQLHVDKAVSGLRSL

SEQ ID NO: 1820 - protein, 15 aa, Artificial Sequence
  Synthetic Peptide
KEAISPPDAASAAPL

SEQ ID NO: 1821 - protein, 15 aa, Artificial Sequence
  Synthetic Peptide
PPDAASAAPLRTITA

SEQ ID NO: 1822 - protein, 15 aa, Artificial Sequence
  Synthetic Peptide
SAAPLRTITADTFRK

SEQ ID NO: 1823 - protein, 15 aa, Artificial Sequence
  Synthetic Peptide
EAENITTGTAEHTSL

SEQ ID NO: 1824 - protein, 15 aa, Artificial Sequence
  Synthetic Peptide
RLFDNASLRAHRLHQ

SEQ ID NO: 1825 - protein, 15 aa, Artificial Sequence
  Synthetic Peptide
QLAFDTYQEFEEAYI

SEQ ID NO: 1826 - protein, 15 aa, Artificial Sequence
  Synthetic Peptide
ISLLLIQSWLEPVQF

SEQ ID NO: 1827 - protein, 15 aa, Artificial Sequence
  Synthetic Peptide
NSLVYGASDSNVYDL

SEQ ID NO: 1828 - protein, 15 aa, Artificial Sequence
  Synthetic Peptide
SDSNVYDLLKDLEEG

SEQ ID NO: 1829 - protein, 18 aa, Artificial Sequence
  Synthetic Peptide
KIFGSLAFLPESFDGDPA

SEQ ID NO: 1830 - protein, 15 aa, Artificial Sequence
  Synthetic Peptide
CLKDRRNFDIPEEIK

SEQ ID NO: 1831 - protein, 15 aa, Artificial Sequence [sequence omitted]

SEQ ID NO: 1832 - protein, 15 aa, Artificial Sequence
  Synthetic Peptide
QKEDAAVTIYEMLQN

SEQ ID NO: 1833 - protein, 15 aa, Artificial Sequence
  Synthetic Peptide
STGWNETIVENLLAN

SEQ ID NO: 1834 - protein, 15 aa, Artificial Sequence
  Synthetic Peptide
ETIVENLLANVYHQR

SEQ ID NO: 1835 - protein, 15 aa, Artificial Sequence
  Synthetic Peptide
KEDSHCAWTIVRVEI

SEQ ID NO: 1836 - protein, 15 aa, Artificial Sequence
  Synthetic Peptide
MSYNLLGFLQRSSNT

SEQ ID NO: 1837 - protein, 15 aa, Artificial Sequence
  Synthetic Peptide
QHLCGSHLVEALYLV

SEQ ID NO: 1838 - protein, 15 aa, Artificial Sequence
  Synthetic Peptide
GSHLVEALYLVCGER

SEQ ID NO: 1839 - protein, 15 aa, Artificial Sequence
  Synthetic Peptide
GSDLVEALYLVCGER

SEQ ID NO: 1840 - protein, 15 aa, Artificial Sequence
  Synthetic Peptide
VEALYLVCGERGFLY

SEQ ID NO: 1841 - protein, 15 aa, Artificial Sequence
  Synthetic Peptide
VEALYLVTGERGFFY

SEQ ID NO: 1842 - protein, 15 aa, Artificial Sequence
  Synthetic Peptide
IDVWLGGLAENFLPY

SEQ ID NO: 1843 - protein, 15 aa, Artificial Sequence
  Synthetic Peptide
IDVWLGGLAYNFLPY

SEQ ID NO: 1844 - protein, 15 aa, Artificial Sequence
  Synthetic Peptide
IDVWLGGLALNFLPY

SEQ ID NO: 1845 - protein, 15 aa, Artificial Sequence
  Synthetic Peptide
IDVWLGGLASNFLPY

SEQ ID NO: 1846 - protein, 15 aa, Artificial Sequence
  Synthetic Peptide
IDVWLGGLAKNFLPY

SEQ ID NO: 1847 - protein, 15 aa, Artificial Sequence
  Synthetic Peptide
IDVWLGGLADNFLPY

SEQ ID NO: 1848 - protein, 15 aa, Artificial Sequence
  Synthetic Peptide
IDVYLGGLAENFLPY

SEQ ID NO: 1849 - protein, 15 aa, Artificial Sequence
  Synthetic Peptide
IDVLLGGLAENFLPY

SEQ ID NO: 1850 - protein, 15 aa, Artificial Sequence
  Synthetic Peptide
IDVSLGGLAENFLPY

SEQ ID NO: 1851 - protein, 15 aa, Artificial Sequence
  Synthetic Peptide
IDVKLGGLAENFLPY

SEQ ID NO: 1852 - protein, 15 aa, Artificial Sequence
  Synthetic Peptide
IDVDLGGLAENFLPY

SEQ ID NO: 1853 - protein, 15 aa, Artificial Sequence
  Synthetic Peptide
IDVWLGGLAENYLPY

SEQ ID NO: 1854 - protein, 15 aa, Artificial Sequence
  Synthetic Peptide
IDVWLGGLAENVLPY

SEQ ID NO: 1855 - protein, 15 aa, Artificial Sequence
  Synthetic Peptide
IDVWLGGLAENSLPY

SEQ ID NO: 1856 - protein, 15 aa, Artificial Sequence
  Synthetic Peptide
IDVWLGGLAENKLPY

SEQ ID NO: 1857 - protein, 15 aa, Artificial Sequence
  Synthetic Peptide
IDVWLGGLAENDLPY

SEQ ID NO: 1858 - protein, 15 aa, Artificial Sequence
  Synthetic Peptide
IYVWLGGLAENFLPY

SEQ ID NO: 1859 - protein, 15 aa, Artificial Sequence
  Synthetic Peptide
ILVWLGGLAENFLPY

SEQ ID NO: 1860 - protein, 15 aa, Artificial Sequence
  Synthetic Peptide
ISVWLGGLAENFLPY

SEQ ID NO: 1861 - protein, 15 aa, Artificial Sequence
  Synthetic Peptide
IKVWLGGLAENFLPY

SEQ ID NO: 1862 - protein, 15 aa, Artificial Sequence
  Synthetic Peptide
IEVWLGGLAENFLPY

SEQ ID NO: 1863 - protein, 15 aa, Artificial Sequence
  Synthetic Peptide
IDVWLGGLAENFLPF

SEQ ID NO: 1864 - protein, 15 aa, Artificial Sequence
  Synthetic Peptide
IDVWLGGLAENFLPL

SEQ ID NO: 1865 - protein, 15 aa, Artificial Sequence
  Synthetic Peptide
IDVWLGGLAENFLPS

SEQ ID NO: 1866 - protein, 15 aa, Artificial Sequence
  Synthetic Peptide
IDVWLGGLAENFLPK

SEQ ID NO: 1867 - protein, 15 aa, Artificial Sequence
  Synthetic Peptide
IDVWLGGLAENFLPD

SEQ ID NO: 1868 - protein, 15 aa, Artificial Sequence
  Synthetic Peptide
IDVWLGGLAENFYPY

SEQ ID NO: 1869 - protein, 15 aa, Artificial Sequence
  Synthetic Peptide
IDVWLGGLAENFVPY

SEQ ID NO: 1870 - protein, 15 aa, Artificial Sequence
  Synthetic Peptide
IDVWLGGLAENFSPY

SEQ ID NO: 1871 - protein, 15 aa, Artificial Sequence
  Synthetic Peptide
IDVWLGGLAENFKPY

SEQ ID NO: 1872 - protein, 15 aa, Artificial Sequence
  Synthetic Peptide
IDVWLGGLAENFDPY

SEQ ID NO: 1873 - protein, 15 aa, Artificial Sequence
  Synthetic Peptide
IDVWLGGLAEYFLPY

SEQ ID NO: 1874 - protein, 15 aa, Artificial Sequence
  Synthetic Peptide
IDVWLGGLAELFLPY

SEQ ID NO: 1875 - protein, 15 aa, Artificial Sequence
  Synthetic Peptide
IDVWLGGLAESFLPY

SEQ ID NO: 1876 - protein, 15 aa, Artificial Sequence
  Synthetic Peptide
IDVWLGGLAEKFLPY

SEQ ID NO: 1877 - protein, 15 aa, Artificial Sequence
  Synthetic Peptide
IDVWLGGLAEDFLPY

SEQ ID NO: 1878 - protein, 15 aa, Artificial Sequence
  Synthetic Peptide
IDVWLGGLAEQFLPY

SEQ ID NO: 1879 - protein, 15 aa, Artificial Sequence
  Synthetic Peptide
IDVWLGGLYENFLPY

SEQ ID NO: 1880 - protein, 15 aa, Artificial Sequence
  Synthetic Peptide
IDVWLGGLLENFLPY

SEQ ID NO: 1881 - protein, 15 aa, Artificial Sequence
  Synthetic Peptide
IDVWLGGLSENFLPY

SEQ ID NO: 1882 - protein, 15 aa, Artificial Sequence
  Synthetic Peptide
IDVWLGGLKENFLPY

SEQ ID NO: 1883 - protein, 15 aa, Artificial Sequence
  Synthetic Peptide
IDVWLGGLDENFLPY

SEQ ID NO: 1884 - protein, 15 aa, Artificial Sequence
  Synthetic Peptide
IDVWLGGYAENFLPY

SEQ ID NO: 1885 - protein, 15 aa, Artificial Sequence
  Synthetic Peptide
IDVWLGGVAENFLPY

SEQ ID NO: 1886 - protein, 15 aa, Artificial Sequence
  Synthetic Peptide
IDVWLGGSAENFLPY

SEQ ID NO: 1887 - protein, 15 aa, Artificial Sequence
  Synthetic Peptide
IDVWLGGKAENFLPY

SEQ ID NO: 1888 - protein, 15 aa, Artificial Sequence
  Synthetic Peptide
IDVWLGGDAENFLPY

SEQ ID NO: 1889 - protein, 15 aa, Artificial Sequence
  Synthetic Peptide
IDVWLGYLAENFLPY

SEQ ID NO: 1890 - protein, 15 aa, Artificial Sequence
  Synthetic Peptide
IDVWLGLLAENFLPY

SEQ ID NO: 1891 - protein, 15 aa, Artificial Sequence
  Synthetic Peptide
IDVWLGSLAENFLPY

SEQ ID NO: 1892 - protein, 15 aa, Artificial Sequence
  Synthetic Peptide
IDVWLGKLAENFLPY

SEQ ID NO: 1893 - protein, 15 aa, Artificial Sequence
  Synthetic Peptide
IDVWLGDLAENFLPY

SEQ ID NO: 1894 - protein, 15 aa, Artificial Sequence
  Synthetic Peptide
IDVWLYGLAENFLPY

SEQ ID NO: 1895 - protein, 15 aa, Artificial Sequence
  Synthetic Peptide
IDVWLLGLAENFLPY

SEQ ID NO: 1896 - protein, 15 aa, Artificial Sequence
  Synthetic Peptide
IDVWLSGLAENFLPY

SEQ ID NO: 1897 - protein, 15 aa, Artificial Sequence
  Synthetic Peptide
IDVWLKGLAENFLPY

SEQ ID NO: 1898 - protein, 15 aa, Artificial Sequence
  Synthetic Peptide
IDVWLDGLAENFLPY

SEQ ID NO: 1899 - protein, 15 aa, Artificial Sequence
  Synthetic Peptide
IDVWYGGLAENFLPY

SEQ ID NO: 1900 - protein, 15 aa, Artificial Sequence
  Synthetic Peptide
IDVWVGGLAENFLPY

SEQ ID NO: 1901 - protein, 15 aa, Artificial Sequence
  Synthetic Peptide
IDVWSGGLAENFLPY

SEQ ID NO: 1902 - protein, 15 aa, Artificial Sequence
  Synthetic Peptide
IDVWKGGLAENFLPY

SEQ ID NO: 1903 - protein, 15 aa, Artificial Sequence
  Synthetic Peptide
IDVWDGGLAENFLPY

SEQ ID NO: 1904 - protein, 15 aa, Artificial Sequence
  Synthetic Peptide
IDYWLGGLAENFLPY

SEQ ID NO: 1905 - protein, 15 aa, Artificial Sequence
  Synthetic Peptide
IDLWLGGLAENFLPY

SEQ ID NO: 1906 - protein, 15 aa, Artificial Sequence
  Synthetic Peptide
IDSWLGGLAENFLPY

SEQ ID NO: 1907 - protein, 15 aa, Artificial Sequence
  Synthetic Peptide
IDKWLGGLAENFLPY

SEQ ID NO: 1908 - protein, 15 aa, Artificial Sequence
  Synthetic Peptide
IDDWLGGLAENFLPY

SEQ ID NO: 1909 - protein, 15 aa, Artificial Sequence
  Synthetic Peptide
IDVWLGGLAENFLYY

SEQ ID NO: 1910 - protein, 15 aa, Artificial Sequence
  Synthetic Peptide
IDVWLGGLAENFLLY

SEQ ID NO: 1911 - protein, 15 aa, Artificial Sequence
  Synthetic Peptide
IDVWLGGLAENFLSY

SEQ ID NO: 1912 - protein, 15 aa, Artificial Sequence
  Synthetic Peptide
IDVWLGGLAENFLKY

SEQ ID NO: 1913 - protein, 15 aa, Artificial Sequence
  Synthetic Peptide
IDVWLGGLAENFLDY

SEQ ID NO: 1914 - protein, 15 aa, Artificial Sequence
  Synthetic Peptide
YDVWLGGLAENFLPY

SEQ ID NO: 1915 - protein, 15 aa, Artificial Sequence
  Synthetic Peptide
LDVWLGGLAENFLPY

SEQ ID NO: 1916 - protein, 15 aa, Artificial Sequence
  Synthetic Peptide
SDVWLGGLAENFLPY

SEQ ID NO: 1917 - protein, 15 aa, Artificial Sequence
  Synthetic Peptide
KDVWLGGLAENFLPY

SEQ ID NO: 1918 - protein, 15 aa, Artificial Sequence
  Synthetic Peptide
DDVWLGGLAENFLPY

SEQ ID NO: 1919 - protein, 18 aa, Artificial Sequence
  Synthetic Peptide
NPTKHKWEAAHVAEQLAA

SEQ ID NO: 1920 - protein, 19 aa, Artificial Sequence
  Synthetic Peptide
DDYVKQYTKQYTKQNTLKK

SEQ ID NO: 1921 - protein, 13 aa, Artificial Sequence
  Synthetic Peptide
AAAKAAAAAAYAA

SEQ ID NO: 1922 - protein, 13 aa, Artificial Sequence
  Synthetic Peptide
AAAKAAAAAAYAA

SEQ ID NO: 1923 - protein, 7 aa, Artificial Sequence
  Synthetic Peptide
AYAAAKA

SEQ ID NO: 1924 - protein, 13 aa, Artificial Sequence
  Synthetic Peptide
AAAKATAAAAYAA

SEQ ID NO: 1925 - protein, 13 aa, Artificial Sequence
  Synthetic Peptide
AAAKAAAAAAFAA

SEQ ID NO: 1926 - protein, 12 aa, Artificial Sequence
  Synthetic Peptide
AAAKATAAAAAA

SEQ ID NO: 1927 - protein, 12 aa, Artificial Sequence
  Synthetic Peptide
AAAKATAAAAAA

SEQ ID NO: 1928 - protein, 12 aa, Artificial Sequence
  Synthetic Peptide
AAKAAAAAAAAA

SEQ ID NO: 1929 - protein, 13 aa, Artificial Sequence
  Synthetic Peptide
AAYAAAATAKAAA

SEQ ID NO: 1930 - protein, 13 aa, Artificial Sequence
  Synthetic Peptide
AALAAAAAAKAAA

SEQ ID NO: 1931 - protein, 13 aa, Artificial Sequence
  Synthetic Peptide
AAEAAAATAKAAA

SEQ ID NO: 1932 - protein, 11 aa, Artificial Sequence
  Synthetic Peptide
AAYAAAAKAAA

SEQ ID NO: 1933 - protein, 11 aa, Artificial Sequence
  Synthetic Peptide
AAYAAAAKAAA

SEQ ID NO: 1934 - protein, 13 aa, Artificial Sequence
  Synthetic Peptide
AFLRAAAAAAFAA

SEQ ID NO: 1935 - protein, 14 aa, Artificial Sequence
  Synthetic Peptide
AFLRQAAAAAFAAY

SEQ ID NO: 1936 - protein, 13 aa, Artificial Sequence
  Synthetic Peptide
AAFAAAKTAAAFA

SEQ ID NO: 1937 - protein, 14 aa, Artificial Sequence
  Synthetic Peptide
YAAFAAAKTAAAFA

SEQ ID NO: 1938 - protein, 13 aa, Artificial Sequence
  Synthetic Peptide
AALKATAAAAAAA

SEQ ID NO: 1939 - protein, 12 aa, Artificial Sequence
  Synthetic Peptide
YARSQTTLKAKT

SEQ ID NO: 1940 - protein, 12 aa, Artificial Sequence
  Synthetic Peptide
YARFQTTLKAKT

SEQ ID NO: 1941 - protein, 13 aa, Artificial Sequence
  Synthetic Peptide
PKYFKQRILKFAT

SEQ ID NO: 1942 - protein, 13 aa, Artificial Sequence
  Synthetic Peptide
PKYFKQGFLKGAT

SEQ ID NO: 1943 - protein, 13 aa, Artificial Sequence
  Synthetic Peptide
PKYGKQIDLKGAT

SEQ ID NO: 1944 - protein, 13 aa, Artificial Sequence
  Synthetic Peptide
AAFFFFFGGGGGA

SEQ ID NO: 1945 - protein, 13 aa, Artificial Sequence
  Synthetic Peptide
AADFFFFFFFFDA

SEQ ID NO: 1946 - protein, 13 aa, Artificial Sequence
  Synthetic Peptide
AAKGIKIGFGIFA

SEQ ID NO: 1947 - protein, 13 aa, Artificial Sequence
  Synthetic Peptide
AAFIFIGGGKIKA

SEQ ID NO: 1948 - protein, 13 aa, Artificial Sequence
  Synthetic Peptide
AAKIFIGFFIDGA

SEQ ID NO: 1949 - protein, 13 aa, Artificial Sequence
  Synthetic Peptide
AAFIGFGKIKFIA

SEQ ID NO: 1950 - protein, 13 aa, Artificial Sequence
  Synthetic Peptide
AAKIGFGIKIGFA

SEQ ID NO: 1951 - protein, 13 aa, Artificial Sequence
  Synthetic Peptide
AAFKIGKFGIFFA

SEQ ID NO: 1952 - protein, 13 aa, Artificial Sequence
  Synthetic Peptide
AADDDDDDDDDDA

SEQ ID NO: 1953 - protein, 13 aa, Artificial Sequence
  Synthetic Peptide
AAIGFFFFKKGIA

SEQ ID NO: 1954 - protein, 13 aa, Artificial Sequence
  Synthetic Peptide
AAFFGIFKIGKFA

SEQ ID NO: 1955 - protein, 13 aa, Artificial Sequence
  Synthetic Peptide
AADFGIFIDFIIA

SEQ ID NO: 1956 - protein, 13 aa, Artificial Sequence
  Synthetic Peptide
AAIGGIFIFKKDA

SEQ ID NO: 1957 - protein, 13 aa, Artificial Sequence
  Synthetic Peptide
AAFIGFGKIKFIA

SEQ ID NO: 1958 - protein, 13 aa, Artificial Sequence
  Synthetic Peptide
AAKIGFGIKIGFA

SEQ ID NO: 1959 - protein, 13 aa, Artificial Sequence
  Synthetic Peptide
AAFKIGKFGIFFA

SEQ ID NO: 1960 - protein, 13 aa, Artificial Sequence
  Synthetic Peptide
AAAKAAAAAAAAF

SEQ ID NO: 1961 - protein, 13 aa, Artificial Sequence
  Synthetic Peptide
AAAKAAAAAAAFA

SEQ ID NO: 1962 - protein, 13 aa, Artificial Sequence
  Synthetic Peptide
AAAKAAAAAAFAA

SEQ ID NO: 1963 - protein, 13 aa, Artificial Sequence
  Synthetic Peptide
AAAKAAAAFAAAA

SEQ ID NO: 1964 - protein, 13 aa, Artificial Sequence
  Synthetic Peptide
FAAAAAAAAAAAA

SEQ ID NO: 1965 - protein, 13 aa, Artificial Sequence
  Synthetic Peptide
AAAAAAAAAAAAN

SEQ ID NO: 1966 - protein, 13 aa, Artificial Sequence
  Synthetic Peptide
AAAAAAAAAAANA

SEQ ID NO: 1967 - protein, 13 aa, Artificial Sequence
  Synthetic Peptide
AAANAAAAAAAAA

SEQ ID NO: 1968 - protein, 13 aa, Artificial Sequence
  Synthetic Peptide
AAAAAAAAAAAAS

SEQ ID NO: 1969 - protein, 13 aa, Artificial Sequence
  Synthetic Peptide
AAAAASAAAAAAA

SEQ ID NO: 1970 - protein, 13 aa, Artificial Sequence
  Synthetic Peptide
ASAAAAAAAAAAA

SEQ ID NO: 1971 - protein, 9 aa, Artificial Sequence
  Synthetic Peptide
AFAAAKTAA

SEQ ID NO: 1972 - protein, 14 aa, Artificial Sequence
  Synthetic Peptide
YARFLALTTLRARA

SEQ ID NO: 1973 - protein, 12 aa, Artificial Sequence
  Synthetic Peptide
YARSQTTLKAKT

SEQ ID NO: 1974 - protein, 12 aa, Artificial Sequence
  Synthetic Peptide
YARRQTTLKAAA

SEQ ID NO: 1975 - protein, 10 aa, Artificial Sequence
  Synthetic Peptide
ARQTTLKAAA

SEQ ID NO: 1976 - protein, 10 aa, Artificial Sequence
  Synthetic Peptide
ARQTTLKAAA

SEQ ID NO: 1977 - protein, 9 aa, Artificial Sequence
  Synthetic Peptide
AAKTAAAFA

SEQ ID NO: 1978 - protein, 9 aa, Artificial Sequence
  Synthetic Peptide
AAAATKAAA

SEQ ID NO: 1979 - protein, 10 aa, Artificial Sequence
  Synthetic Peptide
AAAATKAAAA

SEQ ID NO: 1980 - protein, 10 aa, Artificial Sequence
  Synthetic Peptide
AAAATKAAAA

SEQ ID NO: 1981 - protein, 9 aa, Artificial Sequence
  Synthetic Peptide
AAAAKTAAA

SEQ ID NO: 1982 - protein, 10 aa, Artificial Sequence
  Synthetic Peptide
AAAATKAAAA

SEQ ID NO: 1983 - protein, 10 aa, Artificial Sequence
  Synthetic Peptide
AAAATKAAAA

SEQ ID NO: 1984 - protein, 9 aa, Artificial Sequence
  Synthetic Peptide
AFAAAKTAA

SEQ ID NO: 1985 - protein, 8 aa, Artificial Sequence
  Synthetic Peptide
AAAKTAAA

SEQ ID NO: 1986 - protein, 8 aa, Artificial Sequence
  Synthetic Peptide
AAAKTAAA

SEQ ID NO: 1987 - protein, 20 aa, Artificial Sequence
  Synthetic Peptide
HQAISPRTLNGPGPGSPAIF

SEQ ID NO: 1988 - protein, 14 aa, Artificial Sequence
  Synthetic Peptide
YAAFAAAKTAAAFA

SEQ ID NO: 1989 - protein, 16 aa, Artificial Sequence
  Synthetic Peptide
TEGRCLHYTVDKSKPK

SEQ ID NO: 1990 - protein, 10 aa, Artificial Sequence
  Synthetic Peptide
AWVAWRNRCK

SEQ ID NO: 1991 - protein, 18 aa, Artificial Sequence
  Synthetic Peptide
IVSDGNGMNAWVAWRNRC

SEQ ID NO: 1992 - protein, 20 aa, Artificial Sequence
  Synthetic Peptide
PHHTALRQAILSWGELMTLA

SEQ ID NO: 1993 - protein, 15 aa, Artificial Sequence
  Synthetic Peptide
WMYYHGQRHSDEHHH

SEQ ID NO: 1994 - protein, 11 aa, Artificial Sequence
  Synthetic Peptide
YIVMSDWTGGA

SEQ ID NO: 1995 - protein, 16 aa, Artificial Sequence
  Synthetic Peptide
AHAAHAAHAAHAAHAA

SEQ ID NO: 1996 - protein, 25 aa, Artificial Sequence
  Synthetic Peptide
MDIDPYKEFGATVELLSFLPSDFFP

SEQ ID NO: 1997 - protein, 19 aa, Artificial Sequence
  Synthetic Peptide
GMLPVCPLIPGSSTTSTGP

SEQ ID NO: 1998 - protein, 17 aa, Artificial Sequence
  Synthetic Peptide
LGFFPDHQLDPAFRANT

SEQ ID NO: 1999 - protein, 11 aa, Artificial Sequence
  Synthetic Peptide
GYKVLVLNPSV

SEQ ID NO: 2000 - protein, 10 aa, Artificial Sequence
  Synthetic Peptide
LMAFTAAVTS

SEQ ID NO: 2001 - protein, 12 aa, Artificial Sequence
  Synthetic Peptide
TFALWRVSAEEY

SEQ ID NO: 2002 - protein, 10 aa, Artificial Sequence
  Synthetic Peptide
ALWRVSAEEY

SEQ ID NO: 2003 - protein, 13 aa, Artificial Sequence
  Synthetic Peptide
EEYVEIRQVGDFH

SEQ ID NO: 2004 - protein, 16 aa, Artificial Sequence
  Synthetic Peptide
VGGVYLLPRRGPRLGV

SEQ ID NO: 2005 - protein, 16 aa, Artificial Sequence
  Synthetic Peptide
VGGAYLLPRRGPRLGV

SEQ ID NO: 2006 - protein, 16 aa, Artificial Sequence
  Synthetic Peptide
VGGVALLPRRGPRLGV

SEQ ID NO: 2007 - protein, 16 aa, Artificial Sequence
  Synthetic Peptide
VGGVYALPRRGPRLGV

SEQ ID NO: 2008 - protein, 16 aa, Artificial Sequence
  Synthetic Peptide
VGGVYLAPRRGPRLGV

SEQ ID NO: 2009 - protein, 16 aa, Artificial Sequence
  Synthetic Peptide
VGGVYLLARRGPRLGV

SEQ ID NO: 2010 - protein, 16 aa, Artificial Sequence
  Synthetic Peptide
VGGVYLLPARGPRLGV

SEQ ID NO: 2011 - protein, 16 aa, Artificial Sequence
  Synthetic Peptide
VGGVYLLRRAGPRLGV

SEQ ID NO: 2012 - protein, 15 aa, Artificial Sequence
  Synthetic Peptide
GAPLGGAARALAHGV

SEQ ID NO: 2013 - protein, 15 aa, Artificial Sequence
  Synthetic Peptide
GAALGGAARALAHGV

SEQ ID NO: 2014 - protein, 15 aa, Artificial Sequence
  Synthetic Peptide
GAPLAGAARALAHGV

SEQ ID NO: 2015 - protein, 15 aa, Artificial Sequence
  Synthetic Peptide
GAPLGAAARALAHGV

SEQ ID NO: 2016 - protein, 15 aa, Artificial Sequence
  Synthetic Peptide
GAPLGGLARALAHGV

SEQ ID NO: 2017 - protein, 15 aa, Artificial Sequence
  Synthetic Peptide
GAPLGGALRALAHGV

SEQ ID NO: 2018 - protein, 15 aa, Artificial Sequence
  Synthetic Peptide
GAPLGGAAAALAHGV

SEQ ID NO: 2019 - protein, 15 aa, Artificial Sequence
  Synthetic Peptide
GAPLGGAARLLAHGV

SEQ ID NO: 2020 - protein, 15 aa, Artificial Sequence
  Synthetic Peptide
GAPLGGAARAAAHGV

SEQ ID NO: 2021 - protein, 15 aa, Artificial Sequence
  Synthetic Peptide
GAPLGGAARALAAGV

SEQ ID NO: 2022 - protein, 15 aa, Artificial Sequence
  Synthetic Peptide
FPDWQNYTPGPGTRF

SEQ ID NO: 2023 - protein, 15 aa, Artificial Sequence
  Synthetic Peptide
RFPLTFGWCFKLVPV

SEQ ID NO: 2024 - protein, 15 aa, Artificial Sequence
  Synthetic Peptide
RQDILDLWVYHTQGY

SEQ ID NO: 2025 - protein, 15 aa, Artificial Sequence
  Synthetic Peptide
RQEILDLWVYHTQGF

SEQ ID NO: 2026 - protein, 15 aa, Artificial Sequence
  Synthetic Peptide
LSHFLKEKGGLEGLI

SEQ ID NO: 2027 - protein, 15 aa, Artificial Sequence
  Synthetic Peptide
LSFFLKEKGGLDGLI

SEQ ID NO: 2028 - protein, 16 aa, Artificial Sequence
  Synthetic Peptide
LEPWNHPGSQPKTACT

SEQ ID NO: 2029 - protein, 15 aa, Artificial Sequence
  Synthetic Peptide
QVCFITKGLGISYGR

SEQ ID NO: 2030 - protein, 15 aa, Artificial Sequence
  Synthetic Peptide
QLCFLKKGLGISYGR

SEQ ID NO: 2031 - protein, 16 aa, Artificial Sequence
  Synthetic Peptide
PPEESFRFGEEKTTPS

SEQ ID NO: 2032 - protein, 15 aa, Artificial Sequence
  Synthetic Peptide
CIVYRDGNPYAVCDK

SEQ ID NO: 2033 - protein, 15 aa, Artificial Sequence
  Synthetic Peptide
HYCYSLYGTTLEQQY

SEQ ID NO: 2034 - protein, 15 aa, Artificial Sequence
  Synthetic Peptide
CYSLYGTTLEQQYNK

SEQ ID NO: 2035 - protein, 15 aa, Artificial Sequence
  Synthetic Peptide
NTSLQDIEITCVYCK

SEQ ID NO: 2036 - protein, 15 aa, Artificial Sequence
  Synthetic Peptide
VFEFAFKDLFVVYRD

SEQ ID NO: 2037 - protein, 15 aa, Artificial Sequence
  Synthetic Peptide
EFAFKDLFVVYRDSI

SEQ ID NO: 2038 - protein, 15 aa, Artificial Sequence
  Synthetic Peptide
DLFVVYRDSIPHAAC

SEQ ID NO: 2039 - protein, 15 aa, Artificial Sequence
  Synthetic Peptide
FVVYRDSIPHAACHK

SEQ ID NO: 2040 - protein, 15 aa, Artificial Sequence
  Synthetic Peptide
NTGLYNLLIRCLRCQ

SEQ ID NO: 2041 - protein, 15 aa, Artificial Sequence
  Synthetic Peptide
IRCLRCQKPLNPAEK

SEQ ID NO: 2042 - protein, 15 aa, Artificial Sequence
  Synthetic Peptide
PRKLHELSSALEIPY

SEQ ID NO: 2043 - protein, 15 aa, Artificial Sequence
  Synthetic Peptide
EIPYDELRLNCVYCK

SEQ ID NO: 2044 - protein, 15 aa, Artificial Sequence
  Synthetic Peptide
TEVLDFAFTDLTIVY

SEQ ID NO: 2045 - protein, 15 aa, Artificial Sequence
  Synthetic Peptide
VLDFAFTDLTIVYRD

SEQ ID NO: 2046 - protein, 15 aa, Artificial Sequence
  Synthetic Peptide
DFAFTDLTIVYRDDT

SEQ ID NO: 2047 - protein, 15 aa, Artificial Sequence
  Synthetic Peptide
TIVYRDDTPHGVCTK

SEQ ID NO: 2048 - protein, 15 aa, Artificial Sequence
  Synthetic Peptide
WYRYSVYGTTLEKLT

SEQ ID NO: 2049 - protein, 15 aa, Artificial Sequence
  Synthetic Peptide
ETTIHNIELQCVECK

SEQ ID NO: 2050 - protein, 15 aa, Artificial Sequence
  Synthetic Peptide
SEVYDFAFADLTVVY

SEQ ID NO: 2051 - protein, 15 aa, Artificial Sequence
  Synthetic Peptide
VYDFAFADLTVVYRE

SEQ ID NO: 2052 - protein, 15 aa, Artificial Sequence
  Synthetic Peptide
DFAFADLTVVYREGN

SEQ ID NO: 2053 - protein, 15 aa, Artificial Sequence
  Synthetic Peptide
TVVYREGNPFGICKL

SEQ ID NO: 2054 - protein, 15 aa, Artificial Sequence
  Synthetic Peptide
GNPFGICKLCLRFLS

SEQ ID NO: 2055 - protein, 15 aa, Artificial Sequence
  Synthetic Peptide
NYSVYGNTLEQTVKK

SEQ ID NO: 2056 - protein, 15 aa, Artificial Sequence
  Synthetic Peptide
KKPLNEILIRCIICQ

SEQ ID NO: 2057 - protein, 15 aa, Artificial Sequence
  Synthetic Peptide
NEILIRCIICQRPLC

SEQ ID NO: 2058 - protein, 15 aa, Artificial Sequence
  Synthetic Peptide
IRCIICQRPLCPQEK

SEQ ID NO: 2059 - protein, 15 aa, Artificial Sequence
  Synthetic Peptide
CIVYRDCIAYAACHK

SEQ ID NO: 2060 - protein, 15 aa, Artificial Sequence
  Synthetic Peptide
NTELYNLLIRCLRCQ

SEQ ID NO: 2061 - protein, 15 aa, Artificial Sequence
  Synthetic Peptide
IRCLRCQKPLNPAEK

SEQ ID NO: 2062 - protein, 15 aa, Artificial Sequence
  Synthetic Peptide
REVYKFLFTDLRIVY

SEQ ID NO: 2063 - protein, 15 aa, Artificial Sequence
  Synthetic Peptide
RIVYRDNNPYGVCIM

SEQ ID NO: 2064 - protein, 15 aa, Artificial Sequence
  Synthetic Peptide
NNPYGVCIMCLRFLS

SEQ ID NO: 2065 - protein, 15 aa, Artificial Sequence
  Synthetic Peptide
EERVKKPLSEITIRC

SEQ ID NO: 2066 - protein, 15 aa, Artificial Sequence
  Synthetic Peptide
IRCIICQTPLCPEEK

SEQ ID NO: 2067 - protein, 15 aa, Artificial Sequence
  Synthetic Peptide
EIPLIDLRLSCVYCK

SEQ ID NO: 2068 - protein, 15 aa, Artificial Sequence
  Synthetic Peptide
SCVYCKKELTRAEVY

SEQ ID NO: 2069 - protein, 15 aa, Artificial Sequence
  Synthetic Peptide
VCLLFYSKVRKYRYY

SEQ ID NO: 2070 - protein, 15 aa, Artificial Sequence
  Synthetic Peptide
YYDYSVYGATLESIT

SEQ ID NO: 2071 - protein, 15 aa, Artificial Sequence
  Synthetic Peptide
IRCYRCQSPLTPEEK

SEQ ID NO: 2072 - protein, 15 aa, Artificial Sequence
  Synthetic Peptide
VYDFVFADLRIVYRD

SEQ ID NO: 2073 - protein, 15 aa, Artificial Sequence
  Synthetic Peptide
DFVFADLRIVYRDGN

SEQ ID NO: 2074 - protein, 15 aa, Artificial Sequence
  Synthetic Peptide
RIVYRDGNPFAVCKV

SEQ ID NO: 2075 - protein, 15 aa, Artificial Sequence
  Synthetic Peptide
GNPFAVCKVCLRLLS

SEQ ID NO: 2076 - protein, 15 aa, Artificial Sequence
  Synthetic Peptide
KKCLNEILIRCIICQ

SEQ ID NO: 2077 - protein, 15 aa, Artificial Sequence
  Synthetic Peptide
NEILIRCIICQRPLC

SEQ ID NO: 2078 - protein, 15 aa, Artificial Sequence
  Synthetic Peptide
RTAMFQDPQERPRKL

SEQ ID NO: 2079 - protein, 15 aa, Artificial Sequence
  Synthetic Peptide
LFVVYRDSIPHAACH

SEQ ID NO: 2080 - protein, 15 aa, Artificial Sequence
  Synthetic Peptide
LTIVYRDDTPHGVCT

SEQ ID NO: 2081 - protein, 15 aa, Artificial Sequence
  Synthetic Peptide
LCIVYRDCIAYAACH

SEQ ID NO: 2082 - protein, 15 aa, Artificial Sequence
  Synthetic Peptide
YKFLFTDLRIVYRDN

SEQ ID NO: 2083 - protein, 15 aa, Artificial Sequence
  Synthetic Peptide
YNFACTELKLVYRDD

SEQ ID NO: 2084 - protein, 15 aa, Artificial Sequence
  Synthetic Peptide
LKLVYRDDFPYAVCR

SEQ ID NO: 2085 - protein, 15 aa, Artificial Sequence
  Synthetic Peptide
YDFVFADLRIVYRDG

SEQ ID NO: 2086 - protein, 15 aa, Artificial Sequence
  Synthetic Peptide
LRIVYRDGNPFAVCK

SEQ ID NO: 2087 - protein, 15 aa, Artificial Sequence
  Synthetic Peptide
HEYMLDLQPETTDLY

SEQ ID NO: 2088 - protein, 15 aa, Artificial Sequence
  Synthetic Peptide
TLRLCVQSTHVDIRT

SEQ ID NO: 2089 - protein, 15 aa, Artificial Sequence
  Synthetic Peptide
IRTLEDLLMGTLGIV

SEQ ID NO: 2090 - protein, 15 aa, Artificial Sequence
  Synthetic Peptide
LEDLLMGTLGIVCPI

SEQ ID NO: 2091 - protein, 15 aa, Artificial Sequence
  Synthetic Peptide
DLLMGTLGIVCPICS

SEQ ID NO: 2092 - protein, 15 aa, Artificial Sequence
  Synthetic Peptide
KATLQDIVLHLEPQN

SEQ ID NO: 2093 - protein, 15 aa, Artificial Sequence
  Synthetic Peptide
IDGVNHQHLPARRAE

SEQ ID NO: 2094 - protein, 15 aa, Artificial Sequence
  Synthetic Peptide
LRAFQQLFLNTLSFV

SEQ ID NO: 2095 - protein, 15 aa, Artificial Sequence
  Synthetic Peptide
FQQLFLNTLSFVCPW

SEQ ID NO: 2096 - protein, 15 aa, Artificial Sequence
  Synthetic Peptide
QDYVLDLQPEATDLH

SEQ ID NO: 2097 - protein, 15 aa, Artificial Sequence
  Synthetic Peptide
DIRILQELLMGSFGI

SEQ ID NO: 2098 - protein, 15 aa, Artificial Sequence
  Synthetic Peptide
IRILQELLMGSFGIV

SEQ ID NO: 2099 - protein, 15 aa, Artificial Sequence
  Synthetic Peptide
ELLMGSFGIVCPNCS

SEQ ID NO: 2100 - protein, 15 aa, Artificial Sequence
  Synthetic Peptide
KEYVLDLYPEPTDLY

SEQ ID NO: 2101 - protein, 15 aa, Artificial Sequence
  Synthetic Peptide
LRTIQQLLMGTVNIV

SEQ ID NO: 2102 - protein, 15 aa, Artificial Sequence
  Synthetic Peptide
IQQLLMGTVNIVCPT

SEQ ID NO: 2103 - protein, 15 aa, Artificial Sequence
  Synthetic Peptide
QLLMGTVNIVCPTCA

SEQ ID NO: 2104 - protein, 15 aa, Artificial Sequence
  Synthetic Peptide
RETLQEIVLHLEPQN

SEQ ID NO: 2105 - protein, 15 aa, Artificial Sequence
  Synthetic Peptide
LRTLQQLFLSTLSFV

SEQ ID NO: 2106 - protein, 15 aa, Artificial Sequence
  Synthetic Peptide
LQQLFLSTLSFVCPW

SEQ ID NO: 2107 - protein, 15 aa, Artificial Sequence
  Synthetic Peptide
KDYILDLQPETTDLH

SEQ ID NO: 2108 - protein, 15 aa, Artificial Sequence
  Synthetic Peptide
LRTLQQMLLGTLQVV

SEQ ID NO: 2109 - protein, 15 aa, Artificial Sequence
  Synthetic Peptide
LQQMLLGTLQVVCPG

SEQ ID NO: 2110 - protein, 15 aa, Artificial Sequence
  Synthetic Peptide
QMLLGTLQVVCPGCA

SEQ ID NO: 2111 - protein, 15 aa, Artificial Sequence
  Synthetic Peptide
VPTLQDVVLELTPQT

SEQ ID NO: 2112 - protein, 15 aa, Artificial Sequence
  Synthetic Peptide
LQDVVLELTPQTEID

SEQ ID NO: 2113 - protein, 15 aa, Artificial Sequence
  Synthetic Peptide
QDVVLELTPQTEIDL

SEQ ID NO: 2114 - protein, 15 aa, Artificial Sequence
  Synthetic Peptide
CKFVVQLDIQSTKED

SEQ ID NO: 2115 - protein, 15 aa, Artificial Sequence
  Synthetic Peptide
VVQLDIQSTKEDLRV

SEQ ID NO: 2116 - protein, 15 aa, Artificial Sequence
  Synthetic Peptide
DLRVVQQLLMGALTV

SEQ ID NO: 2117 - protein, 15 aa, Artificial Sequence
  Synthetic Peptide
LRVVQQLLMGALTVT

SEQ ID NO: 2118 - protein, 15 aa, Artificial Sequence
  Synthetic Peptide
VQQLLMGALTVTCPL

SEQ ID NO: 2119 - protein, 15 aa, Artificial Sequence
  Synthetic Peptide
QQLLMGALTVTCPLC

SEQ ID NO: 2120 - protein, 15 aa, Artificial Sequence
  Synthetic Peptide
QLLMGALTVTCPLCA

SEQ ID NO: 2121 - protein, 15 aa, Artificial Sequence
  Synthetic Peptide
REYILDLHPEPTDLF

SEQ ID NO: 2122 - protein, 15 aa, Artificial Sequence
  Synthetic Peptide
TCCYTCGTTVRLCIN

SEQ ID NO: 2123 - protein, 15 aa, Artificial Sequence
  Synthetic Peptide
VRTLQQLLMGTCTIV

SEQ ID NO: 2124 - protein, 15 aa, Artificial Sequence
  Synthetic Peptide
LQQLLMGTCTIVCPS

SEQ ID NO: 2125 - protein, 15 aa, Artificial Sequence
  Synthetic Peptide
MLDLQPETTDLYCYE

SEQ ID NO: 2126 - protein, 15 aa, Artificial Sequence
  Synthetic Peptide
VLDLYPEPTDLYCYE

SEQ ID NO: 2127 - protein, 15 aa, Artificial Sequence
  Synthetic Peptide
LREYILDLHPEPTDL

SEQ ID NO: 2128 - protein, 16 aa, Artificial Sequence
  Synthetic Peptide
HIEFTPTRTDTYACRV

SEQ ID NO: 2129 - protein, 15 aa, Artificial Sequence
  Synthetic Peptide
LWWVNNESLPVSPRL

SEQ ID NO: 2130 - protein, 13 aa, Artificial Sequence
  Synthetic Peptide
YEEYVRFDSDVGE

SEQ ID NO: 2131 - protein, 12 aa, Artificial Sequence
  Synthetic Peptide
EEYVRFDSDVGE

SEQ ID NO: 2132 - protein, 15 aa, Artificial Sequence
  Synthetic Peptide
APPRLICDSRVLERY

SEQ ID NO: 2133 - protein, 15 aa, Artificial Sequence
  Synthetic Peptide
ICDSRVLERYLLEAK

SEQ ID NO: 2134 - protein, 15 aa, Artificial Sequence
  Synthetic Peptide
VLERYLLEAKEAENI

SEQ ID NO: 2135 - protein, 15 aa, Artificial Sequence
  Synthetic Peptide
EHCSLNENITVPDTK

SEQ ID NO: 2136 - protein, 15 aa, Artificial Sequence
  Synthetic Peptide
NENITVPDTKVNFYA

SEQ ID NO: 2137 - protein, 15 aa, Artificial Sequence
  Synthetic Peptide
VPDTKVNFYAWKRME

SEQ ID NO: 2138 - protein, 15 aa, Artificial Sequence
  Synthetic Peptide
VNFYAWKRMEVGQQA

SEQ ID NO: 2139 - protein, 15 aa, Artificial Sequence
  Synthetic Peptide
WKRMEVGQQAVEVWQ

SEQ ID NO: 2140 - protein, 15 aa, Artificial Sequence
  Synthetic Peptide
VGQQAVEVWQGLALL

SEQ ID NO: 2141 - protein, 15 aa, Artificial Sequence
  Synthetic Peptide
VEVWQGLALLSEAVL

SEQ ID NO: 2142 - protein, 15 aa, Artificial Sequence
  Synthetic Peptide
GLALLSEAVLRGQAL

SEQ ID NO: 2143 - protein, 15 aa, Artificial Sequence
  Synthetic Peptide
SEAVLRGQALLVNSS

SEQ ID NO: 2144 - protein, 15 aa, Artificial Sequence
  Synthetic Peptide
RGQALLVNSSQPWEP

SEQ ID NO: 2145 - protein, 15 aa, Artificial Sequence
  Synthetic Peptide
LVNSSQPWEPLQLHV

SEQ ID NO: 2146 - protein, 15 aa, Artificial Sequence
  Synthetic Peptide
QPWEPLQLHVDKAVS

SEQ ID NO: 2147 - protein, 15 aa, Artificial Sequence
  Synthetic Peptide
LQLHVDKAVSGLRSL

SEQ ID NO: 2148 - protein, 15 aa, Artificial Sequence
  Synthetic Peptide
DKAVSGLRSLTTLLR

SEQ ID NO: 2149 - protein, 15 aa, Artificial Sequence
  Synthetic Peptide
GLRSLTTLLRALGAQ

SEQ ID NO: 2150 - protein, 15 aa, Artificial Sequence
  Synthetic Peptide
TTLLRALGAQKEAIS

SEQ ID NO: 2151 - protein, 15 aa, Artificial Sequence
  Synthetic Peptide
ALGAQKEAISPPDAA

SEQ ID NO: 2152 - protein, 15 aa, Artificial Sequence
  Synthetic Peptide
KEAISPPDAASAAPL

SEQ ID NO: 2153 - protein, 15 aa, Artificial Sequence
  Synthetic Peptide
PPDAASAAPLRTITA

SEQ ID NO: 2154 - protein, 15 aa, Artificial Sequence
  Synthetic Peptide
SAAPLRTITADTFRK

SEQ ID NO: 2155 - protein, 15 aa, Artificial Sequence
  Synthetic Peptide
RTITADTFRKLFRVY

SEQ ID NO: 2156 - protein, 15 aa, Artificial Sequence
  Synthetic Peptide
DTFRKLFRVYSNFLR

SEQ ID NO: 2157 - protein, 15 aa, Artificial Sequence
  Synthetic Peptide
LFRVYSNFLRGKLKL

SEQ ID NO: 2158 - protein, 15 aa, Artificial Sequence
  Synthetic Peptide
SNFLRGKLKLYTGEA

SEQ ID NO: 2159 - protein, 15 aa, Artificial Sequence
  Synthetic Peptide
KLKLYTGEACRTGDR

SEQ ID NO: 2160 - protein, 15 aa, Artificial Sequence
  Synthetic Peptide
APPRLITDSRVLERY

SEQ ID NO: 2161 - protein, 15 aa, Artificial Sequence
  Synthetic Peptide
ITDSRVLERYLLEAK

SEQ ID NO: 2162 - protein, 15 aa, Artificial Sequence
  Synthetic Peptide
EHTSLNENITVPDTK

SEQ ID NO: 2163 - protein, 15 aa, Artificial Sequence
  Synthetic Peptide
KLKLYTGEATRTGDR

SEQ ID NO: 2164 - protein, 12 aa, Artificial Sequence
  Synthetic Peptide
PQPFRPQQPYPQ

SEQ ID NO: 2165 - protein, 10 aa, Artificial Sequence
  Synthetic Peptide
PFRPQQPYPQ

SEQ ID NO: 2166 - protein, 11 aa, Artificial Sequence
  Synthetic Peptide
PQPFRPQQPYP

SEQ ID NO: 2167 - protein, 9 aa, Artificial Sequence
  Synthetic Peptide
PQPFRPQQP

SEQ ID NO: 2168 - protein, 12 aa, Artificial Sequence
  Synthetic Peptide
KQPFRPQQPYPQ

SEQ ID NO: 2169 - protein, 12 aa, Artificial Sequence
  Synthetic Peptide
PKPFRPQQPYPQ

SEQ ID NO: 2170 - protein, 12 aa, Artificial Sequence
  Synthetic Peptide
PQPFKPQQPYPQ

SEQ ID NO: 2171 - protein, 12 aa, Artificial Sequence
  Synthetic Peptide
PQPFRKQQPYPQ

SEQ ID NO: 2172 - protein, 12 aa, Artificial Sequence
  Synthetic Peptide
PQPFRPQKPYPQ

SEQ ID NO: 2173 - protein, 12 aa, Artificial Sequence
  Synthetic Peptide
PQPFRPQQPKPQ

SEQ ID NO: 2174 - protein, 12 aa, Artificial Sequence
  Synthetic Peptide
PQPFRPQQPYKQ

SEQ ID NO: 2175 - protein, 12 aa, Artificial Sequence
  Synthetic Peptide
PQPFRPQQPYPK

SEQ ID NO: 2176 - protein, 12 aa, Artificial Sequence
  Synthetic Peptide
QFLGQQQPFPPQ

SEQ ID NO: 2177 - protein, 11 aa, Artificial Sequence
  Synthetic Peptide
FLGQQQPFPPQ

SEQ ID NO: 2178 - protein, 10 aa, Artificial Sequence
  Synthetic Peptide
LGQQQPFPPQ

SEQ ID NO: 2179 - protein, 11 aa, Artificial Sequence
  Synthetic Peptide
QFLGQQQPFPP

SEQ ID NO: 2180 - protein, 9 aa, Artificial Sequence
  Synthetic Peptide
QFLGQQQPF

SEQ ID NO: 2181 - protein, 16 aa, Artificial Sequence
  Synthetic Peptide
IRNLALQTLPAMCNVY

SEQ ID NO: 2182 - protein, 14 aa, Artificial Sequence
  Synthetic Peptide
NLALQTLPAMCNVY

SEQ ID NO: 2183 - protein, 13 aa, Artificial Sequence
  Synthetic Peptide
LALQTLPAMCNVY

SEQ ID NO: 2184 - protein, 12 aa, Artificial Sequence
  Synthetic Peptide
IRNLALQTLPAM

SEQ ID NO: 2185 - protein, 10 aa, Artificial Sequence
  Synthetic Peptide
IRNLALQTLP

SEQ ID NO: 2186 - protein, 17 aa, Artificial Sequence
  Synthetic Peptide
EGDAFELTVSCQGGLPK

SEQ ID NO: 2187 - protein, 18 aa, Artificial Sequence
  Synthetic Peptide
ESTGMTPEKVPVSEVMGT

SEQ ID NO: 2188 - protein, 15 aa, Artificial Sequence
  Synthetic Peptide
FPTIPLSRLFDNASL

SEQ ID NO: 2189 - protein, 15 aa, Artificial Sequence
  Synthetic Peptide
RLFDNASLRAHRLHQ

SEQ ID NO: 2190 - protein, 15 aa, Artificial Sequence
  Synthetic Peptide
LRAHRLHQLAFDTYQ

SEQ ID NO: 2191 - protein, 15 aa, Artificial Sequence
  Synthetic Peptide
QLAFDTYQEFEEAYI

SEQ ID NO: 2192 - protein, 15 aa, Artificial Sequence
  Synthetic Peptide
QEFEEAYIPKEQKYS

SEQ ID NO: 2193 - protein, 15 aa, Artificial Sequence
  Synthetic Peptide
IPKEQKYSFLQNPQT

SEQ ID NO: 2194 - protein, 15 aa, Artificial Sequence
  Synthetic Peptide
SFLQNPQTSLCFSES

SEQ ID NO: 2195 - protein, 15 aa, Artificial Sequence
  Synthetic Peptide
TSLCFSESIPTPSNR

SEQ ID NO: 2196 - protein, 15 aa, Artificial Sequence
  Synthetic Peptide
REETQQKSNLELLRI

SEQ ID NO: 2197 - protein, 15 aa, Artificial Sequence
  Synthetic Peptide
SNLELLRISLLLIQS

SEQ ID NO: 2198 - protein, 15 aa, Artificial Sequence
  Synthetic Peptide
ISLLLIQSWLEPVQF

SEQ ID NO: 2199 - protein, 15 aa, Artificial Sequence
  Synthetic Peptide
SWLEPVQFLRSVFAN

SEQ ID NO: 2200 - protein, 15 aa, Artificial Sequence
  Synthetic Peptide
FLRSVFANSLVYGAS

SEQ ID NO: 2201 - protein, 15 aa, Artificial Sequence
  Synthetic Peptide
NSLVYGASDSNVYDL

SEQ ID NO: 2202 - protein, 15 aa, Artificial Sequence
  Synthetic Peptide
SDSNVYDLLKDLEEG

SEQ ID NO: 2203 - protein, 15 aa, Artificial Sequence
  Synthetic Peptide
GIQTLMGRLEDGSPR

SEQ ID NO: 2204 - protein, 15 aa, Artificial Sequence
  Synthetic Peptide
RLEDGSPRTGQIFKQ

SEQ ID NO: 2205 - protein, 15 aa, Artificial Sequence
  Synthetic Peptide
RTGQIFKQTYSKFDT

SEQ ID NO: 2206 - protein, 15 aa, Artificial Sequence
  Synthetic Peptide
QTYSKFDTNSHNDDA

SEQ ID NO: 2207 - protein, 15 aa, Artificial Sequence
  Synthetic Peptide
TNSHNDDALLKNYGL

SEQ ID NO: 2208 - protein, 15 aa, Artificial Sequence
  Synthetic Peptide
ALLKNYGLLYCFRKD

SEQ ID NO: 2209 - protein, 15 aa, Artificial Sequence
  Synthetic Peptide
DMDKVETFLRIVQCR

SEQ ID NO: 2210 - protein, 16 aa, Artificial Sequence
  Synthetic Peptide
FLRIVQCRSVEGSCGF

SEQ ID NO: 2211 - protein, 15 aa, Artificial Sequence
  Synthetic Peptide
FPTIPLSRLFDNAML

SEQ ID NO: 2212 - protein, 15 aa, Artificial Sequence
  Synthetic Peptide
RLFDNAMLRAHRLHQ

SEQ ID NO: 2213 - protein, 15 aa, Artificial Sequence
  Synthetic Peptide
QLAFDTYQEFEQNPQ

SEQ ID NO: 2214 - protein, 15 aa, Artificial Sequence
  Synthetic Peptide
SFLQNPQTSLCCFRK

SEQ ID NO: 2215 - protein, 15 aa, Artificial Sequence
  Synthetic Peptide
SNLELLRICLLLIQS

SEQ ID NO: 2216 - protein, 15 aa, Artificial Sequence
  Synthetic Peptide
ICLLLIQSWLEPVQF

SEQ ID NO: 2217 - protein, 15 aa, Artificial Sequence
  Synthetic Peptide
NSLVYGASDSNIYDL

SEQ ID NO: 2218 - protein, 15 aa, Artificial Sequence
  Synthetic Peptide
SDSNIYDLLKDLEEG

SEQ ID NO: 2219 - protein, 15 aa, Artificial Sequence
  Synthetic Peptide
DKVETFLRIVQCCGF

SEQ ID NO: 2220 - protein, 15 aa, Artificial Sequence [sequence omitted]

SEQ ID NO: 2221 - protein, 15 aa, Artificial Sequence
  Synthetic Peptide
TSLTFSESIPTPSNR

SEQ ID NO: 2222 - protein, 15 aa, Artificial Sequence [sequence omitted]

SEQ ID NO: 2223 - protein, 15 aa, Artificial Sequence
  Synthetic Peptide
LLYTFRKDMDKVETF

SEQ ID NO: 2224 - protein, 15 aa, Artificial Sequence
  Synthetic Peptide
DMDKVETFLRIVQTR

SEQ ID NO: 2225 - protein, 16 aa, Artificial Sequence
  Synthetic Peptide
FLRIVQTRSVEGSTGF

SEQ ID NO: 2226 - protein, 15 aa, Artificial Sequence
  Synthetic Peptide
HLDMLRHLYQGCQVV

SEQ ID NO: 2227 - protein, 17 aa, Artificial Sequence
  Synthetic Peptide
RLRIVRGTQLFEDNYAL

SEQ ID NO: 2228 - protein, 15 aa, Artificial Sequence
  Synthetic Peptide
GVGSPYVSRLLGICL

SEQ ID NO: 2229 - protein, 15 aa, Artificial Sequence
  Synthetic Peptide
TLERPKTLSPGKNGV

SEQ ID NO: 2230 - protein, 18 aa, Artificial Sequence
  Synthetic Peptide
KIFGSLAFLPESFDGDPA

SEQ ID NO: 2231 - protein, 14 aa, Artificial Sequence
  Synthetic Peptide
ELVSEFSRMARDPQ

SEQ ID NO: 2232 - protein, 15 aa, Artificial Sequence
  Synthetic Peptide
GEALSTLVLNRLKVG

SEQ ID NO: 2233 - protein, 15 aa, Artificial Sequence
  Synthetic Peptide
AYVLLSEKKISSIQS

SEQ ID NO: 2234 - protein, 15 aa, Artificial Sequence
  Synthetic Peptide
VASLLTTAEVVVTEI

SEQ ID NO: 2235 - protein, 16 aa, Artificial Sequence
  Synthetic Peptide
KCEFQDAYVILLSEKK

SEQ ID NO: 2236 - protein, 15 aa, Artificial Sequence
  Synthetic Peptide
ALSTLVLNRLKVGLQ

SEQ ID NO: 2237 - protein, 15 aa, Artificial Sequence
  Synthetic Peptide
MSYNLLGFLQRSSNC

SEQ ID NO: 2238 - protein, 15 aa, Artificial Sequence [sequence omitted]

SEQ ID NO: 2239 - protein, 15 aa, Artificial Sequence
  Synthetic Peptide
RSSNCQCQKLLWQLN

SEQ ID NO: 2240 - protein, 15 aa, Artificial Sequence
  Synthetic Peptide
QCQKLLWQLNGRLEY

SEQ ID NO: 2241 - protein, 15 aa, Artificial Sequence
  Synthetic Peptide
LWQLNGRLEYCLKDR

SEQ ID NO: 2242 - protein, 15 aa, Artificial Sequence
  Synthetic Peptide
GRLEYCLKDRRNFDI

SEQ ID NO: 2243 - protein, 15 aa, Artificial Sequence
  Synthetic Peptide
RNFDIPEEIKQLQQF

SEQ ID NO: 2244 - protein, 15 aa, Artificial Sequence
  Synthetic Peptide
PEEIKQLQQFQKEDA

SEQ ID NO: 2245 - protein, 15 aa, Artificial Sequence [sequence omitted]

SEQ ID NO: 2246 - protein, 15 aa, Artificial Sequence
  Synthetic Peptide
QKEDAAVTIYEMLQN

SEQ ID NO: 2247 - protein, 15 aa, Artificial Sequence
  Synthetic Peptide
AVTIYEMLQNIFAIF

SEQ ID NO: 2248 - protein, 15 aa, Artificial Sequence
  Synthetic Peptide
EMLQNIFAIFRQDSS

SEQ ID NO: 2249 - protein, 15 aa, Artificial Sequence
  Synthetic Peptide
IFAIFRQDSSSTGWN

SEQ ID NO: 2250 - protein, 15 aa, Artificial Sequence
  Synthetic Peptide
RQDSSSTGWNETIVE

SEQ ID NO: 2251 - protein, 15 aa, Artificial Sequence
  Synthetic Peptide
STGWNETIVENLLAN

SEQ ID NO: 2252 - protein, 15 aa, Artificial Sequence
  Synthetic Peptide
ETIVENLLANVYHQR

SEQ ID NO: 2253 - protein, 15 aa, Artificial Sequence
  Synthetic Peptide
NLLANVYHQRNHLKT

SEQ ID NO: 2254 - protein, 15 aa, Artificial Sequence
  Synthetic Peptide
VYHQRNHLKTVLEEK

SEQ ID NO: 2255 - protein, 15 aa, Artificial Sequence [sequence omitted]

SEQ ID NO: 2256 - protein, 15 aa, Artificial Sequence
  Synthetic Peptide
FTRGKRMSSLHLKRY

SEQ ID NO: 2257 - protein, 15 aa, Artificial Sequence
  Synthetic Peptide
RMSSLHLKRYYGRIL

SEQ ID NO: 2258 - protein, 15 aa, Artificial Sequence
  Synthetic Peptide
HLKRYYGRILHYLKA

SEQ ID NO: 2259 - protein, 15 aa, Artificial Sequence
  Synthetic Peptide
YGRILHYLKAKEDSH

SEQ ID NO: 2260 - protein, 15 aa, Artificial Sequence
  Synthetic Peptide
HYLKAKEDSHCAWTI

SEQ ID NO: 2261 - protein, 15 aa, Artificial Sequence
  Synthetic Peptide
KEDSHCAWTIVRVEI

SEQ ID NO: 2262 - protein, 15 aa, Artificial Sequence
  Synthetic Peptide
CAWTIVRVEILRNFY

SEQ ID NO: 2263 - protein, 15 aa, Artificial Sequence
  Synthetic Peptide
VRVEILRNFYVINRL

SEQ ID NO: 2264 - protein, 15 aa, Artificial Sequence [sequence omitted]

SEQ ID NO: 2265 - protein, 15 aa, Artificial Sequence
  Synthetic Peptide
MSYNLLGFLQRSSNT

SEQ ID NO: 2266 - protein, 15 aa, Artificial Sequence
  Synthetic Peptide
LGFLQRSSNTQTQKL

SEQ ID NO: 2267 - protein, 15 aa, Artificial Sequence
  Synthetic Peptide
RSSNTQTQKLLWQLN

SEQ ID NO: 2268 - protein, 15 aa, Artificial Sequence
  Synthetic Peptide
QTQKLLWQLNGRLEY

SEQ ID NO: 2269 - protein, 15 aa, Artificial Sequence [sequence omitted]

SEQ ID NO: 2270 - protein, 15 aa, Artificial Sequence
  Synthetic Peptide
GRLEYTLKDRRNFDI

SEQ ID NO: 2271 - protein, 15 aa, Artificial Sequence
  Synthetic Peptide
HYLKAKEDSHTAWTI

SEQ ID NO: 2272 - protein, 15 aa, Artificial Sequence
  Synthetic Peptide
KEDSHTAWTIVRVEI

SEQ ID NO: 2273 - protein, 15 aa, Artificial Sequence
  Synthetic Peptide
TAWTIVRVEILRNFY

SEQ ID NO: 2274 - protein, 15 aa, Artificial Sequence
  Synthetic Peptide
LGFLQRSSNCQSQKL

SEQ ID NO: 2275 - protein, 15 aa, Artificial Sequence
  Synthetic Peptide
RSSNCQSQKLLWQLN

SEQ ID NO: 2276 - protein, 15 aa, Artificial Sequence
  Synthetic Peptide
QSQKLLWQLNGRLEY

SEQ ID NO: 2277 - protein, 15 aa, Artificial Sequence
  Synthetic Peptide
GIVEQCCTSICSLYQ

SEQ ID NO: 2278 - protein, 14 aa, Artificial Sequence
  Synthetic Peptide
TSICSLYQLENYCN

SEQ ID NO: 2279 - protein, 15 aa, Artificial Sequence
  Synthetic Peptide
GILEQCCTSICSLYQ

SEQ ID NO: 2280 - protein, 15 aa, Artificial Sequence
  Synthetic Peptide
GIVEQTTTSITSLYQ

SEQ ID NO: 2281 - protein, 15 aa, Artificial Sequence
  Synthetic Peptide
EQTTTSITSLYQLEN

SEQ ID NO: 2282 - protein, 14 aa, Artificial Sequence
  Synthetic Peptide
TSICSLYQLENYCG

SEQ ID NO: 2283 - protein, 14 aa, Artificial Sequence
  Synthetic Peptide
TSITSLYQLENYTN

SEQ ID NO: 2284 - protein, 14 aa, Artificial Sequence
  Synthetic Peptide
TSITSLYQLENYTG

SEQ ID NO: 2285 - protein, 15 aa, Artificial Sequence
  Synthetic Peptide
GIVEQCCCGSHLVEA

SEQ ID NO: 2286 - protein, 15 aa, Artificial Sequence
  Synthetic Peptide
SLYQLENYCCGERGF

SEQ ID NO: 2287 - protein, 16 aa, Artificial Sequence
  Synthetic Peptide
CCTSICSLYQLENYCC

SEQ ID NO: 2288 - protein, 14 aa, Artificial Sequence
  Synthetic Peptide
GSHLVEALYLVCCN

SEQ ID NO: 2289 - protein, 15 aa, Artificial Sequence
  Synthetic Peptide
CCGSHLVEALYLVCC

SEQ ID NO: 2290 - protein, 15 aa, Artificial Sequence
  Synthetic Peptide
FVNQHLCGSHLVEAL

SEQ ID NO: 2291 - protein, 15 aa, Artificial Sequence
  Synthetic Peptide
QHLCGSHLVEALYLV

SEQ ID NO: 2292 - protein, 15 aa, Artificial Sequence
  Synthetic Peptide
GSHLVEALYLVCGER

SEQ ID NO: 2293 - protein, 15 aa, Artificial Sequence
  Synthetic Peptide
VEALYLVCGERGFFY

SEQ ID NO: 2294 - protein, 15 aa, Artificial Sequence
  Synthetic Peptide
YLVCGERGFFYTPKT

SEQ ID NO: 2295 - protein, 15 aa, Artificial Sequence
  Synthetic Peptide
FVNQHLCGSDLVEAL

SEQ ID NO: 2296 - protein, 15 aa, Artificial Sequence
  Synthetic Peptide
FVNQHLTGSHLVEAL

SEQ ID NO: 2297 - protein, 15 aa, Artificial Sequence
  Synthetic Peptide
QHLTGSHLVEALYLV

SEQ ID NO: 2298 - protein, 15 aa, Artificial Sequence
  Synthetic Peptide
GSHLVEALYLVTGER

SEQ ID NO: 2299 - protein, 15 aa, Artificial Sequence
  Synthetic Peptide
VEALYLVCGERGSFY

SEQ ID NO: 2300 - protein, 15 aa, Artificial Sequence
  Synthetic Peptide
VEALYLVCGERGFLY

SEQ ID NO: 2301 - protein, 15 aa, Artificial Sequence
  Synthetic Peptide
VEALYLVTGERGFFY

SEQ ID NO: 2302 - protein, 15 aa, Artificial Sequence
  Synthetic Peptide
YLVCGERGFLYTPKT

SEQ ID NO: 2303 - protein, 15 aa, Artificial Sequence
  Synthetic Peptide
YLVCGERGFFYTDKT

SEQ ID NO: 2304 - protein, 15 aa, Artificial Sequence
  Synthetic Peptide
YLVCGERGFFYTKPT

SEQ ID NO: 2305 - protein, 15 aa, Artificial Sequence
  Synthetic Peptide
YLVTGERGFFYTPKT

SEQ ID NO: 2306 - protein, 15 aa, Artificial Sequence
  Synthetic Peptide
YLVTGERGFFYTDKT

SEQ ID NO: 2307 - protein, 15 aa, Artificial Sequence
  Synthetic Peptide
YLVTGERGFFYTKPT

SEQ ID NO: 2308 - protein, 15 aa, Artificial Sequence
  Synthetic Peptide
VCGERGFFYTPKTRR

SEQ ID NO: 2309 - protein, 15 aa, Artificial Sequence
  Synthetic Peptide
VTGERGFFYTPKTRR

SEQ ID NO: 2310 - protein, 15 aa, Artificial Sequence
  Synthetic Peptide
MWDLVLSIALSVGCT

SEQ ID NO: 2311 - protein, 15 aa, Artificial Sequence
  Synthetic Peptide
DLVLSIALSVGCTGA

SEQ ID NO: 2312 - protein, 15 aa, Artificial Sequence
  Synthetic Peptide
HPQWVLTAAHCLKKN

SEQ ID NO: 2313 - protein, 15 aa, Artificial Sequence
  Synthetic Peptide
QWVLTAAHCLKKNSQ

SEQ ID NO: 2314 - protein, 15 aa, Artificial Sequence
  Synthetic Peptide
GQRVPVSHSFPHPLY

SEQ ID NO: 2315 - protein, 15 aa, Artificial Sequence
  Synthetic Peptide
RVPVSHSFPHPLYNM

SEQ ID NO: 2316 - protein, 15 aa, Artificial Sequence
  Synthetic Peptide
PHPLYNMSLLKHQSL

SEQ ID NO: 2317 - protein, 15 aa, Artificial Sequence
  Synthetic Peptide
HPLYNMSLLKHQSLR

SEQ ID NO: 2318 - protein, 15 aa, Artificial Sequence
  Synthetic Peptide
NMSLLKHQSLRPDED

SEQ ID NO: 2319 - protein, 15 aa, Artificial Sequence
  Synthetic Peptide
SHDLMLLRLSEPAKI

SEQ ID NO: 2320 - protein, 15 aa, Artificial Sequence
  Synthetic Peptide
HDLMLLRLSEPAKIT

SEQ ID NO: 2321 - protein, 15 aa, Artificial Sequence
  Synthetic Peptide
PEEFLRPRSLQCVSL

SEQ ID NO: 2322 - protein, 15 aa, Artificial Sequence
  Synthetic Peptide
PRSLQCVSLHLLSND

SEQ ID NO: 2323 - protein, 15 aa, Artificial Sequence
  Synthetic Peptide
NGVLQGITSWGPEPC

SEQ ID NO: 2324 - protein, 15 aa, Artificial Sequence
  Synthetic Peptide
KPAVYTKVVHYRKWI

SEQ ID NO: 2325 - protein, 15 aa, Artificial Sequence
  Synthetic Peptide
LHLLSNDMCARAYSE

SEQ ID NO: 2326 - protein, 15 aa, Artificial Sequence
  Synthetic Peptide
VGNWQYFFPVIFSKA

SEQ ID NO: 2327 - protein, 15 aa, Artificial Sequence
  Synthetic Peptide
ESEFQAALSRKVAKL

SEQ ID NO: 2328 - protein, 18 aa, Artificial Sequence
  Synthetic Peptide
IGHLYIFATCLGLSYDGL

SEQ ID NO: 2329 - protein, 31 aa, Artificial Sequence
  Synthetic Peptide
VGNWQYFFPVIFSKASDSLQLVFGIELMEVD

SEQ ID NO: 2330 - protein, 15 aa, Artificial Sequence
  Synthetic Peptide
PAYEKLSAEQSPPPY

SEQ ID NO: 2331 - protein, 23 aa, Artificial Sequence
  Synthetic Peptide
RNGYRALMDKSLHVGTQCALTRR

SEQ ID NO: 2332 - protein, 14 aa, Artificial Sequence
  Synthetic Peptide
FFKNIVTFFKNIVT

SEQ ID NO: 2333 - protein, 20 aa, Artificial Sequence
  Synthetic Peptide
YKSAHKGFKGVDAQGTLSKI

SEQ ID NO: 2334 - protein, 20 aa, Artificial Sequence
  Synthetic Peptide
VDAQGTLSKIFKLGGRDSRS

SEQ ID NO: 2335 - protein, 20 aa, Artificial Sequence
  Synthetic Peptide
ASQKRPSQRHGSKYLATAST

SEQ ID NO: 2336 - protein, 15 aa, Artificial Sequence
  Synthetic Peptide
ENPVVHFFKNIVTPR

SEQ ID NO: 2337 - protein, 15 aa, Artificial Sequence
  Synthetic Peptide
ENPVVAFFKNIVTPR

SEQ ID NO: 2338 - protein, 15 aa, Artificial Sequence
  Synthetic Peptide
ENPVVHAFKNIVTPR

SEQ ID NO: 2339 - protein, 15 aa, Artificial Sequence
  Synthetic Peptide
ENPVVHFFANIVTPR

SEQ ID NO: 2340 - protein, 15 aa, Artificial Sequence
  Synthetic Peptide
ENPVVHFFKNIVTPA

SEQ ID NO: 2341 - protein, 12 aa, Artificial Sequence
  Synthetic Peptide
NPVVHFFKNIVT

SEQ ID NO: 2342 - protein, 14 aa, Artificial Sequence
  Synthetic Peptide
HFFKNIVTPRTPPY

SEQ ID NO: 2343 - protein, 14 aa, Artificial Sequence
  Synthetic Peptide
NPVVHFFKNIVTPR

SEQ ID NO: 2344 - protein, 20 aa, Artificial Sequence
  Synthetic Peptide
LPVPGVLLKEFTVSGNILTI

SEQ ID NO: 2345 - protein, 20 aa, Artificial Sequence
  Synthetic Peptide
WITQCFLPVFLAQPPSGQRR

SEQ ID NO: 2346 - protein, 20 aa, Artificial Sequence
  Synthetic Peptide
DHRQLQLSISSCLQQLSLLM

SEQ ID NO: 2347 - protein, 20 aa, Artificial Sequence
  Synthetic Peptide
YLAMPFATPMEAELARRSLA

SEQ ID NO: 2348 - protein, 15 aa, Artificial Sequence
  Synthetic Peptide
AAPLLLARAASLSLG

SEQ ID NO: 2349 - protein, 15 aa, Artificial Sequence
  Synthetic Peptide
APLLLARAASLSLGF

SEQ ID NO: 2350 - protein, 15 aa, Artificial Sequence
  Synthetic Peptide
PLLLARAASLSLGFL

SEQ ID NO: 2351 - protein, 15 aa, Artificial Sequence
  Synthetic Peptide
SLSLGFLFLLFFWLD

SEQ ID NO: 2352 - protein, 15 aa, Artificial Sequence
  Synthetic Peptide
LLFFWLDRSVLAKEL

SEQ ID NO: 2353 - protein, 15 aa, Artificial Sequence
  Synthetic Peptide
DRSVLAKELKFVTLV

SEQ ID NO: 2354 - protein, 15 aa, Artificial Sequence
  Synthetic Peptide
AKELKFVTLVFRHGD

SEQ ID NO: 2355 - protein, 15 aa, Artificial Sequence
  Synthetic Peptide
RSPIDTFPTDPIKES

SEQ ID NO: 2356 - protein, 15 aa, Artificial Sequence
  Synthetic Peptide
FGQLTQLGMEQHYEL

SEQ ID NO: 2357 - protein, 15 aa, Artificial Sequence
  Synthetic Peptide
DRTLMSAMTNLAALF

SEQ ID NO: 2358 - protein, 15 aa, Artificial Sequence
  Synthetic Peptide
MSAMTNLAALFPPEG

SEQ ID NO: 2359 - protein, 15 aa, Artificial Sequence
  Synthetic Peptide
MTNLAALFPPEGVSI

SEQ ID NO: 2360 - protein, 15 aa, Artificial Sequence
  Synthetic Peptide
PEGVSIWNPILLWQP

SEQ ID NO: 2361 - protein, 15 aa, Artificial Sequence
  Synthetic Peptide
GVSIWNPILLWQPIP

SEQ ID NO: 2362 - protein, 15 aa, Artificial Sequence
  Synthetic Peptide
WNPILLWQPIPVHTV

SEQ ID NO: 2363 - protein, 15 aa, Artificial Sequence
  Synthetic Peptide
NPILLWQPIPVHTVP

SEQ ID NO: 2364 - protein, 15 aa, Artificial Sequence
  Synthetic Peptide
PILLWQPIPVHTVPL

SEQ ID NO: 2365 - protein, 15 aa, Artificial Sequence
  Synthetic Peptide
ILLWQPIPVHTVPLS

SEQ ID NO: 2366 - protein, 15 aa, Artificial Sequence
  Synthetic Peptide
WQPIPVHTVPLSEDQ

SEQ ID NO: 2367 - protein, 15 aa, Artificial Sequence
  Synthetic Peptide
LSGLHGQDLFGIWSK

SEQ ID NO: 2368 - protein, 15 aa, Artificial Sequence
  Synthetic Peptide
YDPLYCESVHNFTLP

SEQ ID NO: 2369 - protein, 15 aa, Artificial Sequence
  Synthetic Peptide
LPSWATEDTMTKLRE

SEQ ID NO: 2370 - protein, 15 aa, Artificial Sequence
  Synthetic Peptide
LRELSELSLLSLYGI

SEQ ID NO: 2371 - protein, 15 aa, Artificial Sequence
  Synthetic Peptide
LSELSLLSLYGIHKQ

SEQ ID NO: 2372 - protein, 15 aa, Artificial Sequence
  Synthetic Peptide
LSLLSLYGIHKQKEK

SEQ ID NO: 2373 - protein, 15 aa, Artificial Sequence
  Synthetic Peptide
KSRLQGGVLVNEILN

SEQ ID NO: 2374 - protein, 15 aa, Artificial Sequence
  Synthetic Peptide
GGVLVNEILNHMKRA

SEQ ID NO: 2375 - protein, 15 aa, Artificial Sequence
  Synthetic Peptide
IPSYKKLIMYSAHDT

SEQ ID NO: 2376 - protein, 15 aa, Artificial Sequence
  Synthetic Peptide
YKKLIMYSAHDTTVS

SEQ ID NO: 2377 - protein, 15 aa, Artificial Sequence
  Synthetic Peptide
LIMYSAHDTTVSGLQ

SEQ ID NO: 2378 - protein, 15 aa, Artificial Sequence
  Synthetic Peptide
DTTVSGLQMALDVYN

SEQ ID NO: 2379 - protein, 15 aa, Artificial Sequence
  Synthetic Peptide
ALDVYNGLLPPYASC

SEQ ID NO: 2380 - protein, 15 aa, Artificial Sequence
  Synthetic Peptide
LDVYNGLLPPYASCH

SEQ ID NO: 2381 - protein, 15 aa, Artificial Sequence
  Synthetic Peptide
YNGLLPPYASCHLTE

SEQ ID NO: 2382 - protein, 15 aa, Artificial Sequence
  Synthetic Peptide
FAELVGPVIPQDWST

SEQ ID NO: 2383 - protein, 15 aa, Artificial Sequence
  Synthetic Peptide
TVPLSEDQLLYLPFR

SEQ ID NO: 2384 - protein, 15 aa, Artificial Sequence
  Synthetic Peptide
LTELYFEKGEYFVEM

SEQ ID NO: 2385 - protein, 15 aa, Artificial Sequence
  Synthetic Peptide
GPVIPQDWSTECMTT

SEQ ID NO: 2386 - protein, 21 aa, Artificial Sequence
  Synthetic Peptide
QAHSLERVCHCLGKWLGHPDK

SEQ ID NO: 2387 - protein, 20 aa, Artificial Sequence
  Synthetic Peptide
WTTCQSIAFPSKTSASIGSL

SEQ ID NO: 2388 - protein, 20 aa, Artificial Sequence
  Synthetic Peptide
QKGRGYRGQHQAHSLERVCH

SEQ ID NO: 2389 - protein, 18 aa, Artificial Sequence
  Synthetic Peptide
AATYNFAVLKLMGRGTKF

SEQ ID NO: 2390 - protein, 20 aa, Artificial Sequence
  Synthetic Peptide
VATGLCFFGVALFCGCGHEA

SEQ ID NO: 2391 - protein, 20 aa, Artificial Sequence
  Synthetic Peptide
FLYGALLLAEGFYTTGAVRQ

SEQ ID NO: 2392 - protein, 20 aa, Artificial Sequence
  Synthetic Peptide
SAVPVYIYFNTWTTCQSIAF

SEQ ID NO: 2393 - protein, 15 aa, Artificial Sequence
  Synthetic Peptide
TLSVTWIGAAPLILS

SEQ ID NO: 2394 - protein, 15 aa, Artificial Sequence
  Synthetic Peptide
SVTWIGAAPLILSRI

SEQ ID NO: 2395 - protein, 15 aa, Artificial Sequence
  Synthetic Peptide
VTWIGAAPLILSRIV

SEQ ID NO: 2396 - protein, 15 aa, Artificial Sequence
  Synthetic Peptide
SQPWQVLVASRGRAV

SEQ ID NO: 2397 - protein, 15 aa, Artificial Sequence
  Synthetic Peptide
GRAVCGGVLVHPQWV

SEQ ID NO: 2398 - protein, 15 aa, Artificial Sequence
  Synthetic Peptide
GVLVHPQWVLTAAHC

SEQ ID NO: 2399 - protein, 15 aa, Artificial Sequence
  Synthetic Peptide
HPQWVLTAAHCIRNK

SEQ ID NO: 2400 - protein, 15 aa, Artificial Sequence
  Synthetic Peptide
QWVLTAAHCIRNKSV

SEQ ID NO: 2401 - protein, 15 aa, Artificial Sequence
  Synthetic Peptide
AHCIRNKSVILLGRH

SEQ ID NO: 2402 - protein, 15 aa, Artificial Sequence
  Synthetic Peptide
SVILLGRHSLFHPED

SEQ ID NO: 2403 - protein, 15 aa, Artificial Sequence
  Synthetic Peptide
VILLGRHSLFHPEDT

SEQ ID NO: 2404 - protein, 15 aa, Artificial Sequence
  Synthetic Peptide
GQVFQVSHSFPHPLY

SEQ ID NO: 2405 - protein, 15 aa, Artificial Sequence
  Synthetic Peptide
VFQVSHSFPHPLYDM

SEQ ID NO: 2406 - protein, 15 aa, Artificial Sequence
  Synthetic Peptide
PHPLYDMSLLKNRFL

SEQ ID NO: 2407 - protein, 15 aa, Artificial Sequence
  Synthetic Peptide
SHDLMLLRLSEPAEL

SEQ ID NO: 2408 - protein, 15 aa, Artificial Sequence
  Synthetic Peptide
HDLMLLRLSEPAELT

SEQ ID NO: 2409 - protein, 15 aa, Artificial Sequence
  Synthetic Peptide
TDAVKVMDLPTQEPA

SEQ ID NO: 2410 - protein, 15 aa, Artificial Sequence
  Synthetic Peptide
LHVISNDVCAQVHPQ

SEQ ID NO: 2411 - protein, 15 aa, Artificial Sequence
  Synthetic Peptide
CAQVHPQKVTKFMLC

SEQ ID NO: 2412 - protein, 15 aa, Artificial Sequence
  Synthetic Peptide
GGPLVCNGVLQGITS

SEQ ID NO: 2413 - protein, 15 aa, Artificial Sequence
  Synthetic Peptide
GPLVCNGVLQGITSW

SEQ ID NO: 2414 - protein, 15 aa, Artificial Sequence
  Synthetic Peptide
NGVLQGITSWGSEPC

SEQ ID NO: 2415 - protein, 15 aa, Artificial Sequence
  Synthetic Peptide
RPSLYTKVVHYRKWI

SEQ ID NO: 2416 - protein, 15 aa, Artificial Sequence
  Synthetic Peptide
HSLFHPEDTGQVFQV

SEQ ID NO: 2417 - protein, 15 aa, Artificial Sequence
  Synthetic Peptide
PRWLCAGALVLAGGF

SEQ ID NO: 2418 - protein, 15 aa, Artificial Sequence
  Synthetic Peptide
LGFLFGWFIKSSNEA

SEQ ID NO: 2419 - protein, 15 aa, Artificial Sequence
  Synthetic Peptide
LDELKAENIKKFLYN

SEQ ID NO: 2420 - protein, 15 aa, Artificial Sequence
  Synthetic Peptide
IKKFLYNFTQIPHLA

SEQ ID NO: 2421 - protein, 15 aa, Artificial Sequence
  Synthetic Peptide
KFLYNFTQIPHLAGT

SEQ ID NO: 2422 - protein, 15 aa, Artificial Sequence
  Synthetic Peptide
WKEFGLDSVELAHYD

SEQ ID NO: 2423 - protein, 15 aa, Artificial Sequence
  Synthetic Peptide
LAHYDVLLSYPNKTH

SEQ ID NO: 2424 - protein, 15 aa, Artificial Sequence
  Synthetic Peptide
GNEIFNTSLFEPPPP

SEQ ID NO: 2425 - protein, 15 aa, Artificial Sequence
  Synthetic Peptide
GKVFRGNKVKNAQLA

SEQ ID NO: 2426 - protein, 15 aa, Artificial Sequence
  Synthetic Peptide
GNKVKNAQLAGAKGV

SEQ ID NO: 2427 - protein, 15 aa, Artificial Sequence
  Synthetic Peptide
EYAYRRGIAEAVGLP

SEQ ID NO: 2428 - protein, 15 aa, Artificial Sequence
  Synthetic Peptide
AEAVGLPSIPVHPIG

SEQ ID NO: 2429 - protein, 15 aa, Artificial Sequence
  Synthetic Peptide
AVGLPSIPVHPIGYY

SEQ ID NO: 2430 - protein, 15 aa, Artificial Sequence
  Synthetic Peptide
IGYYDAQKLLEKMGG

SEQ ID NO: 2431 - protein, 15 aa, Artificial Sequence
  Synthetic Peptide
TGNFSTQKVKMHIHS

SEQ ID NO: 2432 - protein, 15 aa, Artificial Sequence
  Synthetic Peptide
TRIYNVIGTLRGAVE

SEQ ID NO: 2433 - protein, 15 aa, Artificial Sequence
  Synthetic Peptide
ERGVAYINADSSIEG

SEQ ID NO: 2434 - protein, 15 aa, Artificial Sequence
  Synthetic Peptide
GVAYINADSSIEGNY

SEQ ID NO: 2435 - protein, 15 aa, Artificial Sequence
  Synthetic Peptide
DSSIEGNYTLRVDCT

SEQ ID NO: 2436 - protein, 15 aa, Artificial Sequence
  Synthetic Peptide
NYTLRVDCTPLMYSL

SEQ ID NO: 2437 - protein, 15 aa, Artificial Sequence
  Synthetic Peptide
CTPLMYSLVHNLTKE

SEQ ID NO: 2438 - protein, 15 aa, Artificial Sequence
  Synthetic Peptide
DFEVFFQRLGIASGR

SEQ ID NO: 2439 - protein, 15 aa, Artificial Sequence
  Synthetic Peptide
EVFFQRLGIASGRAR

SEQ ID NO: 2440 - protein, 15 aa, Artificial Sequence
  Synthetic Peptide
TNKFSGYPLYHSVYE

SEQ ID NO: 2441 - protein, 15 aa, Artificial Sequence
  Synthetic Peptide
YDPMFKYHLTVAQVR

SEQ ID NO: 2442 - protein, 15 aa, Artificial Sequence
  Synthetic Peptide
DPMFKYHLTVAQVRG

SEQ ID NO: 2443 - protein, 15 aa, Artificial Sequence
  Synthetic Peptide
MFKYHLTVAQVRGGM

SEQ ID NO: 2444 - protein, 15 aa, Artificial Sequence
  Synthetic Peptide
KYHLTVAQVRGGMVF

SEQ ID NO: 2445 - protein, 15 aa, Artificial Sequence
  Synthetic Peptide
VAQVRGGMVFELANS

SEQ ID NO: 2446 - protein, 15 aa, Artificial Sequence
  Synthetic Peptide
RGGMVFELANSIVLP

SEQ ID NO: 2447 - protein, 15 aa, Artificial Sequence
  Synthetic Peptide
GMVFELANSIVLPFD

SEQ ID NO: 2448 - protein, 15 aa, Artificial Sequence
  Synthetic Peptide
VFELANSIVLPFDCR

SEQ ID NO: 2449 - protein, 15 aa, Artificial Sequence
  Synthetic Peptide
ADKIYSISMKHPQEM

SEQ ID NO: 2450 - protein, 15 aa, Artificial Sequence
  Synthetic Peptide
IYSISMKHPQEMKTY

SEQ ID NO: 2451 - protein, 15 aa, Artificial Sequence
  Synthetic Peptide
PQEMKTYSVSFDSLF

SEQ ID NO: 2452 - protein, 15 aa, Artificial Sequence
  Synthetic Peptide
TYSVSFDSLFSAVKN

SEQ ID NO: 2453 - protein, 15 aa, Artificial Sequence
  Synthetic Peptide
VLRMMNDQLMFLERA

SEQ ID NO: 2454 - protein, 15 aa, Artificial Sequence
  Synthetic Peptide
LRMMNDQLMFLERAF

SEQ ID NO: 2455 - protein, 15 aa, Artificial Sequence
  Synthetic Peptide
RHVIYAPSSHNKYAG

SEQ ID NO: 2456 - protein, 15 aa, Artificial Sequence
  Synthetic Peptide
RQIYVAAFTVQAAAE

SEQ ID NO: 2457 - protein, 15 aa, Artificial Sequence
  Synthetic Peptide
QIYVAAFTVQAAAET

SEQ ID NO: 2458 - protein, 15 aa, Artificial Sequence
  Synthetic Peptide
VAAFTVQAAAETLSE

SEQ ID NO: 2459 - protein, 15 aa, Artificial Sequence
  Synthetic Peptide
YISIINEDGNEIFNT

SEQ ID NO: 2460 - protein, 15 aa, Artificial Sequence
  Synthetic Peptide
ISIINEDGNEIFNTS

SEQ ID NO: 2461 - protein, 15 aa, Artificial Sequence
  Synthetic Peptide
EDFFKLERDMKINCS

SEQ ID NO: 2462 - protein, 15 aa, Artificial Sequence
  Synthetic Peptide
FFKLERDMKINCSGK

SEQ ID NO: 2463 - protein, 15 aa, Artificial Sequence
  Synthetic Peptide
GVILYSDPADYFAPG

SEQ ID NO: 2464 - protein, 15 aa, Artificial Sequence
  Synthetic Peptide
GAAVVHEIVRSFGTL

SEQ ID NO: 2465 - protein, 15 aa, Artificial Sequence
  Synthetic Peptide
NSRLLQERGVAYINA

SEQ ID NO: 2466 - protein, 15 aa, Artificial Sequence
  Synthetic Peptide
VAYINADSSIEGNYT

SEQ ID NO: 2467 - protein, 15 aa, Artificial Sequence
  Synthetic Peptide
DQLMFLERAFIDPLG

SEQ ID NO: 2468 - protein, 16 aa, Artificial Sequence
  Synthetic Peptide
KSNFLNCYVSGFHPSD

SEQ ID NO: 2469 - protein, 18 aa, Artificial Sequence
  Synthetic Peptide
NPDAENWNSQFEILEDAA

SEQ ID NO: 2470 - protein, 15 aa, Artificial Sequence
  Synthetic Peptide
EYLILSARDVLAVVS

SEQ ID NO: 2471 - protein, 12 aa, Artificial Sequence
  Synthetic Peptide
YKTIAYDEEARR

SEQ ID NO: 2472 - protein, 15 aa, Artificial Sequence
  Synthetic Peptide
GEALSTLVVNKIRGT

SEQ ID NO: 2473 - protein, 15 aa, Artificial Sequence
  Synthetic Peptide
PYILLVSSKVSTVKD

SEQ ID NO: 2474 - protein, 15 aa, Artificial Sequence
  Synthetic Peptide
EAVLEDPYILLVSSK

SEQ ID NO: 2475 - protein, 15 aa, Artificial Sequence
  Synthetic Peptide
IAGLFLTTEAVVADK

SEQ ID NO: 2476 - protein, 15 aa, Artificial Sequence
  Synthetic Peptide
ALSTLVVNKIRGTFK

SEQ ID NO: 2477 - protein, 15 aa, Artificial Sequence
  Synthetic Peptide
MKHILYISFYFILVN

SEQ ID NO: 2478 - protein, 15 aa, Artificial Sequence
  Synthetic Peptide
KSLLSTNLPYGRTNL

SEQ ID NO: 2479 - protein, 15 aa, Artificial Sequence
  Synthetic Peptide
HFFLFLLYILFLVKM

SEQ ID NO: 2480 - protein, 15 aa, Artificial Sequence
  Synthetic Peptide
LFLLYILFLVKMNAL

SEQ ID NO: 2481 - protein, 15 aa, Artificial Sequence
  Synthetic Peptide
ILFLVKMNALRRLPV

SEQ ID NO: 2482 - protein, 15 aa, Artificial Sequence
  Synthetic Peptide
MNALRRLPVICSFLV

SEQ ID NO: 2483 - protein, 15 aa, Artificial Sequence
  Synthetic Peptide
SAFLESQSMNKIGDD

SEQ ID NO: 2484 - protein, 15 aa, Artificial Sequence
  Synthetic Peptide
LKELIKVGLPSFENL

SEQ ID NO: 2485 - protein, 15 aa, Artificial Sequence
  Synthetic Peptide
FENLVAENVKPPKVD

SEQ ID NO: 2486 - protein, 15 aa, Artificial Sequence
  Synthetic Peptide
PATYGIIVPVLTSLF

SEQ ID NO: 2487 - protein, 15 aa, Artificial Sequence
  Synthetic Peptide
YGIIVPVLTSLFNKV

SEQ ID NO: 2488 - protein, 15 aa, Artificial Sequence
  Synthetic Peptide
LLKIWKNYMKIMNHL

SEQ ID NO: 2489 - protein, 15 aa, Artificial Sequence
  Synthetic Peptide
MTLYQIQVMKRNQKQ

SEQ ID NO: 2490 - protein, 15 aa, Artificial Sequence
  Synthetic Peptide
QKQVQMMIMIKFMGV

SEQ ID NO: 2491 - protein, 15 aa, Artificial Sequence
  Synthetic Peptide
MIMIKFMGVIYIMII

SEQ ID NO: 2492 - protein, 15 aa, Artificial Sequence
  Synthetic Peptide
GVIYIMIISKKMMRK

SEQ ID NO: 2493 - protein, 15 aa, Artificial Sequence
  Synthetic Peptide
LYYLFNQHIKKELYH

SEQ ID NO: 2494 - protein, 15 aa, Artificial Sequence
  Synthetic Peptide
HFNMLKNKMQSSFFM

SEQ ID NO: 2495 - protein, 15 aa, Artificial Sequence
  Synthetic Peptide
LDIYQKLYIKQEEQK

SEQ ID NO: 2496 - protein, 15 aa, Artificial Sequence
  Synthetic Peptide
QKKYIYNLIMNTQNK

SEQ ID NO: 2497 - protein, 15 aa, Artificial Sequence
  Synthetic Peptide
YEALIKLLPFSKRIR

SEQ ID NO: 2498 - protein, 15 aa, Artificial Sequence
  Synthetic Peptide
ENEYATGAVRPFQAA

SEQ ID NO: 2499 - protein, 15 aa, Artificial Sequence
  Synthetic Peptide
NYELSKKAVIFTPIY

SEQ ID NO: 2500 - protein, 15 aa, Artificial Sequence
  Synthetic Peptide
QKILIKIPVTKNIIT

SEQ ID NO: 2501 - protein, 15 aa, Artificial Sequence
  Synthetic Peptide
KCLVISQVSNSDSYK

SEQ ID NO: 2502 - protein, 15 aa, Artificial Sequence
  Synthetic Peptide
SKIMKLPKLPISNGK

SEQ ID NO: 2503 - protein, 15 aa, Artificial Sequence
  Synthetic Peptide
FIHFFTWGTMFVPKY

SEQ ID NO: 2504 - protein, 15 aa, Artificial Sequence
  Synthetic Peptide
LCNFKKNIIALLIIP

SEQ ID NO: 2505 - protein, 15 aa, Artificial Sequence
  Synthetic Peptide
KKNIIALLIIPPKIH

SEQ ID NO: 2506 - protein, 15 aa, Artificial Sequence
  Synthetic Peptide
ALLIIPPKIHISIEL

SEQ ID NO: 2507 - protein, 15 aa, Artificial Sequence
  Synthetic Peptide
SMEYKKDFLITARKP

SEQ ID NO: 2508 - protein, 15 aa, Artificial Sequence
  Synthetic Peptide
KSKFNILSSPLFNNF

SEQ ID NO: 2509 - protein, 15 aa, Artificial Sequence
  Synthetic Peptide
FKKLKNHVLFLQMMN

SEQ ID NO: 2510 - protein, 15 aa, Artificial Sequence
  Synthetic Peptide
KNHVLFLQMMNVNLQ

SEQ ID NO: 2511 - protein, 15 aa, Artificial Sequence
  Synthetic Peptide
VLFLQMMNVNLQKQL

SEQ ID NO: 2512 - protein, 15 aa, Artificial Sequence
  Synthetic Peptide
NVNLQKQLLTNHLIN

SEQ ID NO: 2513 - protein, 15 aa, Artificial Sequence
  Synthetic Peptide
QKQLLTNHLINTPKI

SEQ ID NO: 2514 - protein, 15 aa, Artificial Sequence
  Synthetic Peptide
NHLINTPKIMPHHII

SEQ ID NO: 2515 - protein, 15 aa, Artificial Sequence
  Synthetic Peptide
YILLKKILSSRFNQM

SEQ ID NO: 2516 - protein, 15 aa, Artificial Sequence
  Synthetic Peptide
FNQMIFVSSIFISFY

SEQ ID NO: 2517 - protein, 17 aa, Artificial Sequence
  Synthetic Peptide
KVSCKGSGYTFTAYQMH

SEQ ID NO: 2518 - protein, 20 aa, Artificial Sequence
  Synthetic Peptide
IAKVPPGPNITAEYGDKWLD

SEQ ID NO: 2519 - protein, 20 aa, Artificial Sequence
  Synthetic Peptide
TAEYGDKWLDAKSTWYGKPT

SEQ ID NO: 2520 - protein, 20 aa, Artificial Sequence
  Synthetic Peptide
AKSTWYGKPTGAGPKDNGGA

SEQ ID NO: 2521 - protein, 20 aa, Artificial Sequence
  Synthetic Peptide
GAGPKDNGGACGYKDVDKAP

SEQ ID NO: 2522 - protein, 20 aa, Artificial Sequence
  Synthetic Peptide
FNGMTGCGNTPIFKDGRGCG

SEQ ID NO: 2523 - protein, 20 aa, Artificial Sequence
  Synthetic Peptide
PIFKDGRGCGSCFEIKCTKP

SEQ ID NO: 2524 - protein, 20 aa, Artificial Sequence
  Synthetic Peptide
SCFEIKCTKPESCSGEAVTV

SEQ ID NO: 2525 - protein, 20 aa, Artificial Sequence
  Synthetic Peptide
AFGSMAKKGEEQNVRSAGEL

SEQ ID NO: 2526 - protein, 20 aa, Artificial Sequence
  Synthetic Peptide
TPDKLTGPFTVRYTTEGGTK

SEQ ID NO: 2527 - protein, 20 aa, Artificial Sequence
  Synthetic Peptide
VRYTTEGGTKSEVEDVIPEG

SEQ ID NO: 2528 - protein, 15 aa, Artificial Sequence
  Synthetic Peptide
TCVLGKLSQELHKLQ

SEQ ID NO: 2529 - protein, 15 aa, Artificial Sequence
  Synthetic Peptide
KLSQELHKLQTYPRT

SEQ ID NO: 2530 - protein, 15 aa, Artificial Sequence
  Synthetic Peptide
LHKLQTYPRTNTGSG

SEQ ID NO: 2531 - protein, 15 aa, Artificial Sequence
  Synthetic Peptide
KLQTYPRTNTGSGTP

SEQ ID NO: 2532 - protein, 15 aa, Artificial Sequence
  Synthetic Peptide
CCVLGKLSQELHKLQ

SEQ ID NO: 2533 - protein, 15 aa, Artificial Sequence
  Synthetic Peptide
CSNLSTCVLGKLSQE

SEQ ID NO: 2534 - protein, 15 aa, Artificial Sequence
  Synthetic Peptide
TSNLSTTVLGKLSQE

SEQ ID NO: 2535 - protein, 15 aa, Artificial Sequence
  Synthetic Peptide
TTVLGKLSQELHKLQ

SEQ ID NO: 2536 - protein, 11 aa, Artificial Sequence
  Synthetic Peptide
DIAAKYKELGY

SEQ ID NO: 2537 - protein, 11 aa, Artificial Sequence
  Synthetic Peptide
ALVRQGLAKVA

SEQ ID NO: 2538 - protein, 20 aa, Artificial Sequence
  Synthetic Peptide
PATLIKAIDGDTVKLMYKGQ

SEQ ID NO: 2539 - protein, 20 aa, Artificial Sequence
  Synthetic Peptide
TPETKHPKKGVEKYGPEASA

SEQ ID NO: 2540 - protein, 20 aa, Artificial Sequence
  Synthetic Peptide
VEKYGPEASAFTKKMVENAK

SEQ ID NO: 2541 - protein, 20 aa, Artificial Sequence
  Synthetic Peptide
FTKKMVENAKKIEVEFDKGQ

SEQ ID NO: 2542 - protein, 20 aa, Artificial Sequence
  Synthetic Peptide
YIYADGKMVNEALVRQGLAK

SEQ ID NO: 2543 - protein, 20 aa, Artificial Sequence
  Synthetic Peptide
HEQHLRKSEAQAKKEKLNIW

SEQ ID NO: 2544 - protein, 19 aa, Artificial Sequence
  Synthetic Peptide
QAKKEKLNIWSEDNADSGQ

SEQ ID NO: 2545 - protein, 15 aa, Artificial Sequence
  Synthetic Peptide
YFNNFTVSFWLRVPK

SEQ ID NO: 2546 - protein, 7 aa, Artificial Sequence
  Synthetic Peptide
FSYFPSI

SEQ ID NO: 2547 - protein, 7 aa, Artificial Sequence
  Synthetic Peptide
YSFFPSI

SEQ ID NO: 2548 - protein, 8 aa, Artificial Sequence
  Synthetic Peptide
YSYFPSIR

SEQ ID NO: 2549 - protein, 29 aa, Artificial Sequence
  Synthetic Peptide
  VARIANT 29: Xaa = Any Amino Acid
DPNANPNVDPNANPNVNANPNANPNANPX

SEQ ID NO: 2550 - protein, 10 aa, Artificial Sequence
  Synthetic Peptide
QKWAAVVVPS

SEQ ID NO: 2551 - protein, 22 aa, Artificial Sequence
  Synthetic Peptide
TWQLNGEELIQDMELVETRPAG

SEQ ID NO: 2552 - protein, 15 aa, Artificial Sequence
  Synthetic Peptide
PEFLEQRRAAVDTYC

SEQ ID NO: 2553 - protein, 6 aa, Artificial Sequence
  Synthetic Peptide
STRKSP

SEQ ID NO: 2554 - protein, 15 aa, Artificial Sequence
  Synthetic Peptide
DYSYLQDSDPDSFQD

SEQ ID NO: 2555 - protein, 15 aa, Artificial Sequence
  Synthetic Peptide
DFSYLQDSDPDSFQD

SEQ ID NO: 2556 - protein, 15 aa, Artificial Sequence
  Synthetic Peptide
QNILFSNAPLGPQFP

SEQ ID NO: 2557 - protein, 15 aa, Artificial Sequence [sequence omitted]

SEQ ID NO: 2558 - protein, 15 aa, Artificial Sequence
  Synthetic Peptide
DYSYLQDSDPDSFQD

SEQ ID NO: 2559 - protein, 12 aa, Artificial Sequence
  Synthetic Peptide
KYVKQNTLKLAT

SEQ ID NO: 2560 - protein, 11 aa, Artificial Sequence
  Synthetic Peptide
  VARIANT 2: Xaa = Any Amino Acid
PXKQNTLKLAT

SEQ ID NO: 2561 - protein, 14 aa, Artificial Sequence
  Synthetic Peptide
EEDIEIIPIQEEEY

SEQ ID NO: 2562 - protein, 15 aa, Artificial Sequence
  Synthetic Peptide
HQAISPRTLNSPAIF

SEQ ID NO: 2563 - protein, 16 aa, Artificial Sequence
  Synthetic Peptide
YTDVFSLDPTFTIETT

SEQ ID NO: 2564 - protein, 15 aa, Artificial Sequence
  Synthetic Peptide
YAGIRRDGLLLRLVD

SEQ ID NO: 2565 - protein, 15 aa, Artificial Sequence
  Synthetic Peptide
LFFYRKSVWSKLQSI

SEQ ID NO: 2566 - protein, 20 aa, Artificial Sequence
  Synthetic Peptide
RPIVNMDYVVGARTFRREKR

SEQ ID NO: 2567 - protein, 15 aa, Artificial Sequence
  Synthetic Peptide
RPGLLGASVLGLDDI

SEQ ID NO: 2568 - protein, 15 aa, Artificial Sequence
  Synthetic Peptide
LYFVKVDVTGAYDTI

SEQ ID NO: 2569 - protein, 15 aa, Artificial Sequence
  Synthetic Peptide
FAGIRRDGLLLRLVD

SEQ ID NO: 2570 - protein, 15 aa, Artificial Sequence
  Synthetic Peptide
AKTFLRTLVRGVPEY

SEQ ID NO: 2571 - protein, 15 aa, Artificial Sequence
  Synthetic Peptide
YGAVVNLRKTVVNFP

SEQ ID NO: 2572 - protein, 15 aa, Artificial Sequence
  Synthetic Peptide
GTAFVQMPAHGLFPW

SEQ ID NO: 2573 - protein, 15 aa, Artificial Sequence
  Synthetic Peptide
WAGLLLDTRTLEVQS

SEQ ID NO: 2574 - protein, 15 aa, Artificial Sequence
  Synthetic Peptide
RTSIRASLTFNRGFK

SEQ ID NO: 2575 - protein, 11 aa, Artificial Sequence
  Synthetic Peptide
RVIKNSIRLTL

SEQ ID NO: 2576 - protein, 11 aa, Artificial Sequence
  Synthetic Peptide
PVIKNSIKLRL

SEQ ID NO: 2577 - protein, 20 aa, Artificial Sequence
  Synthetic Peptide
ATSTKKLHKEPATLIKAIDG

SEQ ID NO: 2578 - protein, 10 aa, Artificial Sequence
  Synthetic Peptide
SGPSNTPPEI

SEQ ID NO: 2579 - protein, 8 aa, Artificial Sequence
  Synthetic Peptide
RNPRFYNL

SEQ ID NO: 2580 - protein, 9 aa, Artificial Sequence
  Synthetic Peptide
QPQRGYENF

SEQ ID NO: 2581 - protein, 9 aa, Artificial Sequence
  Synthetic Peptide
SEAAYAKKI

SEQ ID NO: 2582 - protein, 9 aa, Artificial Sequence
  Synthetic Peptide
AYAPAKAAI

SEQ ID NO: 2583 - protein, 9 aa, Artificial Sequence
  Synthetic Peptide
AYAEAKAAI

SEQ ID NO: 2584 - protein, 9 aa, Artificial Sequence
  Synthetic Peptide
AYANAKAAI

SEQ ID NO: 2585 - protein, 9 aa, Artificial Sequence
  Synthetic Peptide
AYAGAKAAI

SEQ ID NO: 2586 - protein, 9 aa, Artificial Sequence
  Synthetic Peptide
AYAVAKAAI

SEQ ID NO: 2587 - protein, 8 aa, Artificial Sequence
  Synthetic Peptide
AAAAYAAM

SEQ ID NO: 2588 - protein, 10 aa, Artificial Sequence
  Synthetic Peptide
AAAAYAAAAM

SEQ ID NO: 2589 - protein, 9 aa, Artificial Sequence
  Synthetic Peptide
AAAANAAAM

SEQ ID NO: 2590 - protein, 11 aa, Artificial Sequence
  Synthetic Peptide
AAAAAANAAAM

SEQ ID NO: 2591 - protein, 8 aa, Artificial Sequence
  Synthetic Peptide
NAIVFKGL

SEQ ID NO: 2592 - protein, 8 aa, Artificial Sequence
  Synthetic Peptide
SIINFEKL

SEQ ID NO: 2593 - protein, 8 aa, Artificial Sequence
  Synthetic Peptide
IFYCPIAI

SEQ ID NO: 2594 - protein, 8 aa, Artificial Sequence
  Synthetic Peptide
KVVRFDKL

SEQ ID NO: 2595 - protein, 10 aa, Artificial Sequence
  Synthetic Peptide
VYSFSLASRL

SEQ ID NO: 2596 - protein, 8 aa, Artificial Sequence
  Synthetic Peptide
SIINFEKL

SEQ ID NO: 2597 - protein, 8 aa, Artificial Sequence
  Synthetic Peptide
KVVRFDKL

SEQ ID NO: 2598 - protein, 9 aa, Artificial Sequence
  Synthetic Peptide
SENDRYRLL

SEQ ID NO: 2599 - protein, 9 aa, Artificial Sequence
  Synthetic Peptide
SFYRNLLWL

SEQ ID NO: 2600 - protein, 8 aa, Artificial Sequence
  Synthetic Peptide
YEANGNLI

SEQ ID NO: 2601 - protein, 8 aa, Artificial Sequence
  Synthetic Peptide
MGLIYNRM

SEQ ID NO: 2602 - protein, 8 aa, Artificial Sequence
  Synthetic Peptide
MGYIYNRM

SEQ ID NO: 2603 - protein, 8 aa, Artificial Sequence
  Synthetic Peptide
MGIIYNRM

SEQ ID NO: 2604 - protein, 8 aa, Artificial Sequence
  Synthetic Peptide
MGLIFNRM

SEQ ID NO: 2605 - protein, 8 aa, Artificial Sequence
  Synthetic Peptide
MGLIYNRM

SEQ ID NO: 2606 - protein, 9 aa, Artificial Sequence
  Synthetic Peptide
RMIQNSLTI

SEQ ID NO: 2607 - protein, 9 aa, Artificial Sequence
  Synthetic Peptide
RLIQNFLTI

SEQ ID NO: 2608 - protein, 9 aa, Artificial Sequence
  Synthetic Peptide
GMRQNATEI

SEQ ID NO: 2609 - protein, 9 aa, Artificial Sequence
  Synthetic Peptide
YMRVNGKWM

SEQ ID NO: 2610 - protein, 9 aa, Artificial Sequence
  Synthetic Peptide
FYIQMATEL

SEQ ID NO: 2611 - protein, 9 aa, Artificial Sequence
  Synthetic Peptide
FYIQMCTFL

SEQ ID NO: 2612 - protein, 9 aa, Artificial Sequence
  Synthetic Peptide
AYERMANIL

SEQ ID NO: 2613 - protein, 9 aa, Artificial Sequence
  Synthetic Peptide
AYQRMCNIL

SEQ ID NO: 2614 - protein, 9 aa, Artificial Sequence
  Synthetic Peptide
AYERMCTIL

SEQ ID NO: 2615 - protein, 9 aa, Artificial Sequence
  Synthetic Peptide
ASNENMETM

SEQ ID NO: 2616 - protein, 9 aa, Artificial Sequence
  Synthetic Peptide
TYQRTRALM

SEQ ID NO: 2617 - protein, 9 aa, Artificial Sequence
  Synthetic Peptide
TYQKTRALV

SEQ ID NO: 2618 - protein, 9 aa, Artificial Sequence
  Synthetic Peptide
TYQPTRALV

SEQ ID NO: 2619 - protein, 9 aa, Artificial Sequence
  Synthetic Peptide
TYQFTRALV

SEQ ID NO: 2620 - protein, 9 aa, Artificial Sequence
  Synthetic Peptide
TYQLTRALV

SEQ ID NO: 2621 - protein, 8 aa, Artificial Sequence
  Synthetic Peptide
SDYEGRLI

SEQ ID NO: 2622 - protein, 8 aa, Artificial Sequence
  Synthetic Peptide
MITQFESL

SEQ ID NO: 2623 - protein, 8 aa, Artificial Sequence
  Synthetic Peptide
RTFSFQLI

SEQ ID NO: 2624 - protein, 8 aa, Artificial Sequence
  Synthetic Peptide
FSVIFDRL

SEQ ID NO: 2625 - protein, 8 aa, Artificial Sequence
  Synthetic Peptide
RTFSFQLI

SEQ ID NO: 2626 - protein, 8 aa, Artificial Sequence
  Synthetic Peptide
MITQFESL

SEQ ID NO: 2627 - protein, 8 aa, Artificial Sequence
  Synthetic Peptide
FSVIFDRL

SEQ ID NO: 2628 - protein, 8 aa, Artificial Sequence
  Synthetic Peptide
KSSFYRNL

SEQ ID NO: 2629 - protein, 8 aa, Artificial Sequence
  Synthetic Peptide
SSLPFQNI

SEQ ID NO: 2630 - protein, 8 aa, Artificial Sequence
  Synthetic Peptide
MNIQFTAV

SEQ ID NO: 2631 - protein, 8 aa, Artificial Sequence
  Synthetic Peptide
MNYYWTLL

SEQ ID NO: 2632 - protein, 9 aa, Artificial Sequence
  Synthetic Peptide
SFYRNLLWL

SEQ ID NO: 2633 - protein, 8 aa, Artificial Sequence
  Synthetic Peptide
SSLPFQNI

SEQ ID NO: 2634 - protein, 8 aa, Artificial Sequence
  Synthetic Peptide
MNIQFTAV

SEQ ID NO: 2635 - protein, 8 aa, Artificial Sequence
  Synthetic Peptide
MNYYWTLL

SEQ ID NO: 2636 - protein, 8 aa, Artificial Sequence
  Synthetic Peptide
KSSFYRNL

SEQ ID NO: 2637 - protein, 8 aa, Artificial Sequence
  Synthetic Peptide
SIIPSGPL

SEQ ID NO: 2638 - protein, 8 aa, Artificial Sequence
  Synthetic Peptide
LSYSAGAL

SEQ ID NO: 2639 - protein, 8 aa, Artificial Sequence
  Synthetic Peptide
LSYSAGAL

SEQ ID NO: 2640 - protein, 8 aa, Artificial Sequence
  Synthetic Peptide
SSISFCGV

SEQ ID NO: 2641 - protein, 9 aa, Artificial Sequence
  Synthetic Peptide
TGICNQNII

SEQ ID NO: 2642 - protein, 9 aa, Artificial Sequence
  Synthetic Peptide
ITYKNSTWV

SEQ ID NO: 2643 - protein, 9 aa, Artificial Sequence
  Synthetic Peptide
FCGVNSDTV

SEQ ID NO: 2644 - protein, 9 aa, Artificial Sequence
  Synthetic Peptide
TGICNQNII

SEQ ID NO: 2645 - protein, 9 aa, Artificial Sequence
  Synthetic Peptide
FCGVNSDTV

SEQ ID NO: 2646 - protein, 9 aa, Artificial Sequence
  Synthetic Peptide
ITYKNSTWV

SEQ ID NO: 2647 - protein, 8 aa, Artificial Sequence
  Synthetic Peptide
SSISFCGV

SEQ ID NO: 2648 - protein, 8 aa, Artificial Sequence
  Synthetic Peptide
IGRFYIQM

SEQ ID NO: 2649 - protein, 8 aa, Artificial Sequence
  Synthetic Peptide
MMIWHSNL

SEQ ID NO: 2650 - protein, 9 aa, Artificial Sequence
  Synthetic Peptide
ASNENMETM

SEQ ID NO: 2651 - protein, 8 aa, Artificial Sequence
  Synthetic Peptide
IGRFYIQM

SEQ ID NO: 2652 - protein, 8 aa, Artificial Sequence
  Synthetic Peptide
MMIWHSNL

SEQ ID NO: 2653 - protein, 8 aa, Artificial Sequence
  Synthetic Peptide
FFYRYGFV

SEQ ID NO: 2654 - protein, 8 aa, Artificial Sequence
  Synthetic Peptide
KMITQRTI

SEQ ID NO: 2655 - protein, 8 aa, Artificial Sequence
  Synthetic Peptide
RSYLIRAL

SEQ ID NO: 2656 - protein, 8 aa, Artificial Sequence
  Synthetic Peptide
RFYRTCKL

SEQ ID NO: 2657 - protein, 9 aa, Artificial Sequence
  Synthetic Peptide
TALANTIEV

SEQ ID NO: 2658 - protein, 9 aa, Artificial Sequence
  Synthetic Peptide
TALANTIEV

SEQ ID NO: 2659 - protein, 8 aa, Artificial Sequence
  Synthetic Peptide
RSYLIRAL

SEQ ID NO: 2660 - protein, 8 aa, Artificial Sequence
  Synthetic Peptide
RFYRTCKL

SEQ ID NO: 2661 - protein, 8 aa, Artificial Sequence
  Synthetic Peptide
VYINTALL

SEQ ID NO: 2662 - protein, 8 aa, Artificial Sequence
  Synthetic Peptide
VYINTALL

SEQ ID NO: 2663 - protein, 8 aa, Artificial Sequence
  Synthetic Peptide
VYIEVLHL

SEQ ID NO: 2664 - protein, 8 aa, Artificial Sequence
  Synthetic Peptide
VYIEVLHL

SEQ ID NO: 2665 - protein, 10 aa, Artificial Sequence
  Synthetic Peptide
WYIPPSLRTL

SEQ ID NO: 2666 - protein, 16 aa, Artificial Sequence
  Synthetic Peptide
MRTAZAKDPEPTIDES

SEQ ID NO: 2667 - protein, 9 aa, Artificial Sequence
  Synthetic Peptide
IYSTVASSL

SEQ ID NO: 2668 - protein, 9 aa, Artificial Sequence
  Synthetic Peptide
LYEKVKSQL

SEQ ID NO: 2669 - protein, 9 aa, Artificial Sequence
  Synthetic Peptide
LYQKVKSQL

SEQ ID NO: 2670 - protein, 9 aa, Artificial Sequence
  Synthetic Peptide
LYEKMKSQL

SEQ ID NO: 2671 - protein, 9 aa, Artificial Sequence
  Synthetic Peptide
LYEKVFSQL

SEQ ID NO: 2672 - protein, 9 aa, Artificial Sequence
  Synthetic Peptide
LYQNVGTYV

SEQ ID NO: 2673 - protein, 8 aa, Artificial Sequence
  Synthetic Peptide
MGLKFRQL

SEQ ID NO: 2674 - protein, 8 aa, Artificial Sequence
  Synthetic Peptide
VSYVNTNM

SEQ ID NO: 2675 - protein, 9 aa, Artificial Sequence
  Synthetic Peptide
SYVNTNMGL

SEQ ID NO: 2676 - protein, 8 aa, Artificial Sequence
  Synthetic Peptide
MGLKFRQL

SEQ ID NO: 2677 - protein, 8 aa, Artificial Sequence
  Synthetic Peptide
VSYVNTNM

SEQ ID NO: 2678 - protein, 9 aa, Artificial Sequence
  Synthetic Peptide
SYVNTNMGL

SEQ ID NO: 2679 - protein, 8 aa, Artificial Sequence
  Synthetic Peptide
WGPSLYSI

SEQ ID NO: 2680 - protein, 8 aa, Artificial Sequence
  Synthetic Peptide
ASARFSWL

SEQ ID NO: 2681 - protein, 9 aa, Artificial Sequence
  Synthetic Peptide
WGPSLYSIL

SEQ ID NO: 2682 - protein, 9 aa, Artificial Sequence
  Synthetic Peptide
TGPCRTCMT

SEQ ID NO: 2683 - protein, 10 aa, Artificial Sequence
  Synthetic Peptide
WYWGPSLYSI

SEQ ID NO: 2684 - protein, 12 aa, Artificial Sequence
  Synthetic Peptide
IPQSLDSWWTSL

SEQ ID NO: 2685 - protein, 12 aa, Artificial Sequence
  Synthetic Peptide
IPQSLDSYWTSL

SEQ ID NO: 2686 - protein, 8 aa, Artificial Sequence
  Synthetic Peptide
ASARFSWL

SEQ ID NO: 2687 - protein, 10 aa, Artificial Sequence
  Synthetic Peptide
WYWGPSLYSI

SEQ ID NO: 2688 - protein, 12 aa, Artificial Sequence
  Synthetic Peptide
APQSLDSWWTSL

SEQ ID NO: 2689 - protein, 12 aa, Artificial Sequence
  Synthetic Peptide
IPQALDSWWTSL

SEQ ID NO: 2690 - protein, 12 aa, Artificial Sequence
  Synthetic Peptide
IPQSLASWWTSL

SEQ ID NO: 2691 - protein, 12 aa, Artificial Sequence
  Synthetic Peptide
IPQSLDAWWTSL

SEQ ID NO: 2692 - protein, 12 aa, Artificial Sequence
  Synthetic Peptide
IPQSLDSAWTSL

SEQ ID NO: 2693 - protein, 12 aa, Artificial Sequence
  Synthetic Peptide
IPQSLDSWWASL

SEQ ID NO: 2694 - protein, 12 aa, Artificial Sequence
  Synthetic Peptide
IPQSLDSWWTAL

SEQ ID NO: 2695 - protein, 12 aa, Artificial Sequence
  Synthetic Peptide
EPQSLDSWWTSL

SEQ ID NO: 2696 - protein, 12 aa, Artificial Sequence
  Synthetic Peptide
IPESLDSWWTSL

SEQ ID NO: 2697 - protein, 12 aa, Artificial Sequence
  Synthetic Peptide
IPQSLDEWWTSL

SEQ ID NO: 2698 - protein, 12 aa, Artificial Sequence
  Synthetic Peptide
IPQSLDSWWTEL

SEQ ID NO: 2699 - protein, 12 aa, Artificial Sequence
  Synthetic Peptide
RPQSLDSWWTSL

SEQ ID NO: 2700 - protein, 12 aa, Artificial Sequence
  Synthetic Peptide
IPRSLDSWWTSL

SEQ ID NO: 2701 - protein, 12 aa, Artificial Sequence
  Synthetic Peptide
IPQRLDSWWTSL

SEQ ID NO: 2702 - protein, 12 aa, Artificial Sequence
  Synthetic Peptide
IPQSRDSWWTSL

SEQ ID NO: 2703 - protein, 12 aa, Artificial Sequence
  Synthetic Peptide
IPQSLRSWWTSL

SEQ ID NO: 2704 - protein, 12 aa, Artificial Sequence
  Synthetic Peptide
IPQSLDRWWTSL

SEQ ID NO: 2705 - protein, 12 aa, Artificial Sequence
  Synthetic Peptide
IPQSLDSRWTSL

SEQ ID NO: 2706 - protein, 12 aa, Artificial Sequence
  Synthetic Peptide
IPQSLDSWWRSL

SEQ ID NO: 2707 - protein, 12 aa, Artificial Sequence
  Synthetic Peptide
IPQSLDSWWTRL

SEQ ID NO: 2708 - protein, 12 aa, Artificial Sequence
  Synthetic Peptide
YPQSLDSWWTSL

SEQ ID NO: 2709 - protein, 12 aa, Artificial Sequence
  Synthetic Peptide
IPYSLDSWWTSL

SEQ ID NO: 2710 - protein, 12 aa, Artificial Sequence
  Synthetic Peptide
IPQYLDSWWTSL

SEQ ID NO: 2711 - protein, 12 aa, Artificial Sequence
  Synthetic Peptide
IPQSLYSWWTSL

SEQ ID NO: 2712 - protein, 12 aa, Artificial Sequence
  Synthetic Peptide
IPQSLDYWWTSL

SEQ ID NO: 2713 - protein, 12 aa, Artificial Sequence
  Synthetic Peptide
IPQSLDSWYTSL

SEQ ID NO: 2714 - protein, 12 aa, Artificial Sequence
  Synthetic Peptide
IPQSLDSWWTYL

SEQ ID NO: 2715 - protein, 12 aa, Artificial Sequence
  Synthetic Peptide
IPGSLDSWWTSL

SEQ ID NO: 2716 - protein, 12 aa, Artificial Sequence
  Synthetic Peptide
IPQSLDSGWTSL

SEQ ID NO: 2717 - protein, 12 aa, Artificial Sequence
  Synthetic Peptide
IPQSLDSPWTSL

SEQ ID NO: 2718 - protein, 12 aa, Artificial Sequence
  Synthetic Peptide
IPQSLDSWGTSL

SEQ ID NO: 2719 - protein, 12 aa, Artificial Sequence
  Synthetic Peptide
IPQSLDSWPTSL

SEQ ID NO: 2720 - protein, 12 aa, Artificial Sequence
  Synthetic Peptide
IPQSLDSWWTGL

SEQ ID NO: 2721 - protein, 12 aa, Artificial Sequence
  Synthetic Peptide
IPQSLDSWWTPL

SEQ ID NO: 2722 - protein, 12 aa, Artificial Sequence
  Synthetic Peptide
IPQVLDSWWTSL

SEQ ID NO: 2723 - protein, 12 aa, Artificial Sequence
  Synthetic Peptide
IPQFLDSWWTSL

SEQ ID NO: 2724 - protein, 12 aa, Artificial Sequence
  Synthetic Peptide
IPQPLDSWWTSL

SEQ ID NO: 2725 - protein, 12 aa, Artificial Sequence
  Synthetic Peptide
IPQMLDSWWTSL

SEQ ID NO: 2726 - protein, 12 aa, Artificial Sequence
  Synthetic Peptide
IPQILDSWWTSL

SEQ ID NO: 2727 - protein, 12 aa, Artificial Sequence
  Synthetic Peptide
IPQLLDSWWTSL

SEQ ID NO: 2728 - protein, 12 aa, Artificial Sequence
  Synthetic Peptide
IPQGLDSWWTSL

SEQ ID NO: 2729 - protein, 12 aa, Artificial Sequence
  Synthetic Peptide
IPQTLDSWWTSL

SEQ ID NO: 2730 - protein, 12 aa, Artificial Sequence
  Synthetic Peptide
IPQHLDSWWTSL

SEQ ID NO: 2731 - protein, 12 aa, Artificial Sequence
  Synthetic Peptide
IPQCLDSWWTSL

SEQ ID NO: 2732 - protein, 12 aa, Artificial Sequence
  Synthetic Peptide
IPQNLDSWWTSL

SEQ ID NO: 2733 - protein, 12 aa, Artificial Sequence
  Synthetic Peptide
IPQQLDSWWTSL

SEQ ID NO: 2734 - protein, 12 aa, Artificial Sequence
  Synthetic Peptide
IPQWLDSWWTSL

SEQ ID NO: 2735 - protein, 12 aa, Artificial Sequence
  Synthetic Peptide
IPQDLDSWWTSL

SEQ ID NO: 2736 - protein, 12 aa, Artificial Sequence
  Synthetic Peptide
IPQKLDSWWTSL

SEQ ID NO: 2737 - protein, 12 aa, Artificial Sequence
  Synthetic Peptide
IPQSLVSWWTSL

SEQ ID NO: 2738 - protein, 12 aa, Artificial Sequence
  Synthetic Peptide
IPQSLFSWWTSL

SEQ ID NO: 2739 - protein, 12 aa, Artificial Sequence
  Synthetic Peptide
IPQSLPSWWTSL

SEQ ID NO: 2740 - protein, 12 aa, Artificial Sequence
  Synthetic Peptide
IPQSLMSWWTSL

SEQ ID NO: 2741 - protein, 12 aa, Artificial Sequence
  Synthetic Peptide
IPQSLISWWTSL

SEQ ID NO: 2742 - protein, 12 aa, Artificial Sequence
  Synthetic Peptide
IPQSLLSWWTSL

SEQ ID NO: 2743 - protein, 12 aa, Artificial Sequence
  Synthetic Peptide
IPQSLGSWWTSL

SEQ ID NO: 2744 - protein, 12 aa, Artificial Sequence
  Synthetic Peptide
IPQSLSSWWTSL

SEQ ID NO: 2745 - protein, 12 aa, Artificial Sequence
  Synthetic Peptide
IPQSLTSWWTSL

SEQ ID NO: 2746 - protein, 12 aa, Artificial Sequence
  Synthetic Peptide
IPQSLHSWWTSL

SEQ ID NO: 2747 - protein, 12 aa, Artificial Sequence
  Synthetic Peptide
IPQSLCSWWTSL

SEQ ID NO: 2748 - protein, 12 aa, Artificial Sequence
  Synthetic Peptide
IPQSLNSWWTSL

SEQ ID NO: 2749 - protein, 12 aa, Artificial Sequence
  Synthetic Peptide
IPQSLQSWWTSL

SEQ ID NO: 2750 - protein, 12 aa, Artificial Sequence
  Synthetic Peptide
IPQSLWSWWTSL

SEQ ID NO: 2751 - protein, 12 aa, Artificial Sequence
  Synthetic Peptide
IPQSLKSWWTSL

SEQ ID NO: 2752 - protein, 11 aa, Artificial Sequence
  Synthetic Peptide
IPSLDSWWTSL

SEQ ID NO: 2753 - protein, 11 aa, Artificial Sequence
  Synthetic Peptide
IPQSLDSWTSL

SEQ ID NO: 2754 - protein, 11 aa, Artificial Sequence
  Synthetic Peptide
IPQSLDSWWTL

SEQ ID NO: 2755 - protein, 12 aa, Artificial Sequence
  Synthetic Peptide
IPQALASWWTSL

SEQ ID NO: 2756 - protein, 12 aa, Artificial Sequence
  Synthetic Peptide
IPQSLDSWWTSM

SEQ ID NO: 2757 - protein, 12 aa, Artificial Sequence
  Synthetic Peptide
IPQSLDSWWTSF

SEQ ID NO: 2758 - protein, 8 aa, Artificial Sequence
  Synthetic Peptide
KTPSFPNI

SEQ ID NO: 2759 - protein, 8 aa, Artificial Sequence
  Synthetic Peptide
HAVEFHNL

SEQ ID NO: 2760 - protein, 8 aa, Artificial Sequence
  Synthetic Peptide
VSAAFYHL

SEQ ID NO: 2761 - protein, 8 aa, Artificial Sequence
  Synthetic Peptide
VIGCYGSL

SEQ ID NO: 2762 - protein, 9 aa, Artificial Sequence
  Synthetic Peptide
KQYLNLYPV

SEQ ID NO: 2763 - protein, 10 aa, Artificial Sequence
  Synthetic Peptide
CYGSLPQEHI

SEQ ID NO: 2764 - protein, 8 aa, Artificial Sequence
  Synthetic Peptide
VSAAFYHL

SEQ ID NO: 2765 - protein, 8 aa, Artificial Sequence
  Synthetic Peptide
HAVEFHNL

SEQ ID NO: 2766 - protein, 8 aa, Artificial Sequence
  Synthetic Peptide
VIGCYGSL

SEQ ID NO: 2767 - protein, 8 aa, Artificial Sequence
  Synthetic Peptide
KTPSFPNI

SEQ ID NO: 2768 - protein, 12 aa, Artificial Sequence
  Synthetic Peptide
RPQSLDSWWTSL

SEQ ID NO: 2769 - protein, 12 aa, Artificial Sequence
  Synthetic Peptide
IPQRLDSWWTSL

SEQ ID NO: 2770 - protein, 12 aa, Artificial Sequence
  Synthetic Peptide
IPQSLRSWWTSL

SEQ ID NO: 2771 - protein, 12 aa, Artificial Sequence
  Synthetic Peptide
IPQSLDRWWTSL

SEQ ID NO: 2772 - protein, 12 aa, Artificial Sequence
  Synthetic Peptide
IPQSLDSRWTSL

SEQ ID NO: 2773 - protein, 12 aa, Artificial Sequence
  Synthetic Peptide
IPQSLDSWWRSL

SEQ ID NO: 2774 - protein, 12 aa, Artificial Sequence
  Synthetic Peptide
IPQSLDSWWTRL

SEQ ID NO: 2775 - protein, 12 aa, Artificial Sequence
  Synthetic Peptide
IPQELDSWWTSL

SEQ ID NO: 2776 - protein, 12 aa, Artificial Sequence
  Synthetic Peptide
IPQSLYSWWTSL

SEQ ID NO: 2777 - protein, 12 aa, Artificial Sequence
  Synthetic Peptide
IPQSLDSWETSL

SEQ ID NO: 2778 - protein, 12 aa, Artificial Sequence
  Synthetic Peptide
IPQSLDSWWESL

SEQ ID NO: 2779 - protein, 8 aa, Artificial Sequence
  Synthetic Peptide
VESENKVV

SEQ ID NO: 2780 - protein, 10 aa, Artificial Sequence
  Synthetic Peptide
AGPYRAFVTI

SEQ ID NO: 2781 - protein, 10 aa, Artificial Sequence
  Synthetic Peptide
RAPYRAFVTI

SEQ ID NO: 2782 - protein, 10 aa, Artificial Sequence
  Synthetic Peptide
RGPYRAFVTA

SEQ ID NO: 2783 - protein, 10 aa, Artificial Sequence
  Synthetic Peptide
KGPYRAFVTI

SEQ ID NO: 2784 - protein, 10 aa, Artificial Sequence
  Synthetic Peptide
RGPYRAFVTK

SEQ ID NO: 2785 - protein, 10 aa, Artificial Sequence
  Synthetic Peptide
RGPGRAFVTI

SEQ ID NO: 2786 - protein, 10 aa, Artificial Sequence
  Synthetic Peptide
RGPGRYFVTI

SEQ ID NO: 2787 - protein, 10 aa, Artificial Sequence
  Synthetic Peptide
RGPGRAYVTI

SEQ ID NO: 2788 - protein, 10 aa, Artificial Sequence
  Synthetic Peptide
RGPGRAFYTI

SEQ ID NO: 2789 - protein, 8 aa, Artificial Sequence
  Synthetic Peptide
VESMNKEL

SEQ ID NO: 2790 - protein, 9 aa, Artificial Sequence
  Synthetic Peptide
TDSQYALGI

SEQ ID NO: 2791 - protein, 10 aa, Artificial Sequence
  Synthetic Peptide
RGAYRAFVTI

SEQ ID NO: 2792 - protein, 10 aa, Artificial Sequence
  Synthetic Peptide
RGPARAFVTI

SEQ ID NO: 2793 - protein, 10 aa, Artificial Sequence
  Synthetic Peptide
RGPYRAAVTI

SEQ ID NO: 2794 - protein, 10 aa, Artificial Sequence
  Synthetic Peptide
RGPYRAFATI

SEQ ID NO: 2795 - protein, 10 aa, Artificial Sequence
  Synthetic Peptide
RGPYRAFVAI

SEQ ID NO: 2796 - protein, 10 aa, Artificial Sequence
  Synthetic Peptide
RGKYRAFVTI

SEQ ID NO: 2797 - protein, 10 aa, Artificial Sequence
  Synthetic Peptide
RGPFRAFVTI

SEQ ID NO: 2798 - protein, 10 aa, Artificial Sequence
  Synthetic Peptide
RGPYKAFVTI

SEQ ID NO: 2799 - protein, 10 aa, Artificial Sequence
  Synthetic Peptide
RGPYRKFVTI

SEQ ID NO: 2800 - protein, 10 aa, Artificial Sequence
  Synthetic Peptide
RGPYRAYVTI

SEQ ID NO: 2801 - protein, 10 aa, Artificial Sequence
  Synthetic Peptide
RGPYRAFKTI

SEQ ID NO: 2802 - protein, 10 aa, Artificial Sequence
  Synthetic Peptide
RGPYRAFVKI

SEQ ID NO: 2803 - protein, 9 aa, Artificial Sequence
  Synthetic Peptide
NEILIRCII

SEQ ID NO: 2804 - protein, 9 aa, Artificial Sequence
  Synthetic Peptide
QEKKRHVDL

SEQ ID NO: 2805 - protein, 9 aa, Artificial Sequence
  Synthetic Peptide
LFVVYRDSI

SEQ ID NO: 2806 - protein, 10 aa, Artificial Sequence
  Synthetic Peptide
FYSRIRELRF

SEQ ID NO: 2807 - protein, 8 aa, Artificial Sequence
  Synthetic Peptide
SSIEFARL

SEQ ID NO: 2808 - protein, 9 aa, Artificial Sequence
  Synthetic Peptide
KVPRNQDWL

SEQ ID NO: 2809 - protein, 8 aa, Artificial Sequence
  Synthetic Peptide
VYDFYVWM

SEQ ID NO: 2810 - protein, 8 aa, Artificial Sequence
  Synthetic Peptide
KNKFFSYL

SEQ ID NO: 2811 - protein, 8 aa, Artificial Sequence
  Synthetic Peptide
LAVLYCLL

SEQ ID NO: 2812 - protein, 8 aa, Artificial Sequence
  Synthetic Peptide
YMVPFIPL

SEQ ID NO: 2813 - protein, 10 aa, Artificial Sequence
  Synthetic Peptide
GQMNNGSTPM

SEQ ID NO: 2814 - protein, 8 aa, Artificial Sequence
  Synthetic Peptide
IVTMFEAL

SEQ ID NO: 2815 - protein, 8 aa, Artificial Sequence
  Synthetic Peptide
ISHNFCNL

SEQ ID NO: 2816 - protein, 8 aa, Artificial Sequence
  Synthetic Peptide
GVYQFKSV

SEQ ID NO: 2817 - protein, 10 aa, Artificial Sequence
  Synthetic Peptide
HYISMGTSGL

SEQ ID NO: 2818 - protein, 11 aa, Artificial Sequence
  Synthetic Peptide
SGVENPGGYCL

SEQ ID NO: 2819 - protein, 9 aa, Artificial Sequence
  Synthetic Peptide
KAVYNFATM

SEQ ID NO: 2820 - protein, 10 aa, Artificial Sequence
  Synthetic Peptide
CMANNSHHYI

SEQ ID NO: 2821 - protein, 10 aa, Artificial Sequence
  Synthetic Peptide
CSANNSHHYM

SEQ ID NO: 2822 - protein, 11 aa, Artificial Sequence
  Synthetic Peptide
SMVENPGGYCL

SEQ ID NO: 2823 - protein, 11 aa, Artificial Sequence
  Synthetic Peptide
SGVENPGGYCM

SEQ ID NO: 2824 - protein, 9 aa, Artificial Sequence
  Synthetic Peptide
KAVYNFATM

SEQ ID NO: 2825 - protein, 9 aa, Artificial Sequence
  Synthetic Peptide
KAVYNAATM

SEQ ID NO: 2826 - protein, 9 aa, Artificial Sequence
  Synthetic Peptide
KAVANFATM

SEQ ID NO: 2827 - protein, 9 aa, Artificial Sequence
  Synthetic Peptide
KAVYNYATM

SEQ ID NO: 2828 - protein, 9 aa, Artificial Sequence
  Synthetic Peptide
KAVYNFAAM

SEQ ID NO: 2829 - protein, 8 aa, Artificial Sequence
  Synthetic Peptide
YTVKYPNL

SEQ ID NO: 2830 - protein, 9 aa, Artificial Sequence
  Synthetic Peptide
FQPQNGQFI

SEQ ID NO: 2831 - protein, 9 aa, Artificial Sequence
  Synthetic Peptide
VGLSYSQTM

SEQ ID NO: 2832 - protein, 9 aa, Artificial Sequence
  Synthetic Peptide
FQPQNGQFI

SEQ ID NO: 2833 - protein, 12 aa, Artificial Sequence
  Synthetic Peptide
FQPQNGQFIHFY

SEQ ID NO: 2834 - protein, 9 aa, Artificial Sequence
  Synthetic Peptide
RPQASGVYM

SEQ ID NO: 2835 - protein, 9 aa, Artificial Sequence
  Synthetic Peptide
RPQASQVYM

SEQ ID NO: 2836 - protein, 8 aa, Artificial Sequence
  Synthetic Peptide
YTYKYPNL

SEQ ID NO: 2837 - protein, 9 aa, Artificial Sequence
  Synthetic Peptide
RPQASGVYM

SEQ ID NO: 2838 - protein, 9 aa, Artificial Sequence
  Synthetic Peptide
RPQASGVAM

SEQ ID NO: 2839 - protein, 9 aa, Artificial Sequence
  Synthetic Peptide
RPQGSGVYM

SEQ ID NO: 2840 - protein, 9 aa, Artificial Sequence
  Synthetic Peptide
RPNASGVYM

SEQ ID NO: 2841 - protein, 11 aa, Artificial Sequence
  Synthetic Peptide
KAVYNFATCGI

SEQ ID NO: 2842 - protein, 9 aa, Artificial Sequence
  Synthetic Peptide
KAVYNFATB

SEQ ID NO: 2843 - protein, 9 aa, Artificial Sequence
  Synthetic Peptide
VYAKECTGL

SEQ ID NO: 2844 - protein, 9 aa, Artificial Sequence
  Synthetic Peptide
YPHFMPTNL

SEQ ID NO: 2845 - protein, 9 aa, Artificial Sequence
  Synthetic Peptide
YPHYMPTNL

SEQ ID NO: 2846 - protein, 8 aa, Artificial Sequence
  Synthetic Peptide
HETTYNSI

SEQ ID NO: 2847 - protein, 8 aa, Artificial Sequence
  Synthetic Peptide
YEDTGKTI

SEQ ID NO: 2848 - protein, 8 aa, Artificial Sequence
  Synthetic Peptide
LGYDYSYL

SEQ ID NO: 2849 - protein, 9 aa, Artificial Sequence
  Synthetic Peptide
SSMHNALHI

SEQ ID NO: 2850 - protein, 9 aa, Artificial Sequence
  Synthetic Peptide
ANFSFRNTL

SEQ ID NO: 2851 - protein, 9 aa, Artificial Sequence
  Synthetic Peptide
SYLTLAKHT

SEQ ID NO: 2852 - protein, 9 aa, Artificial Sequence
  Synthetic Peptide
HYYVSRDTL

SEQ ID NO: 2853 - protein, 9 aa, Artificial Sequence
  Synthetic Peptide
YYVSRDTLL

SEQ ID NO: 2854 - protein, 9 aa, Artificial Sequence
  Synthetic Peptide
SFFSSWQII

SEQ ID NO: 2855 - protein, 9 aa, Artificial Sequence
  Synthetic Peptide
SYMVPFIPL

SEQ ID NO: 2856 - protein, 9 aa, Artificial Sequence
  Synthetic Peptide
PYLEQASRI

SEQ ID NO: 2857 - protein, 10 aa, Artificial Sequence
  Synthetic Peptide
SYLTLAKHTI

SEQ ID NO: 2858 - protein, 10 aa, Artificial Sequence
  Synthetic Peptide
HYYVSRDTLL

SEQ ID NO: 2859 - protein, 9 aa, Artificial Sequence
  Synthetic Peptide
SQVMNLHNL

SEQ ID NO: 2860 - protein, 9 aa, Artificial Sequence
  Synthetic Peptide
YENDIEKKI

SEQ ID NO: 2861 - protein, 9 aa, Artificial Sequence
  Synthetic Peptide
NEEPSDKHI

SEQ ID NO: 2862 - protein, 9 aa, Artificial Sequence
  Synthetic Peptide
EEKHEKKHV

SEQ ID NO: 2863 - protein, 10 aa, Artificial Sequence
  Synthetic Peptide
SYVPSAEQIL

SEQ ID NO: 2864 - protein, 10 aa, Artificial Sequence
  Synthetic Peptide
RYLENGKETL

SEQ ID NO: 2865 - protein, 10 aa, Artificial Sequence
  Synthetic Peptide
RYLKNGKETL

SEQ ID NO: 2866 - protein, 9 aa, Artificial Sequence
  Synthetic Peptide
IYTQNRRAL

SEQ ID NO: 2867 - protein, 8 aa, Artificial Sequence
  Synthetic Peptide
VYDFFVWM

SEQ ID NO: 2868 - protein, 9 aa, Artificial Sequence
  Synthetic Peptide
SVYDFFVWL

SEQ ID NO: 2869 - protein, 9 aa, Artificial Sequence
  Synthetic Peptide
SVYDFYVWM

SEQ ID NO: 2870 - protein, 9 aa, Artificial Sequence
  Synthetic Peptide
ASNENMDAM

SEQ ID NO: 2871 - protein, 9 aa, Artificial Sequence
  Synthetic Peptide
FAPGYNPAL

SEQ ID NO: 2872 - protein, 10 aa, Artificial Sequence
  Synthetic Peptide
SIQFFGERAL

SEQ ID NO: 2873 - protein, 8 aa, Artificial Sequence
  Synthetic Peptide
SIQFFGEL

SEQ ID NO: 2874 - protein, 8 aa, Artificial Sequence
  Synthetic Peptide
RGYVYQGL

SEQ ID NO: 2875 - protein, 8 aa, Artificial Sequence
  Synthetic Peptide
RGPRLNTL

SEQ ID NO: 2876 - protein, 8 aa, Artificial Sequence
  Synthetic Peptide
HMWNFIGV

SEQ ID NO: 2877 - protein, 9 aa, Artificial Sequence
  Synthetic Peptide
GGAYRLIVF

SEQ ID NO: 2878 - protein, 10 aa, Artificial Sequence
  Synthetic Peptide
KYLVTRHADV

SEQ ID NO: 2879 - protein, 9 aa, Artificial Sequence
  Synthetic Peptide
FSPRRNGYL

SEQ ID NO: 2880 - protein, 8 aa, Artificial Sequence
  Synthetic Peptide
SHYAFSPM

SEQ ID NO: 2881 - protein, 9 aa, Artificial Sequence
  Synthetic Peptide
FQPQNGQFI

SEQ ID NO: 2882 - protein, 10 aa, Artificial Sequence
  Synthetic Peptide
SGPSNTPPEI

SEQ ID NO: 2883 - protein, 8 aa, Artificial Sequence
  Synthetic Peptide
RNPRFYNL

SEQ ID NO: 2884 - protein, 9 aa, Artificial Sequence
  Synthetic Peptide
QPQRGYENF

SEQ ID NO: 2885 - protein, 9 aa, Artificial Sequence
  Synthetic Peptide
SEAAYAKKI

SEQ ID NO: 2886 - protein, 9 aa, Artificial Sequence
  Synthetic Peptide
AYAPAKAAI

SEQ ID NO: 2887 - protein, 9 aa, Artificial Sequence
  Synthetic Peptide
AYAEAKAAI

SEQ ID NO: 2888 - protein, 9 aa, Artificial Sequence
  Synthetic Peptide
AYANAKAAI

SEQ ID NO: 2889 - protein, 9 aa, Artificial Sequence
  Synthetic Peptide
AYAGAKAAI

SEQ ID NO: 2890 - protein, 9 aa, Artificial Sequence
  Synthetic Peptide
AYAVAKAAI

SEQ ID NO: 2891 - protein, 8 aa, Artificial Sequence
  Synthetic Peptide
AAAAYAAM

SEQ ID NO: 2892 - protein, 10 aa, Artificial Sequence
  Synthetic Peptide
AAAAYAAAAM

SEQ ID NO: 2893 - protein, 9 aa, Artificial Sequence
  Synthetic Peptide
AAAANAAAM

SEQ ID NO: 2894 - protein, 11 aa, Artificial Sequence
  Synthetic Peptide
AAAAAANAAAM

SEQ ID NO: 2895 - protein, 8 aa, Artificial Sequence
  Synthetic Peptide
NAIVFKGL

SEQ ID NO: 2896 - protein, 8 aa, Artificial Sequence
  Synthetic Peptide
SIINFEKL

SEQ ID NO: 2897 - protein, 8 aa, Artificial Sequence
  Synthetic Peptide
IFYCPIAI

SEQ ID NO: 2898 - protein, 8 aa, Artificial Sequence
  Synthetic Peptide
KVVRFDKL

SEQ ID NO: 2899 - protein, 10 aa, Artificial Sequence
  Synthetic Peptide
VYSFSLASRL

SEQ ID NO: 2900 - protein, 8 aa, Artificial Sequence
  Synthetic Peptide
SIINFEKL

SEQ ID NO: 2901 - protein, 8 aa, Artificial Sequence
  Synthetic Peptide
KVVRFDKL

SEQ ID NO: 2902 - protein, 9 aa, Artificial Sequence
  Synthetic Peptide
SENDRYRLL

SEQ ID NO: 2903 - protein, 9 aa, Artificial Sequence
  Synthetic Peptide
SFYRNLLWL

SEQ ID NO: 2904 - protein, 8 aa, Artificial Sequence
  Synthetic Peptide
YEANGNLI

SEQ ID NO: 2905 - protein, 8 aa, Artificial Sequence
  Synthetic Peptide
MGLIYNRM

SEQ ID NO: 2906 - protein, 8 aa, Artificial Sequence
  Synthetic Peptide
MGYIYNRM

SEQ ID NO: 2907 - protein, 8 aa, Artificial Sequence
  Synthetic Peptide
MGIIYNRM

SEQ ID NO: 2908 - protein, 8 aa, Artificial Sequence
  Synthetic Peptide
MGLIFNRM

SEQ ID NO: 2909 - protein, 8 aa, Artificial Sequence
  Synthetic Peptide
MGLIYNRM

SEQ ID NO: 2910 - protein, 9 aa, Artificial Sequence
  Synthetic Peptide
RMIQNSLTI

SEQ ID NO: 2911 - protein, 9 aa, Artificial Sequence
  Synthetic Peptide
RLIQNFLTI

SEQ ID NO: 2912 - protein, 9 aa, Artificial Sequence
  Synthetic Peptide
GMRQNATEI

SEQ ID NO: 2913 - protein, 9 aa, Artificial Sequence
  Synthetic Peptide
YMRVNGKWM

SEQ ID NO: 2914 - protein, 9 aa, Artificial Sequence
  Synthetic Peptide
FYIQMATEL

SEQ ID NO: 2915 - protein, 9 aa, Artificial Sequence
  Synthetic Peptide
FYIQMCTFL

SEQ ID NO: 2916 - protein, 9 aa, Artificial Sequence
  Synthetic Peptide
AYERMANIL

SEQ ID NO: 2917 - protein, 9 aa, Artificial Sequence
  Synthetic Peptide
AYQRMCNIL

SEQ ID NO: 2918 - protein, 9 aa, Artificial Sequence
  Synthetic Peptide
AYERMCTIL

SEQ ID NO: 2919 - protein, 9 aa, Artificial Sequence
  Synthetic Peptide
ASNENMETM

SEQ ID NO: 2920 - protein, 9 aa, Artificial Sequence
  Synthetic Peptide
TYQRTRALM

SEQ ID NO: 2921 - protein, 9 aa, Artificial Sequence
  Synthetic Peptide
TYQKTRALV

SEQ ID NO: 2922 - protein, 9 aa, Artificial Sequence
  Synthetic Peptide
TYQPTRALV

SEQ ID NO: 2923 - protein, 9 aa, Artificial Sequence
  Synthetic Peptide
TYQFTRALV

SEQ ID NO: 2924 - protein, 9 aa, Artificial Sequence
  Synthetic Peptide
TYQLTRALV

SEQ ID NO: 2925 - protein, 8 aa, Artificial Sequence
  Synthetic Peptide
SDYEGRLI

SEQ ID NO: 2926 - protein, 8 aa, Artificial Sequence
  Synthetic Peptide
MITQFESL

SEQ ID NO: 2927 - protein, 8 aa, Artificial Sequence
  Synthetic Peptide
RTFSFQLI

SEQ ID NO: 2928 - protein, 8 aa, Artificial Sequence
  Synthetic Peptide
FSVIFDRL

SEQ ID NO: 2929 - protein, 8 aa, Artificial Sequence
  Synthetic Peptide
RTFSFQLI

SEQ ID NO: 2930 - protein, 8 aa, Artificial Sequence
  Synthetic Peptide
MITQFESL

SEQ ID NO: 2931 - protein, 8 aa, Artificial Sequence
  Synthetic Peptide
FSVIFDRL

SEQ ID NO: 2932 - protein, 8 aa, Artificial Sequence
  Synthetic Peptide
KDDFYRNL

SEQ ID NO: 2933 - protein, 8 aa, Artificial Sequence
  Synthetic Peptide
SSLPFQNI

SEQ ID NO: 2934 - protein, 8 aa, Artificial Sequence
  Synthetic Peptide
MNIQFTAV

SEQ ID NO: 2935 - protein, 8 aa, Artificial Sequence
  Synthetic Peptide
MNYYWTLL

SEQ ID NO: 2936 - protein, 9 aa, Artificial Sequence
  Synthetic Peptide
SFYRNLLWL

SEQ ID NO: 2937 - protein, 8 aa, Artificial Sequence
  Synthetic Peptide
SSLPFQNI

SEQ ID NO: 2938 - protein, 9 aa, Artificial Sequence
  Synthetic Peptide
NMNIQFTAV

SEQ ID NO: 2939 - protein, 8 aa, Artificial Sequence
  Synthetic Peptide
MNYYWTLL

SEQ ID NO: 2940 - protein, 8 aa, Artificial Sequence
  Synthetic Peptide
KSSFYRNL

SEQ ID NO: 2941 - protein, 8 aa, Artificial Sequence
  Synthetic Peptide
SIIPSGPL

SEQ ID NO: 2942 - protein, 8 aa, Artificial Sequence
  Synthetic Peptide
LSYSAGAL

SEQ ID NO: 2943 - protein, 8 aa, Artificial Sequence
  Synthetic Peptide
LSYSAGAL

SEQ ID NO: 2944 - protein, 8 aa, Artificial Sequence
  Synthetic Peptide
SSISFCGV

SEQ ID NO: 2945 - protein, 9 aa, Artificial Sequence
  Synthetic Peptide
TGICNQNII

SEQ ID NO: 2946 - protein, 9 aa, Artificial Sequence
  Synthetic Peptide
ITYKNSTWV

SEQ ID NO: 2947 - protein, 9 aa, Artificial Sequence
  Synthetic Peptide
FCGVNSDTV

SEQ ID NO: 2948 - protein, 9 aa, Artificial Sequence
  Synthetic Peptide
TGICNQNII

SEQ ID NO: 2949 - protein, 9 aa, Artificial Sequence
  Synthetic Peptide
FCGVNSDTV

SEQ ID NO: 2950 - protein, 9 aa, Artificial Sequence
  Synthetic Peptide
ITYKNSTWV

SEQ ID NO: 2951 - protein, 8 aa, Artificial Sequence
  Synthetic Peptide
SSISFCGV

SEQ ID NO: 2952 - protein, 8 aa, Artificial Sequence
  Synthetic Peptide
IGRFYIQM

SEQ ID NO: 2953 - protein, 8 aa, Artificial Sequence
  Synthetic Peptide
MMIWHSNL

SEQ ID NO: 2954 - protein, 9 aa, Artificial Sequence
  Synthetic Peptide
ASNENMETM

SEQ ID NO: 2955 - protein, 8 aa, Artificial Sequence
  Synthetic Peptide
IGRFYIQM

SEQ ID NO: 2956 - protein, 8 aa, Artificial Sequence
  Synthetic Peptide
MMIWHSNL

SEQ ID NO: 2957 - protein, 8 aa, Artificial Sequence
  Synthetic Peptide
FFYRYGFV

SEQ ID NO: 2958 - protein, 8 aa, Artificial Sequence
  Synthetic Peptide
KMITQRTI

SEQ ID NO: 2959 - protein, 8 aa, Artificial Sequence
  Synthetic Peptide
RSYLIRAL

SEQ ID NO: 2960 - protein, 8 aa, Artificial Sequence
  Synthetic Peptide
RFYRTCKL

SEQ ID NO: 2961 - protein, 8 aa, Artificial Sequence
  Synthetic Peptide
VYINTALL

SEQ ID NO: 2962 - protein, 8 aa, Artificial Sequence
  Synthetic Peptide
VYINTALL

SEQ ID NO: 2963 - protein, 8 aa, Artificial Sequence
  Synthetic Peptide
VYIEVLHL

SEQ ID NO: 2964 - protein, 8 aa, Artificial Sequence
  Synthetic Peptide
VYIEVLHL

SEQ ID NO: 2965 - protein, 10 aa, Artificial Sequence
  Synthetic Peptide
WYIPPSLRTL

SEQ ID NO: 2966 - protein, 8 aa, Artificial Sequence
  Synthetic Peptide
MRTAZAKD

SEQ ID NO: 2967 - protein, 9 aa, Artificial Sequence
  Synthetic Peptide
IYSTVASSL

SEQ ID NO: 2968 - protein, 9 aa, Artificial Sequence
  Synthetic Peptide
LYEKVKSQL

SEQ ID NO: 2969 - protein, 9 aa, Artificial Sequence
  Synthetic Peptide
LYQKVKSQL

SEQ ID NO: 2970 - protein, 9 aa, Artificial Sequence
  Synthetic Peptide
LYEKMKSQL

SEQ ID NO: 2971 - protein, 9 aa, Artificial Sequence
  Synthetic Peptide
LYEKVFSQL

SEQ ID NO: 2972 - protein, 9 aa, Artificial Sequence
  Synthetic Peptide
LYQNVGTYV

SEQ ID NO: 2973 - protein, 8 aa, Artificial Sequence
  Synthetic Peptide
MGLKFRQL

SEQ ID NO: 2974 - protein, 8 aa, Artificial Sequence
  Synthetic Peptide
VSYVNTNM

SEQ ID NO: 2975 - protein, 9 aa, Artificial Sequence
  Synthetic Peptide
SYVNTNMGL

SEQ ID NO: 2976 - protein, 8 aa, Artificial Sequence
  Synthetic Peptide
MGLKFRQL

SEQ ID NO: 2977 - protein, 8 aa, Artificial Sequence
  Synthetic Peptide
VSYVNTNM

SEQ ID NO: 2978 - protein, 9 aa, Artificial Sequence
  Synthetic Peptide
SYVNTNMGL

SEQ ID NO: 2979 - protein, 8 aa, Artificial Sequence
  Synthetic Peptide
WGPSLYSI

SEQ ID NO: 2980 - protein, 8 aa, Artificial Sequence
  Synthetic Peptide
ASARFSWL

SEQ ID NO: 2981 - protein, 9 aa, Artificial Sequence
  Synthetic Peptide
WGPSLYSIL

SEQ ID NO: 2982 - protein, 9 aa, Artificial Sequence
  Synthetic Peptide
TGPCRTCMT

SEQ ID NO: 2983 - protein, 10 aa, Artificial Sequence
  Synthetic Peptide
WYWGPSLYSI

SEQ ID NO: 2984 - protein, 12 aa, Artificial Sequence
  Synthetic Peptide
IPQSLDSWWTSL

SEQ ID NO: 2985 - protein, 12 aa, Artificial Sequence
  Synthetic Peptide
IPQSLDSYWTSL

SEQ ID NO: 2986 - protein, 8 aa, Artificial Sequence
  Synthetic Peptide
ADARFSWL

SEQ ID NO: 2987 - protein, 10 aa, Artificial Sequence
  Synthetic Peptide
WYWGPSLYSI

SEQ ID NO: 2988 - protein, 12 aa, Artificial Sequence
  Synthetic Peptide
APQSLDSWWTSL

SEQ ID NO: 2989 - protein, 12 aa, Artificial Sequence
  Synthetic Peptide
IPQALDSWWTSL

SEQ ID NO: 2990 - protein, 12 aa, Artificial Sequence
  Synthetic Peptide
IPQSLASWWTSL

SEQ ID NO: 2991 - protein, 12 aa, Artificial Sequence
  Synthetic Peptide
IPQSLDAWWTSL

SEQ ID NO: 2992 - protein, 12 aa, Artificial Sequence
  Synthetic Peptide
IPQSLDSAWTSL

SEQ ID NO: 2993 - protein, 12 aa, Artificial Sequence
  Synthetic Peptide
IPQSLDSWWASL

SEQ ID NO: 2994 - protein, 12 aa, Artificial Sequence
  Synthetic Peptide
IPQSLDSWWTAL

SEQ ID NO: 2995 - protein, 12 aa, Artificial Sequence
  Synthetic Peptide
EPQSLDSWWTSL

SEQ ID NO: 2996 - protein, 12 aa, Artificial Sequence
  Synthetic Peptide
IPESLDSWWTSL

SEQ ID NO: 2997 - protein, 12 aa, Artificial Sequence
  Synthetic Peptide
IPQSLDEWWTSL

SEQ ID NO: 2998 - protein, 12 aa, Artificial Sequence
  Synthetic Peptide
IPQSLDSWWTEL

SEQ ID NO: 2999 - protein, 12 aa, Artificial Sequence
  Synthetic Peptide
RPQSLDSWWTSL

SEQ ID NO: 3000 - protein, 12 aa, Artificial Sequence
  Synthetic Peptide
IPRSLDSWWTSL

SEQ ID NO: 3001 - protein, 12 aa, Artificial Sequence
  Synthetic Peptide
IPQRLDSWWTSL

SEQ ID NO: 3002 - protein, 12 aa, Artificial Sequence
  Synthetic Peptide
IPQSRDSWWTSL

SEQ ID NO: 3003 - protein, 12 aa, Artificial Sequence
  Synthetic Peptide
IPQSLRSWWTSL

SEQ ID NO: 3004 - protein, 12 aa, Artificial Sequence
  Synthetic Peptide
IPQSLDRWWTSL

SEQ ID NO: 3005 - protein, 12 aa, Artificial Sequence
  Synthetic Peptide
IPQSLDSRWTSL

SEQ ID NO: 3006 - protein, 12 aa, Artificial Sequence
  Synthetic Peptide
IPQSLDSWWRSL

SEQ ID NO: 3007 - protein, 12 aa, Artificial Sequence
  Synthetic Peptide
IPQSLDSWWTRL

SEQ ID NO: 3008 - protein, 12 aa, Artificial Sequence
  Synthetic Peptide
YPQSLDSWWTSL

SEQ ID NO: 3009 - protein, 12 aa, Artificial Sequence
  Synthetic Peptide
IPYSLDSWWTSL

SEQ ID NO: 3010 - protein, 12 aa, Artificial Sequence
  Synthetic Peptide
IPQYLDSWWTSL

SEQ ID NO: 3011 - protein, 12 aa, Artificial Sequence
  Synthetic Peptide
IPQSLYSWWTSL

SEQ ID NO: 3012 - protein, 12 aa, Artificial Sequence
  Synthetic Peptide
IPQSLDYWWTSL

SEQ ID NO: 3013 - protein, 12 aa, Artificial Sequence
  Synthetic Peptide
IPQSLDSWYTSL

SEQ ID NO: 3014 - protein, 12 aa, Artificial Sequence
  Synthetic Peptide
IPQSLDSWWTYL

SEQ ID NO: 3015 - protein, 12 aa, Artificial Sequence
  Synthetic Peptide
IPGSLDSWWTSL

SEQ ID NO: 3016 - protein, 12 aa, Artificial Sequence
  Synthetic Peptide
IPQSLDSGWTSL

SEQ ID NO: 3017 - protein, 12 aa, Artificial Sequence
  Synthetic Peptide
IPQSLDSPWTSL

SEQ ID NO: 3018 - protein, 12 aa, Artificial Sequence
  Synthetic Peptide
IPQSLDSWGTSL

SEQ ID NO: 3019 - protein, 12 aa, Artificial Sequence
  Synthetic Peptide
IPQSLDSWPTSL

SEQ ID NO: 3020 - protein, 13 aa, Artificial Sequence
  Synthetic Peptide
IPQSLDSWSWTGL

SEQ ID NO: 3021 - protein, 12 aa, Artificial Sequence
  Synthetic Peptide
IPQSLDSWWTPL

SEQ ID NO: 3022 - protein, 12 aa, Artificial Sequence
  Synthetic Peptide
IPQVLDSWWTSL

SEQ ID NO: 3023 - protein, 12 aa, Artificial Sequence
  Synthetic Peptide
IPQFLDSWWTSL

SEQ ID NO: 3024 - protein, 6 aa, Artificial Sequence
  Synthetic Peptide
DSWWTS

SEQ ID NO: 3025 - protein, 12 aa, Artificial Sequence
  Synthetic Peptide
IPQMLDSWWTSL

SEQ ID NO: 3026 - protein, 12 aa, Artificial Sequence
  Synthetic Peptide
IPQILDSWWTSL

SEQ ID NO: 3027 - protein, 12 aa, Artificial Sequence
  Synthetic Peptide
IPQLLDSWWTSL

SEQ ID NO: 3028 - protein, 12 aa, Artificial Sequence
  Synthetic Peptide
IPQGLDSWWTSL

SEQ ID NO: 3029 - protein, 12 aa, Artificial Sequence
  Synthetic Peptide
IPQTLDSWWTSL

SEQ ID NO: 3030 - protein, 12 aa, Artificial Sequence
  Synthetic Peptide
IPQHLDSWWTSL

SEQ ID NO: 3031 - protein, 12 aa, Artificial Sequence
  Synthetic Peptide
IPQCLDSWWTSL

SEQ ID NO: 3032 - protein, 12 aa, Artificial Sequence
  Synthetic Peptide
IPQNLDSWWTSL

SEQ ID NO: 3033 - protein, 12 aa, Artificial Sequence
  Synthetic Peptide
IPQQLDSWWTSL

SEQ ID NO: 3034 - protein, 12 aa, Artificial Sequence
  Synthetic Peptide
IPQWLDSWWTSL

SEQ ID NO: 3035 - protein, 12 aa, Artificial Sequence
  Synthetic Peptide
IPQDLDSWWTSL

SEQ ID NO: 3036 - protein, 12 aa, Artificial Sequence
  Synthetic Peptide
IPQKLDSWWTSL

SEQ ID NO: 3037 - protein, 11 aa, Artificial Sequence
  Synthetic Peptide
IPQSLSWWTSL

SEQ ID NO: 3038 - protein, 12 aa, Artificial Sequence
  Synthetic Peptide
IPQSLFSWWTSL

SEQ ID NO: 3039 - protein, 12 aa, Artificial Sequence
  Synthetic Peptide
IPQSLPSWWTSL

SEQ ID NO: 3040 - protein, 12 aa, Artificial Sequence
  Synthetic Peptide
IPQSLMSWWTSL

SEQ ID NO: 3041 - protein, 12 aa, Artificial Sequence
  Synthetic Peptide
IPQSLISWWTSL

SEQ ID NO: 3042 - protein, 12 aa, Artificial Sequence
  Synthetic Peptide
IPQSLLSWWTSL

SEQ ID NO: 3043 - protein, 12 aa, Artificial Sequence
  Synthetic Peptide
IPQSLGSWWTSL

SEQ ID NO: 3044 - protein, 12 aa, Artificial Sequence
  Synthetic Peptide
IPQSLSSWWTSL

SEQ ID NO: 3045 - protein, 12 aa, Artificial Sequence
  Synthetic Peptide
IPQSLTSWWTSL

SEQ ID NO: 3046 - protein, 12 aa, Artificial Sequence
  Synthetic Peptide
IPQSLHSWWTSL

SEQ ID NO: 3047 - protein, 12 aa, Artificial Sequence
  Synthetic Peptide
IPQSLCSWWTSL

SEQ ID NO: 3048 - protein, 12 aa, Artificial Sequence
  Synthetic Peptide
IPQSLNSWWTSL

SEQ ID NO: 3049 - protein, 12 aa, Artificial Sequence
  Synthetic Peptide
IPQSLQSWWTSL

SEQ ID NO: 3050 - protein, 12 aa, Artificial Sequence
  Synthetic Peptide
IPQSLWSWWTSL

SEQ ID NO: 3051 - protein, 12 aa, Artificial Sequence
  Synthetic Peptide
IPQSLKSWWTSL

SEQ ID NO: 3052 - protein, 11 aa, Artificial Sequence
  Synthetic Peptide
IPSLDSWWTSL

SEQ ID NO: 3053 - protein, 11 aa, Artificial Sequence
  Synthetic Peptide
IPQSLDSWTSL

SEQ ID NO: 3054 - protein, 11 aa, Artificial Sequence
  Synthetic Peptide
IPQSLDSWWTL

SEQ ID NO: 3055 - protein, 12 aa, Artificial Sequence
  Synthetic Peptide
IPQALASWWTSL

SEQ ID NO: 3056 - protein, 12 aa, Artificial Sequence
  Synthetic Peptide
IPQSLDSWWTSM

SEQ ID NO: 3057 - protein, 12 aa, Artificial Sequence
  Synthetic Peptide
IPQSLDSWWTSF

SEQ ID NO: 3058 - protein, 8 aa, Artificial Sequence
  Synthetic Peptide
KTPSFPNI

SEQ ID NO: 3059 - protein, 8 aa, Artificial Sequence
  Synthetic Peptide
HAVEFHNL

SEQ ID NO: 3060 - protein, 8 aa, Artificial Sequence
  Synthetic Peptide
VSAAFYHL

SEQ ID NO: 3061 - protein, 8 aa, Artificial Sequence
  Synthetic Peptide
VIGCYGSL

SEQ ID NO: 3062 - protein, 9 aa, Artificial Sequence
  Synthetic Peptide
KQYLNLYPV

SEQ ID NO: 3063 - protein, 10 aa, Artificial Sequence
  Synthetic Peptide
CYGSLPQEHI

SEQ ID NO: 3064 - protein, 8 aa, Artificial Sequence
  Synthetic Peptide
VSAAFYHL

SEQ ID NO: 3065 - protein, 8 aa, Artificial Sequence
  Synthetic Peptide
HAVEFHNL

SEQ ID NO: 3066 - protein, 8 aa, Artificial Sequence
  Synthetic Peptide
VIGCYGSL

SEQ ID NO: 3067 - protein, 8 aa, Artificial Sequence
  Synthetic Peptide
KTPSFPNI

SEQ ID NO: 3068 - protein, 12 aa, Artificial Sequence
  Synthetic Peptide
RPQSLDSWWTSL

SEQ ID NO: 3069 - protein, 12 aa, Artificial Sequence
  Synthetic Peptide
IPQRLDSWWTSL

SEQ ID NO: 3070 - protein, 12 aa, Artificial Sequence
  Synthetic Peptide
IPQSLRSWWTSL

SEQ ID NO: 3071 - protein, 12 aa, Artificial Sequence
  Synthetic Peptide
IPQSLDRWWTSL

SEQ ID NO: 3072 - protein, 12 aa, Artificial Sequence
  Synthetic Peptide
IPQSLDSRWTSL

SEQ ID NO: 3073 - protein, 12 aa, Artificial Sequence
  Synthetic Peptide
IPQSLDSWWRSL

SEQ ID NO: 3074 - protein, 12 aa, Artificial Sequence
  Synthetic Peptide
IPQSLDSWWTRL

SEQ ID NO: 3075 - protein, 12 aa, Artificial Sequence
  Synthetic Peptide
IPQELDSWWTSL

SEQ ID NO: 3076 - protein, 11 aa, Artificial Sequence
  Synthetic Peptide
IPQSLYWWTSL

SEQ ID NO: 3077 - protein, 12 aa, Artificial Sequence
  Synthetic Peptide
IPQSLDSWETSL

SEQ ID NO: 3078 - protein, 12 aa, Artificial Sequence
  Synthetic Peptide
IPQSLDSWWESL

SEQ ID NO: 3079 - protein, 8 aa, Artificial Sequence
  Synthetic Peptide
VESENKVV

SEQ ID NO: 3080 - protein, 10 aa, Artificial Sequence
  Synthetic Peptide
AGPYRAFVTI

SEQ ID NO: 3081 - protein, 10 aa, Artificial Sequence
  Synthetic Peptide
RAPYRAFVTI

SEQ ID NO: 3082 - protein, 10 aa, Artificial Sequence
  Synthetic Peptide
RGPYRAFVTA

SEQ ID NO: 3083 - protein, 10 aa, Artificial Sequence
  Synthetic Peptide
KGPYRAFVTI

SEQ ID NO: 3084 - protein, 10 aa, Artificial Sequence
  Synthetic Peptide
RGPYRAFVTK

SEQ ID NO: 3085 - protein, 10 aa, Artificial Sequence
  Synthetic Peptide
RGPGRAFVTI

SEQ ID NO: 3086 - protein, 10 aa, Artificial Sequence
  Synthetic Peptide
RGPGRYFVTI

SEQ ID NO: 3087 - protein, 10 aa, Artificial Sequence
  Synthetic Peptide
RGPGRAYVTI

SEQ ID NO: 3088 - protein, 10 aa, Artificial Sequence
  Synthetic Peptide
RGPGRAFYTI

SEQ ID NO: 3089 - protein, 8 aa, Artificial Sequence
  Synthetic Peptide
VESMNKEL

SEQ ID NO: 3090 - protein, 9 aa, Artificial Sequence
  Synthetic Peptide
TDSQYALGI

SEQ ID NO: 3091 - protein, 10 aa, Artificial Sequence
  Synthetic Peptide
RGAYRAFVTI

SEQ ID NO: 3092 - protein, 10 aa, Artificial Sequence
  Synthetic Peptide
RGPARAFVTI

SEQ ID NO: 3093 - protein, 10 aa, Artificial Sequence
  Synthetic Peptide
RGPYRAAVTI

SEQ ID NO: 3094 - protein, 10 aa, Artificial Sequence
  Synthetic Peptide
RGPYRAFATI

SEQ ID NO: 3095 - protein, 10 aa, Artificial Sequence
  Synthetic Peptide
RGPYRAFVAI

SEQ ID NO: 3096 - protein, 10 aa, Artificial Sequence
  Synthetic Peptide
RGKYRAFVTI

SEQ ID NO: 3097 - protein, 10 aa, Artificial Sequence
  Synthetic Peptide
RGPFRAFVTI

SEQ ID NO: 3098 - protein, 10 aa, Artificial Sequence
  Synthetic Peptide
RGPYKAFVTI

SEQ ID NO: 3099 - protein, 10 aa, Artificial Sequence
  Synthetic Peptide
RGPYRKFVTI

SEQ ID NO: 3100 - protein, 10 aa, Artificial Sequence
  Synthetic Peptide
RGPYRAYVTI

SEQ ID NO: 3101 - protein, 10 aa, Artificial Sequence
  Synthetic Peptide
RGPYRAFKTI

SEQ ID NO: 3102 - protein, 10 aa, Artificial Sequence
  Synthetic Peptide
RGPYRAFVKI

SEQ ID NO: 3103 - protein, 9 aa, Artificial Sequence
  Synthetic Peptide
NEILIRCII

SEQ ID NO: 3104 - protein, 9 aa, Artificial Sequence
  Synthetic Peptide
QEKKRHVDL

SEQ ID NO: 3105 - protein, 9 aa, Artificial Sequence
  Synthetic Peptide
LFVVYRDSK

SEQ ID NO: 3106 - protein, 10 aa, Artificial Sequence
  Synthetic Peptide
FYSRIRELRF

SEQ ID NO: 3107 - protein, 8 aa, Artificial Sequence
  Synthetic Peptide
SSIEFARL

SEQ ID NO: 3108 - protein, 9 aa, Artificial Sequence
  Synthetic Peptide
KVPRNQDWL

SEQ ID NO: 3109 - protein, 8 aa, Artificial Sequence
  Synthetic Peptide
VYDFYVWM

SEQ ID NO: 3110 - protein, 8 aa, Artificial Sequence
  Synthetic Peptide
KNKFFSYL

SEQ ID NO: 3111 - protein, 8 aa, Artificial Sequence
  Synthetic Peptide
LAVLYCLL

SEQ ID NO: 3112 - protein, 8 aa, Artificial Sequence
  Synthetic Peptide
YMVPFIPL

SEQ ID NO: 3113 - protein, 10 aa, Artificial Sequence
  Synthetic Peptide
CQMNNGSTPM

SEQ ID NO: 3114 - protein, 8 aa, Artificial Sequence
  Synthetic Peptide
IVTMFEAL

SEQ ID NO: 3115 - protein, 8 aa, Artificial Sequence
  Synthetic Peptide
ISHNFCNL

SEQ ID NO: 3116 - protein, 8 aa, Artificial Sequence
  Synthetic Peptide
GVYQFKSF

SEQ ID NO: 3117 - protein, 9 aa, Artificial Sequence
  Synthetic Peptide
HYIMGTSGL

SEQ ID NO: 3118 - protein, 11 aa, Artificial Sequence
  Synthetic Peptide
SGVENPGGYCL

SEQ ID NO: 3119 - protein, 9 aa, Artificial Sequence
  Synthetic Peptide
KAVYNFATM

SEQ ID NO: 3120 - protein, 10 aa, Artificial Sequence
  Synthetic Peptide
CMANNSHHYI

SEQ ID NO: 3121 - protein, 10 aa, Artificial Sequence
  Synthetic Peptide
CSANNSHHYM

SEQ ID NO: 3122 - protein, 11 aa, Artificial Sequence
  Synthetic Peptide
SMVENPGGYCL

SEQ ID NO: 3123 - protein, 11 aa, Artificial Sequence
  Synthetic Peptide
SGVENPGGYCM

SEQ ID NO: 3124 - protein, 9 aa, Artificial Sequence
  Synthetic Peptide
KAVYNFATM

SEQ ID NO: 3125 - protein, 9 aa, Artificial Sequence
  Synthetic Peptide
KAVYNAATM

SEQ ID NO: 3126 - protein, 9 aa, Artificial Sequence
  Synthetic Peptide
KAVANFATM

SEQ ID NO: 3127 - protein, 9 aa, Artificial Sequence
  Synthetic Peptide
KAVYNYATM

SEQ ID NO: 3128 - protein, 9 aa, Artificial Sequence
  Synthetic Peptide
KAVYNFAAM

SEQ ID NO: 3129 - protein, 8 aa, Artificial Sequence
  Synthetic Peptide
YTVKYPNL

SEQ ID NO: 3130 - protein, 9 aa, Artificial Sequence
  Synthetic Peptide
FQPQNGQFI

SEQ ID NO: 3131 - protein, 9 aa, Artificial Sequence
  Synthetic Peptide
VGLSYSQTM

SEQ ID NO: 3132 - protein, 9 aa, Artificial Sequence
  Synthetic Peptide
FQPQNGQFI

SEQ ID NO: 3133 - protein, 12 aa, Artificial Sequence
  Synthetic Peptide
TQPQNGQFIHFY

SEQ ID NO: 3134 - protein, 9 aa, Artificial Sequence
  Synthetic Peptide
RPQASGVYM

SEQ ID NO: 3135 - protein, 9 aa, Artificial Sequence
  Synthetic Peptide
RPQASQVYM

SEQ ID NO: 3136 - protein, 8 aa, Artificial Sequence
  Synthetic Peptide
YTYKYPNL

SEQ ID NO: 3137 - protein, 9 aa, Artificial Sequence
  Synthetic Peptide
RPQASGVYM

SEQ ID NO: 3138 - protein, 9 aa, Artificial Sequence
  Synthetic Peptide
RPQASGVAM

SEQ ID NO: 3139 - protein, 9 aa, Artificial Sequence
  Synthetic Peptide
TPQGSGVYM

SEQ ID NO: 3140 - protein, 9 aa, Artificial Sequence
  Synthetic Peptide
RPNASGVYM

SEQ ID NO: 3141 - protein, 11 aa, Artificial Sequence
  Synthetic Peptide
KAVYNFATCGI

SEQ ID NO: 3142 - protein, 9 aa, Artificial Sequence
  Synthetic Peptide
KAVYNFATB

SEQ ID NO: 3143 - protein, 9 aa, Artificial Sequence
  Synthetic Peptide
VYAKECTGL

SEQ ID NO: 3144 - protein, 9 aa, Artificial Sequence
  Synthetic Peptide
YPHFMPTNL

SEQ ID NO: 3145 - protein, 9 aa, Artificial Sequence
  Synthetic Peptide
YPHYMPTNL

SEQ ID NO: 3146 - protein, 8 aa, Artificial Sequence
  Synthetic Peptide
HETTYNSI

SEQ ID NO: 3147 - protein, 8 aa, Artificial Sequence
  Synthetic Peptide
YEDTGKTI

SEQ ID NO: 3148 - protein, 8 aa, Artificial Sequence
  Synthetic Peptide
LGYDYSYL

SEQ ID NO: 3149 - protein, 9 aa, Artificial Sequence
  Synthetic Peptide
SSMHNALHI

SEQ ID NO: 3150 - protein, 9 aa, Artificial Sequence
  Synthetic Peptide
NAFSFRNTL

SEQ ID NO: 3151 - protein, 9 aa, Artificial Sequence
  Synthetic Peptide
SYLTLAKHT

SEQ ID NO: 3152 - protein, 9 aa, Artificial Sequence
  Synthetic Peptide
HYYVSRDTL

SEQ ID NO: 3153 - protein, 9 aa, Artificial Sequence
  Synthetic Peptide
YYVSRDTLL

SEQ ID NO: 3154 - protein, 9 aa, Artificial Sequence
  Synthetic Peptide
SFFSSWQII

SEQ ID NO: 3155 - protein, 9 aa, Artificial Sequence
  Synthetic Peptide
SYMVPFIPL

SEQ ID NO: 3156 - protein, 9 aa, Artificial Sequence
  Synthetic Peptide
PYLEQASRI

SEQ ID NO: 3157 - protein, 10 aa, Artificial Sequence
  Synthetic Peptide
SYLTLAKHTI

SEQ ID NO: 3158 - protein, 10 aa, Artificial Sequence
  Synthetic Peptide
HYYVSRDTLL

SEQ ID NO: 3159 - protein, 9 aa, Artificial Sequence
  Synthetic Peptide
SQVMNLHNL

SEQ ID NO: 3160 - protein, 9 aa, Artificial Sequence
  Synthetic Peptide
YENDIEKKI

SEQ ID NO: 3161 - protein, 9 aa, Artificial Sequence
  Synthetic Peptide
NEEPSDKHI

SEQ ID NO: 3162 - protein, 9 aa, Artificial Sequence
  Synthetic Peptide
EEKHEKKHV

SEQ ID NO: 3163 - protein, 10 aa, Artificial Sequence
  Synthetic Peptide
SYVPSAEQIL

SEQ ID NO: 3164 - protein, 10 aa, Artificial Sequence
  Synthetic Peptide
RYLENGKETL

SEQ ID NO: 3165 - protein, 10 aa, Artificial Sequence
  Synthetic Peptide
RYLKNGKETL

SEQ ID NO: 3166 - protein, 9 aa, Artificial Sequence
  Synthetic Peptide
IYTQNRRAL

SEQ ID NO: 3167 - protein, 8 aa, Artificial Sequence
  Synthetic Peptide
VVDFFVWM

SEQ ID NO: 3168 - protein, 9 aa, Artificial Sequence
  Synthetic Peptide
SVYDEFVWL

SEQ ID NO: 3169 - protein, 9 aa, Artificial Sequence
  Synthetic Peptide
SVYDFYVWM

SEQ ID NO: 3170 - protein, 9 aa, Artificial Sequence
  Synthetic Peptide
ASNENMDAM

SEQ ID NO: 3171 - protein, 9 aa, Artificial Sequence
  Synthetic Peptide
FAPGYNPAL

SEQ ID NO: 3172 - protein, 10 aa, Artificial Sequence
  Synthetic Peptide
SIQFFGERAL

SEQ ID NO: 3173 - protein, 8 aa, Artificial Sequence
  Synthetic Peptide
SIQFFGEL

SEQ ID NO: 3174 - protein, 8 aa, Artificial Sequence
  Synthetic Peptide
RGYVYQGL

SEQ ID NO: 3175 - protein, 8 aa, Artificial Sequence
  Synthetic Peptide
RGPRLNTL

SEQ ID NO: 3176 - protein, 8 aa, Artificial Sequence
  Synthetic Peptide
HMWNFIGV

SEQ ID NO: 3177 - protein, 9 aa, Artificial Sequence
  Synthetic Peptide
GGAYRLIVF

SEQ ID NO: 3178 - protein, 10 aa, Artificial Sequence
  Synthetic Peptide
KYLVTRHADV

SEQ ID NO: 3179 - protein, 9 aa, Artificial Sequence
  Synthetic Peptide
FSPRRNGYL

SEQ ID NO: 3180 - protein, 8 aa, Artificial Sequence
  Synthetic Peptide
SHYAFSPM

SEQ ID NO: 3181 - protein, 9 aa, Artificial Sequence
  Synthetic Peptide
FQPQNGQFI

SEQ ID NO: 3182 - protein, 9 aa, Artificial Sequence
  Synthetic Peptide
FPFKYAAAF

SEQ ID NO: 3183 - protein, 9 aa, Artificial Sequence
  Synthetic Peptide
YPKVKQWPL

SEQ ID NO: 3184 - protein, 11 aa, Artificial Sequence
  Synthetic Peptide
CILESCFRAVI

SEQ ID NO: 3185 - protein, 9 aa, Artificial Sequence
  Synthetic Peptide
YPAEITLYW

SEQ ID NO: 3186 - protein, 9 aa, Artificial Sequence
  Synthetic Peptide
FAMPNFQTL

SEQ ID NO: 3187 - protein, 9 aa, Artificial Sequence
  Synthetic Peptide
FAMPNFYTL

SEQ ID NO: 3188 - protein, 9 aa, Artificial Sequence
  Synthetic Peptide
QPDDAVYKL

SEQ ID NO: 3189 - protein, 9 aa, Artificial Sequence
  Synthetic Peptide
IPYPIVRKL

SEQ ID NO: 3190 - protein, 9 aa, Artificial Sequence
  Synthetic Peptide
IPYPIVRSL

SEQ ID NO: 3191 - protein, 9 aa, Artificial Sequence
  Synthetic Peptide
IPFPIVRYL

SEQ ID NO: 3192 - protein, 9 aa, Artificial Sequence
  Synthetic Peptide
RYRPGTVAL

SEQ ID NO: 3193 - protein, 9 aa, Artificial Sequence
  Synthetic Peptide
MPRGVVVTL

SEQ ID NO: 3194 - protein, 10 aa, Artificial Sequence
  Synthetic Peptide
LPENNVLSPL

SEQ ID NO: 3195 - protein, 10 aa, Artificial Sequence
  Synthetic Peptide
APAPAPSWPL

SEQ ID NO: 3196 - protein, 11 aa, Artificial Sequence
  Synthetic Peptide
SPALNKMFCQL

SEQ ID NO: 3197 - protein, 9 aa, Artificial Sequence
  Synthetic Peptide
GTRVRAMAI

SEQ ID NO: 3198 - protein, 9 aa, Artificial Sequence
  Synthetic Peptide
RPILTIITL

SEQ ID NO: 3199 - protein, 10 aa, Artificial Sequence
  Synthetic Peptide
LPPGSTKRAL

SEQ ID NO: 3200 - protein, 9 aa, Artificial Sequence
  Synthetic Peptide
SPQPKKKPL

SEQ ID NO: 3201 - protein, 10 aa, Artificial Sequence
  Synthetic Peptide
KPLDGEYFTL

SEQ ID NO: 3202 - protein, 9 aa, Artificial Sequence
  Synthetic Peptide
GSRAHSSHL

SEQ ID NO: 3203 - protein, 9 aa, Artificial Sequence
  Synthetic Peptide
EADPTGHSY

SEQ ID NO: 3204 - protein, 9 aa, Artificial Sequence
  Synthetic Peptide
WLSLLVPFV

SEQ ID NO: 3205 - protein, 10 aa, Artificial Sequence
  Synthetic Peptide
FLPSDFFPSV

SEQ ID NO: 3206 - protein, 9 aa, Artificial Sequence
  Synthetic Peptide
ILKEPVHGV

SEQ ID NO: 3207 - protein, 9 aa, Artificial Sequence
  Synthetic Peptide
GILGFVFTL

SEQ ID NO: 3208 - protein, 9 aa, Artificial Sequence
  Synthetic Peptide
LLGRNSFEV

SEQ ID NO: 3209 - protein, 11 aa, Artificial Sequence
  Synthetic Peptide
RLRDLLLIVTR

SEQ ID NO: 3210 - protein, 10 aa, Artificial Sequence
  Synthetic Peptide
QVPLRPMTYK

SEQ ID NO: 3211 - protein, 9 aa, Artificial Sequence
  Synthetic Peptide
AVDLSHFLK

SEQ ID NO: 3212 - protein, 9 aa, Artificial Sequence
  Synthetic Peptide
IVTDFSVIK

SEQ ID NO: 3213 - protein, 11 aa, Artificial Sequence
  Synthetic Peptide
STLPETTVVRR

SEQ ID NO: 3214 - protein, 9 aa, Artificial Sequence
  Synthetic Peptide
ELRSRYWAI

SEQ ID NO: 3215 - protein, 9 aa, Artificial Sequence
  Synthetic Peptide
FLRGRAYGI

SEQ ID NO: 3216 - protein, 9 aa, Artificial Sequence
  Synthetic Peptide
GEIYKRWII

SEQ ID NO: 3217 - protein, 9 aa, Artificial Sequence
  Synthetic Peptide
DCKTILKAL

SEQ ID NO: 3218 - protein, 9 aa, Artificial Sequence
  Synthetic Peptide
DPKVKQWPL

SEQ ID NO: 3219 - protein, 9 aa, Artificial Sequence
  Synthetic Peptide
YLKDQQLYL

SEQ ID NO: 3220 - protein, 9 aa, Artificial Sequence
  Synthetic Peptide
GGKKKYKLK

SEQ ID NO: 3221 - protein, 8 aa, Artificial Sequence
  Synthetic Peptide
YLKDQQLL

SEQ ID NO: 3222 - protein, 9 aa, Artificial Sequence
  Synthetic Peptide
SRYWAIRTR

SEQ ID NO: 3223 - protein, 10 aa, Artificial Sequence
  Synthetic Peptide
KRWIILGLNK

SEQ ID NO: 3224 - protein, 9 aa, Artificial Sequence
  Synthetic Peptide
TPYDINQML

SEQ ID NO: 3225 - protein, 9 aa, Artificial Sequence
  Synthetic Peptide
KPIVQYDNF

SEQ ID NO: 3226 - protein, 9 aa, Artificial Sequence
  Synthetic Peptide
YPAEITLTW

SEQ ID NO: 3227 - protein, 9 aa, Artificial Sequence
  Synthetic Peptide
RVMAPRALL

SEQ ID NO: 3228 - protein, 9 aa, Artificial Sequence
  Synthetic Peptide
RPKSNIVLL

SEQ ID NO: 3229 - protein, 11 aa, Artificial Sequence
  Synthetic Peptide
AASKERGSVSL

SEQ ID NO: 3230 - protein, 9 aa, Artificial Sequence
  Synthetic Peptide
APRTLVYLL

SEQ ID NO: 3231 - protein, 9 aa, Artificial Sequence
  Synthetic Peptide
APRTVALTA

SEQ ID NO: 3232 - protein, 10 aa, Artificial Sequence
  Synthetic Peptide
APRTVALTAL

SEQ ID NO: 3233 - protein, 9 aa, Artificial Sequence
  Synthetic Peptide
APRASRPSL

SEQ ID NO: 3234 - protein, 9 aa, Artificial Sequence
  Synthetic Peptide
LVMAPRTVL

SEQ ID NO: 3235 - protein, 9 aa, Artificial Sequence
  Synthetic Peptide
RRYQKSTEL

SEQ ID NO: 3236 - protein, 9 aa, Artificial Sequence
  Synthetic Peptide
KRYEGLTQR

SEQ ID NO: 3237 - protein, 9 aa, Artificial Sequence
  Synthetic Peptide
ARLYGIRAK

SEQ ID NO: 3238 - protein, 9 aa, Artificial Sequence
  Synthetic Peptide
FRYNGLIHR

SEQ ID NO: 3239 - protein, 9 aa, Artificial Sequence
  Synthetic Peptide
SPRTLNAWI

SEQ ID NO: 3240 - protein, 9 aa, Artificial Sequence
  Synthetic Peptide
KPCVKLTPI

SEQ ID NO: 3241 - protein, 9 aa, Artificial Sequence
  Synthetic Peptide
SPAIFQSSI

SEQ ID NO: 3242 - protein, 10 aa, Artificial Sequence
  Synthetic Peptide
LPQGWKGSPI

SEQ ID NO: 3243 - protein, 9 aa, Artificial Sequence
  Synthetic Peptide
HPVHAGPIA

SEQ ID NO: 3244 - protein, 9 aa, Artificial Sequence
  Synthetic Peptide
HPVHAGPII

SEQ ID NO: 3245 - protein, 9 aa, Artificial Sequence
  Synthetic Peptide
PPVVHGCPL

SEQ ID NO: 3246 - protein, 10 aa, Artificial Sequence
  Synthetic Peptide
KPTLHGPTPI

SEQ ID NO: 3247 - protein, 10 aa, Artificial Sequence
  Synthetic Peptide
APTLWARMII

SEQ ID NO: 3248 - protein, 10 aa, Artificial Sequence
  Synthetic Peptide
LPRRGPRLGI

SEQ ID NO: 3249 - protein, 9 aa, Artificial Sequence
  Synthetic Peptide
SPGQRVEFI

SEQ ID NO: 3250 - protein, 9 aa, Artificial Sequence
  Synthetic Peptide
LPGCSFSII

SEQ ID NO: 3251 - protein, 10 aa, Artificial Sequence
  Synthetic Peptide
SPGALVVGVI

SEQ ID NO: 3252 - protein, 10 aa, Artificial Sequence
  Synthetic Peptide
TPLLYRLGAI

SEQ ID NO: 3253 - protein, 9 aa, Artificial Sequence
  Synthetic Peptide
APAAPTPAA

SEQ ID NO: 3254 - protein, 10 aa, Artificial Sequence
  Synthetic Peptide
APAPAAPTPA

SEQ ID NO: 3255 - protein, 10 aa, Artificial Sequence
  Synthetic Peptide
APSWPLSSSV

SEQ ID NO: 3256 - protein, 9 aa, Artificial Sequence
  Synthetic Peptide
FPWDILFPA

SEQ ID NO: 3257 - protein, 8 aa, Artificial Sequence
  Synthetic Peptide
IPWQRLLL

SEQ ID NO: 3258 - protein, 8 aa, Artificial Sequence
  Synthetic Peptide
RPGVNLSL

SEQ ID NO: 3259 - protein, 8 aa, Artificial Sequence
  Synthetic Peptide
SPGGLREL

SEQ ID NO: 3260 - protein, 8 aa, Artificial Sequence
  Synthetic Peptide
WPDSLPDL

SEQ ID NO: 3261 - protein, 8 aa, Artificial Sequence
  Synthetic Peptide
IPVAIKVL

SEQ ID NO: 3262 - protein, 8 aa, Artificial Sequence
  Synthetic Peptide
SPYVSRLL

SEQ ID NO: 3263 - protein, 8 aa, Artificial Sequence
  Synthetic Peptide
VPIKWMAL

SEQ ID NO: 3264 - protein, 8 aa, Artificial Sequence
  Synthetic Peptide
SPKANKEI

SEQ ID NO: 3265 - protein, 8 aa, Artificial Sequence
  Synthetic Peptide
RPRFRELV

SEQ ID NO: 3266 - protein, 8 aa, Artificial Sequence
  Synthetic Peptide
SPGKNGVV

SEQ ID NO: 3267 - protein, 8 aa, Artificial Sequence
  Synthetic Peptide
VPISHLYI

SEQ ID NO: 3268 - protein, 8 aa, Artificial Sequence
  Synthetic Peptide
MPKTGLLI

SEQ ID NO: 3269 - protein, 8 aa, Artificial Sequence
  Synthetic Peptide
MPKAGLLI

SEQ ID NO: 3270 - protein, 8 aa, Artificial Sequence
  Synthetic Peptide
APAPSWPL

SEQ ID NO: 3271 - protein, 9 aa, Artificial Sequence
  Synthetic Peptide
GPLPAARPI

SEQ ID NO: 3272 - protein, 9 aa, Artificial Sequence
  Synthetic Peptide
LPTNASLSI

SEQ ID NO: 3273 - protein, 9 aa, Artificial Sequence
  Synthetic Peptide
SPAFDNLYI

SEQ ID NO: 3274 - protein, 9 aa, Artificial Sequence
  Synthetic Peptide
SPKANKEII

SEQ ID NO: 3275 - protein, 9 aa, Artificial Sequence
  Synthetic Peptide
SPLTSIISI

SEQ ID NO: 3276 - protein, 9 aa, Artificial Sequence
  Synthetic Peptide
SPREGPLPI

SEQ ID NO: 3277 - protein, 9 aa, Artificial Sequence
  Synthetic Peptide
GPHISYPPI

SEQ ID NO: 3278 - protein, 9 aa, Artificial Sequence
  Synthetic Peptide
RPILTIITI

SEQ ID NO: 3279 - protein, 9 aa, Artificial Sequence
  Synthetic Peptide
SPQPKKKPI

SEQ ID NO: 3280 - protein, 10 aa, Artificial Sequence
  Synthetic Peptide
GPASPLDSTF

SEQ ID NO: 3281 - protein, 10 aa, Artificial Sequence
  Synthetic Peptide
SPREGPLPAI

SEQ ID NO: 3282 - protein, 10 aa, Artificial Sequence
  Synthetic Peptide
VPISHLYILI

SEQ ID NO: 3283 - protein, 10 aa, Artificial Sequence
  Synthetic Peptide
MPKAGLLIII

SEQ ID NO: 3284 - protein, 10 aa, Artificial Sequence
  Synthetic Peptide
APAPAPSWPI

SEQ ID NO: 3285 - protein, 11 aa, Artificial Sequence
  Synthetic Peptide
SPLDSTFYRSL

SEQ ID NO: 3286 - protein, 11 aa, Artificial Sequence
  Synthetic Peptide
LPAARPAGATL

SEQ ID NO: 3287 - protein, 11 aa, Artificial Sequence
  Synthetic Peptide
KPYDGIPAREI

SEQ ID NO: 3288 - protein, 11 aa, Artificial Sequence
  Synthetic Peptide
SPLTSIISAVV

SEQ ID NO: 3289 - protein, 11 aa, Artificial Sequence
  Synthetic Peptide
CPSGVKPDLSY

SEQ ID NO: 3290 - protein, 11 aa, Artificial Sequence
  Synthetic Peptide
GPRALIETSYV

SEQ ID NO: 3291 - protein, 11 aa, Artificial Sequence
  Synthetic Peptide
MPKAGLLIIVL

SEQ ID NO: 3292 - protein, 11 aa, Artificial Sequence
  Synthetic Peptide
GPRALVETSYV

SEQ ID NO: 3293 - protein, 11 aa, Artificial Sequence
  Synthetic Peptide
APRMPEAAPPV

SEQ ID NO: 3294 - protein, 11 aa, Artificial Sequence
  Synthetic Peptide
SPALNKMFBQI

SEQ ID NO: 3295 - protein, 9 aa, Artificial Sequence
  Synthetic Peptide
MPNDPNRNV

SEQ ID NO: 3296 - protein, 10 aa, Artificial Sequence
  Synthetic Peptide
NPDPNANPNV

SEQ ID NO: 3297 - protein, 10 aa, Artificial Sequence
  Synthetic Peptide
EPSDKHIKEY

SEQ ID NO: 3298 - protein, 9 aa, Artificial Sequence
  Synthetic Peptide
IPQSLDSWW

SEQ ID NO: 3299 - protein, 9 aa, Artificial Sequence
  Synthetic Peptide
CPGYRWMCL

SEQ ID NO: 3300 - protein, 9 aa, Artificial Sequence
  Synthetic Peptide
IPIPSSWAF

SEQ ID NO: 3301 - protein, 9 aa, Artificial Sequence
  Synthetic Peptide
TPARVTGGV

SEQ ID NO: 3302 - protein, 9 aa, Artificial Sequence
  Synthetic Peptide
LPIFFCLWV

SEQ ID NO: 3303 - protein, 9 aa, Artificial Sequence
  Synthetic Peptide
WPKFAVPNL

SEQ ID NO: 3304 - protein, 9 aa, Artificial Sequence
  Synthetic Peptide
HPAAMPHLL

SEQ ID NO: 3305 - protein, 9 aa, Artificial Sequence
  Synthetic Peptide
FPHCLAFSY

SEQ ID NO: 3306 - protein, 9 aa, Artificial Sequence
  Synthetic Peptide
DPSRGRLGL

SEQ ID NO: 3307 - protein, 10 aa, Artificial Sequence
  Synthetic Peptide
GPLEEELPRL

SEQ ID NO: 3308 - protein, 10 aa, Artificial Sequence
  Synthetic Peptide
IPWTHKVGNF

SEQ ID NO: 3309 - protein, 10 aa, Artificial Sequence
  Synthetic Peptide
LPLDKGIKPY

SEQ ID NO: 3310 - protein, 10 aa, Artificial Sequence
  Synthetic Peptide
PPNAPILSTL

SEQ ID NO: 3311 - protein, 10 aa, Artificial Sequence
  Synthetic Peptide
GPLLVLQAGF

SEQ ID NO: 3312 - protein, 10 aa, Artificial Sequence
  Synthetic Peptide
VPFVQWFVGL

SEQ ID NO: 3313 - protein, 10 aa, Artificial Sequence
  Synthetic Peptide
TPARVTGGVF

SEQ ID NO: 3314 - protein, 10 aa, Artificial Sequence
  Synthetic Peptide
LPIFFCLWVY

SEQ ID NO: 3315 - protein, 10 aa, Artificial Sequence
  Synthetic Peptide
VPNLQSLTNL

SEQ ID NO: 3316 - protein, 10 aa, Artificial Sequence
  Synthetic Peptide
FPHCLAFSYM

SEQ ID NO: 3317 - protein, 9 aa, Artificial Sequence
  Synthetic Peptide
QPRGRRQPI

SEQ ID NO: 3318 - protein, 9 aa, Artificial Sequence
  Synthetic Peptide
QPGYPWPLY

SEQ ID NO: 3319 - protein, 9 aa, Artificial Sequence
  Synthetic Peptide
WPLYGNEGL

SEQ ID NO: 3320 - protein, 9 aa, Artificial Sequence
  Synthetic Peptide
SPRGSRPSW

SEQ ID NO: 3321 - protein, 9 aa, Artificial Sequence
  Synthetic Peptide
DPRRRSRNL

SEQ ID NO: 3322 - protein, 9 aa, Artificial Sequence
  Synthetic Peptide
LPGCSFSIF

SEQ ID NO: 3323 - protein, 9 aa, Artificial Sequence
  Synthetic Peptide
IPQAVVDMV

SEQ ID NO: 3324 - protein, 9 aa, Artificial Sequence
  Synthetic Peptide
GPWLTPRCM

SEQ ID NO: 3325 - protein, 9 aa, Artificial Sequence
  Synthetic Peptide
YPCTVNFTI

SEQ ID NO: 3326 - protein, 9 aa, Artificial Sequence
  Synthetic Peptide
LPALSTGLI

SEQ ID NO: 3327 - protein, 9 aa, Artificial Sequence
  Synthetic Peptide
HPNIEEVAL

SEQ ID NO: 3328 - protein, 9 aa, Artificial Sequence
  Synthetic Peptide
TPAETTVRL

SEQ ID NO: 3329 - protein, 9 aa, Artificial Sequence
  Synthetic Peptide
APPPSWDQM

SEQ ID NO: 3330 - protein, 9 aa, Artificial Sequence
  Synthetic Peptide
PPPSWDQMW

SEQ ID NO: 3331 - protein, 9 aa, Artificial Sequence
  Synthetic Peptide
GPTPLLYRL

SEQ ID NO: 3332 - protein, 9 aa, Artificial Sequence
  Synthetic Peptide
SPGALVVGV

SEQ ID NO: 3333 - protein, 8 aa, Artificial Sequence
  Synthetic Peptide
GPEGAVQW

SEQ ID NO: 3334 - protein, 9 aa, Artificial Sequence
  Synthetic Peptide
LPCEPEPDV

SEQ ID NO: 3335 - protein, 9 aa, Artificial Sequence
  Synthetic Peptide
EPEPDVAVL

SEQ ID NO: 3336 - protein, 9 aa, Artificial Sequence
  Synthetic Peptide
DPDLSDGSW

SEQ ID NO: 3337 - protein, 9 aa, Artificial Sequence
  Synthetic Peptide
PPHSAKSKF

SEQ ID NO: 3338 - protein, 9 aa, Artificial Sequence
  Synthetic Peptide
SPGQRVEFL

SEQ ID NO: 3339 - protein, 9 aa, Artificial Sequence
  Synthetic Peptide
DPPQPEYDL

SEQ ID NO: 3340 - protein, 9 aa, Artificial Sequence
  Synthetic Peptide
QPEYDLELI

SEQ ID NO: 3341 - protein, 9 aa, Artificial Sequence
  Synthetic Peptide
APTLWARMI

SEQ ID NO: 3342 - protein, 10 aa, Artificial Sequence
  Synthetic Peptide
LPRRGPRLGV

SEQ ID NO: 3343 - protein, 10 aa, Artificial Sequence
  Synthetic Peptide
APLGGAARAL

SEQ ID NO: 3344 - protein, 10 aa, Artificial Sequence
  Synthetic Peptide
LPGCSFSIFL

SEQ ID NO: 3345 - protein, 10 aa, Artificial Sequence
  Synthetic Peptide
IPTTTIRRHV

SEQ ID NO: 3346 - protein, 10 aa, Artificial Sequence
  Synthetic Peptide
YPGHVSGHRM

SEQ ID NO: 3347 - protein, 10 aa, Artificial Sequence
  Synthetic Peptide
VPASQVCGPV

SEQ ID NO: 3348 - protein, 10 aa, Artificial Sequence
  Synthetic Peptide
GPWLTPRCMV

SEQ ID NO: 3349 - protein, 10 aa, Artificial Sequence
  Synthetic Peptide
YPCTVNFTIF

SEQ ID NO: 3350 - protein, 10 aa, Artificial Sequence
  Synthetic Peptide
SPLLLSTTEW

SEQ ID NO: 3351 - protein, 10 aa, Artificial Sequence
  Synthetic Peptide
WPLLLLLLAL

SEQ ID NO: 3352 - protein, 10 aa, Artificial Sequence
  Synthetic Peptide
TPCTCGSSDL

SEQ ID NO: 3353 - protein, 10 aa, Artificial Sequence
  Synthetic Peptide
APAAYAAQGY

SEQ ID NO: 3354 - protein, 10 aa, Artificial Sequence
  Synthetic Peptide
NPSVAATLGF

SEQ ID NO: 3355 - protein, 10 aa, Artificial Sequence
  Synthetic Peptide
RPSGMFDSSV

SEQ ID NO: 3356 - protein, 10 aa, Artificial Sequence
  Synthetic Peptide
LPVCQDHLER

SEQ ID NO: 3357 - protein, 10 aa, Artificial Sequence
  Synthetic Peptide
APPPSWDQMW

SEQ ID NO: 3358 - protein, 10 aa, Artificial Sequence
  Synthetic Peptide
KPTLHGPTPL

SEQ ID NO: 3359 - protein, 10 aa, Artificial Sequence
  Synthetic Peptide
TPLLYRLGAV

SEQ ID NO: 3360 - protein, 10 aa, Artificial Sequence
  Synthetic Peptide
LPGNPAIASL

SEQ ID NO: 3361 - protein, 10 aa, Artificial Sequence
  Synthetic Peptide
NPAIASLMAF

SEQ ID NO: 3362 - protein, 10 aa, Artificial Sequence
  Synthetic Peptide
LPSILDPGAL

SEQ ID NO: 3363 - protein, 10 aa, Artificial Sequence
  Synthetic Peptide
SPGALVVGVV

SEQ ID NO: 3364 - protein, 10 aa, Artificial Sequence
  Synthetic Peptide
GPGEGAVQWM

SEQ ID NO: 3365 - protein, 10 aa, Artificial Sequence
  Synthetic Peptide
VPESDAAARV

SEQ ID NO: 3366 - protein, 10 aa, Artificial Sequence
  Synthetic Peptide
EPDVAVLTSM

SEQ ID NO: 3367 - protein, 10 aa, Artificial Sequence
  Synthetic Peptide
SPGQRVEFLV

SEQ ID NO: 3368 - protein, 10 aa, Artificial Sequence
  Synthetic Peptide
PPGDPPQPEY

SEQ ID NO: 3369 - protein, 10 aa, Artificial Sequence
  Synthetic Peptide
PPQPEYDLEL

SEQ ID NO: 3370 - protein, 10 aa, Artificial Sequence
  Synthetic Peptide
TPVNSWLGNI

SEQ ID NO: 3371 - protein, 10 aa, Artificial Sequence
  Synthetic Peptide
APTLWARMIL

SEQ ID NO: 3372 - protein, 8 aa, Artificial Sequence
  Synthetic Peptide
FPRIWLHL

SEQ ID NO: 3373 - protein, 9 aa, Artificial Sequence
  Synthetic Peptide
SPTRRELQV

SEQ ID NO: 3374 - protein, 9 aa, Artificial Sequence
  Synthetic Peptide
FPVRPQVPL

SEQ ID NO: 3375 - protein, 9 aa, Artificial Sequence
  Synthetic Peptide
RPQVPLRPM

SEQ ID NO: 3376 - protein, 9 aa, Artificial Sequence
  Synthetic Peptide
DPDLADQLI

SEQ ID NO: 3377 - protein, 9 aa, Artificial Sequence
  Synthetic Peptide
LPGRWKPKM

SEQ ID NO: 3378 - protein, 9 aa, Artificial Sequence
  Synthetic Peptide
KPCVKLTPL

SEQ ID NO: 3379 - protein, 9 aa, Artificial Sequence
  Synthetic Peptide
SPRTLNAWV

SEQ ID NO: 3380 - protein, 8 aa, Artificial Sequence
  Synthetic Peptide
PPLPSVKL

SEQ ID NO: 3381 - protein, 9 aa, Artificial Sequence
  Synthetic Peptide
FPISPIETV

SEQ ID NO: 3382 - protein, 9 aa, Artificial Sequence
  Synthetic Peptide
VPVKLKPGM

SEQ ID NO: 3383 - protein, 9 aa, Artificial Sequence
  Synthetic Peptide
KPGMDGPKV

SEQ ID NO: 3384 - protein, 9 aa, Artificial Sequence
  Synthetic Peptide
TPQDLNTML

SEQ ID NO: 3385 - protein, 10 aa, Artificial Sequence
  Synthetic Peptide
GPVKVKQWPL

SEQ ID NO: 3386 - protein, 9 aa, Artificial Sequence
  Synthetic Peptide
TPQDLNTML

SEQ ID NO: 3387 - protein, 9 aa, Artificial Sequence
  Synthetic Peptide
GPKVKQWPL

SEQ ID NO: 3388 - protein, 9 aa, Artificial Sequence
  Synthetic Peptide
NPPIPVGEI

SEQ ID NO: 3389 - protein, 9 aa, Artificial Sequence
  Synthetic Peptide
PPIPVGETY

SEQ ID NO: 3390 - protein, 9 aa, Artificial Sequence
  Synthetic Peptide
GPKEPFRDY

SEQ ID NO: 3391 - protein, 9 aa, Artificial Sequence
  Synthetic Peptide
SPAIFQSSM

SEQ ID NO: 3392 - protein, 9 aa, Artificial Sequence
  Synthetic Peptide
GPAATLEEM

SEQ ID NO: 3393 - protein, 9 aa, Artificial Sequence
  Synthetic Peptide
NPDIVIYQY

SEQ ID NO: 3394 - protein, 9 aa, Artificial Sequence
  Synthetic Peptide
GPGHKARVL

SEQ ID NO: 3395 - protein, 9 aa, Artificial Sequence
  Synthetic Peptide
EPPFLWMGY

SEQ ID NO: 3396 - protein, 9 aa, Artificial Sequence
  Synthetic Peptide
DPEIVMHSF

SEQ ID NO: 3397 - protein, 9 aa, Artificial Sequence
  Synthetic Peptide
LPEKDSWTV

SEQ ID NO: 3398 - protein, 9 aa, Artificial Sequence
  Synthetic Peptide
YPLASLRSL

SEQ ID NO: 3399 - protein, 9 aa, Artificial Sequence
  Synthetic Peptide
APTKAKRRV

SEQ ID NO: 3400 - protein, 9 aa, Artificial Sequence
  Synthetic Peptide
TPPLVKLWY

SEQ ID NO: 3401 - protein, 9 aa, Artificial Sequence
  Synthetic Peptide
EPIVGAETF

SEQ ID NO: 3402 - protein, 9 aa, Artificial Sequence
  Synthetic Peptide
QPDKSESEL

SEQ ID NO: 3403 - protein, 9 aa, Artificial Sequence
  Synthetic Peptide
LPPVVAKEI

SEQ ID NO: 3404 - protein, 9 aa, Artificial Sequence
  Synthetic Peptide
PPVVAKEIV

SEQ ID NO: 3405 - protein, 9 aa, Artificial Sequence
  Synthetic Peptide
VPRRKAKII

SEQ ID NO: 3406 - protein, 10 aa, Artificial Sequence
  Synthetic Peptide
EPVDPRLEPW

SEQ ID NO: 3407 - protein, 10 aa, Artificial Sequence
  Synthetic Peptide
SPTRRELQVW

SEQ ID NO: 3408 - protein, 10 aa, Artificial Sequence
  Synthetic Peptide
LPGRQKPKMI

SEQ ID NO: 3409 - protein, 10 aa, Artificial Sequence
  Synthetic Peptide
TPVNIIGRNL

SEQ ID NO: 3410 - protein, 9 aa, Artificial Sequence
  Synthetic Peptide
KPPLPSVKL

SEQ ID NO: 3411 - protein, 10 aa, Artificial Sequence
  Synthetic Peptide
SPIETVPVKL

SEQ ID NO: 3412 - protein, 10 aa, Artificial Sequence
  Synthetic Peptide
GPENPYNTPV

SEQ ID NO: 3413 - protein, 10 aa, Artificial Sequence
  Synthetic Peptide
NPYNTPVFAI

SEQ ID NO: 3414 - protein, 10 aa, Artificial Sequence
  Synthetic Peptide
NPPIPVGEIY

SEQ ID NO: 3415 - protein, 10 aa, Artificial Sequence
  Synthetic Peptide
IPVGEIYKRW

SEQ ID NO: 3416 - protein, 10 aa, Artificial Sequence
  Synthetic Peptide
VPLDKDFRKY

SEQ ID NO: 3417 - protein, 10 aa, Artificial Sequence
  Synthetic Peptide
GPKEPFRDYV

SEQ ID NO: 3418 - protein, 10 aa, Artificial Sequence
  Synthetic Peptide
EPFRDYVDRF

SEQ ID NO: 3419 - protein, 10 aa, Artificial Sequence
  Synthetic Peptide
TPGIRYQYNV

SEQ ID NO: 3420 - protein, 10 aa, Artificial Sequence
  Synthetic Peptide
EPFRKQNPDI

SEQ ID NO: 3421 - protein, 10 aa, Artificial Sequence
  Synthetic Peptide
GPAATLEEMM

SEQ ID NO: 3422 - protein, 10 aa, Artificial Sequence
  Synthetic Peptide
NPDIVIYQYM

SEQ ID NO: 3423 - protein, 10 aa, Artificial Sequence
  Synthetic Peptide
PPFLWMGYEL

SEQ ID NO: 3424 - protein, 10 aa, Artificial Sequence
  Synthetic Peptide
HPDKWTVQPI

SEQ ID NO: 3425 - protein, 10 aa, Artificial Sequence
  Synthetic Peptide
EPTAPPEESF

SEQ ID NO: 3426 - protein, 10 aa, Artificial Sequence
  Synthetic Peptide
YPLASLRSLF

SEQ ID NO: 3427 - protein, 10 aa, Artificial Sequence
  Synthetic Peptide
APTKAKRRVV

SEQ ID NO: 3428 - protein, 10 aa, Artificial Sequence
  Synthetic Peptide
PPLVKLWYQL

SEQ ID NO: 3429 - protein, 10 aa, Artificial Sequence
  Synthetic Peptide
EPIVGAETFY

SEQ ID NO: 3430 - protein, 10 aa, Artificial Sequence
  Synthetic Peptide
QPDKSESELV

SEQ ID NO: 3431 - protein, 10 aa, Artificial Sequence
  Synthetic Peptide
LPPVVAKEIV

SEQ ID NO: 3432 - protein, 10 aa, Artificial Sequence
  Synthetic Peptide
IPYNPQSQGV

SEQ ID NO: 3433 - protein, 10 aa, Artificial Sequence
  Synthetic Peptide
DPLQKGPAKL

SEQ ID NO: 3434 - protein, 9 aa, Artificial Sequence
  Synthetic Peptide
TPTLHEYML

SEQ ID NO: 3435 - protein, 9 aa, Artificial Sequence
  Synthetic Peptide
DPQERPRKL

SEQ ID NO: 3436 - protein, 9 aa, Artificial Sequence
  Synthetic Peptide
EPDRAHYNI

SEQ ID NO: 3437 - protein, 9 aa, Artificial Sequence
  Synthetic Peptide
CPEEKQRHL

SEQ ID NO: 3438 - protein, 10 aa, Artificial Sequence
  Synthetic Peptide
EPDRAHYNIV

SEQ ID NO: 3439 - protein, 10 aa, Artificial Sequence
  Synthetic Peptide
NPYAVCDKCL

SEQ ID NO: 3440 - protein, 9 aa, Artificial Sequence
  Synthetic Peptide
GPKATLQDI

SEQ ID NO: 3441 - protein, 9 aa, Artificial Sequence
  Synthetic Peptide
DPTRRPYKL

SEQ ID NO: 3442 - protein, 9 aa, Artificial Sequence
  Synthetic Peptide
KPLNPAEKL

SEQ ID NO: 3443 - protein, 9 aa, Artificial Sequence
  Synthetic Peptide
NPAEKLRHL

SEQ ID NO: 3444 - protein, 10 aa, Artificial Sequence
  Synthetic Peptide
GPKATLQDIV

SEQ ID NO: 3445 - protein, 10 aa, Artificial Sequence
  Synthetic Peptide
EPQNEIPVDL

SEQ ID NO: 3446 - protein, 10 aa, Artificial Sequence
  Synthetic Peptide
EPQRHTMLCM

SEQ ID NO: 3447 - protein, 10 aa, Artificial Sequence
  Synthetic Peptide
IPHAACHKCI

SEQ ID NO: 3448 - protein, 9 aa, Artificial Sequence
  Synthetic Peptide
LPSENERGY

SEQ ID NO: 3449 - protein, 9 aa, Artificial Sequence
  Synthetic Peptide
KPIVQYDNF

SEQ ID NO: 3450 - protein, 10 aa, Artificial Sequence
  Synthetic Peptide
LPSENERGYY

SEQ ID NO: 3451 - protein, 9 aa, Artificial Sequence
  Synthetic Peptide
VPISHLYIL

SEQ ID NO: 3452 - protein, 9 aa, Artificial Sequence
  Synthetic Peptide
MPKTGLLII

SEQ ID NO: 3453 - protein, 9 aa, Artificial Sequence
  Synthetic Peptide
DPACYEFLW

SEQ ID NO: 3454 - protein, 9 aa, Artificial Sequence
  Synthetic Peptide
EPHISYPPL

SEQ ID NO: 3455 - protein, 9 aa, Artificial Sequence
  Synthetic Peptide
YPPLHERAL

SEQ ID NO: 3456 - protein, 10 aa, Artificial Sequence
  Synthetic Peptide
VPISHLYILV

SEQ ID NO: 3457 - protein, 10 aa, Artificial Sequence
  Synthetic Peptide
MPKTGLLIIV

SEQ ID NO: 3458 - protein, 10 aa, Artificial Sequence
  Synthetic Peptide
HPRKLLMQDL

SEQ ID NO: 3459 - protein, 10 aa, Artificial Sequence
  Synthetic Peptide
GPRALIETSY

SEQ ID NO: 3460 - protein, 9 aa, Artificial Sequence
  Synthetic Peptide
EPVTKAEML

SEQ ID NO: 3461 - protein, 9 aa, Artificial Sequence
  Synthetic Peptide
VPGSDPACY

SEQ ID NO: 3462 - protein, 10 aa, Artificial Sequence
  Synthetic Peptide
APEEKIWEEL

SEQ ID NO: 3463 - protein, 9 aa, Artificial Sequence
  Synthetic Peptide
LPTTMNYPL

SEQ ID NO: 3464 - protein, 9 aa, Artificial Sequence
  Synthetic Peptide
DPIGHLYIF

SEQ ID NO: 3465 - protein, 9 aa, Artificial Sequence
  Synthetic Peptide
MPKAGLLII

SEQ ID NO: 3466 - protein, 9 aa, Artificial Sequence
  Synthetic Peptide
GPHISYPPL

SEQ ID NO: 3467 - protein, 9 aa, Artificial Sequence
  Synthetic Peptide
YPPLHEWVL

SEQ ID NO: 3468 - protein, 10 aa, Artificial Sequence
  Synthetic Peptide
LPTTMNYPLW

SEQ ID NO: 3469 - protein, 10 aa, Artificial Sequence
  Synthetic Peptide
MPKAGLLIIV

SEQ ID NO: 3470 - protein, 10 aa, Artificial Sequence
  Synthetic Peptide
DPKKLLTQHF

SEQ ID NO: 3471 - protein, 10 aa, Artificial Sequence
  Synthetic Peptide
GPRALVETSY

SEQ ID NO: 3472 - protein, 9 aa, Artificial Sequence
  Synthetic Peptide
IPDSIQDWL

SEQ ID NO: 3473 - protein, 9 aa, Artificial Sequence
  Synthetic Peptide
HPSDGKCNL

SEQ ID NO: 3474 - protein, 9 aa, Artificial Sequence
  Synthetic Peptide
GPFMKAVCV

SEQ ID NO: 3475 - protein, 9 aa, Artificial Sequence
  Synthetic Peptide
KPKREPLDV

SEQ ID NO: 3476 - protein, 9 aa, Artificial Sequence
  Synthetic Peptide
RPRGDNFAV

SEQ ID NO: 3477 - protein, 9 aa, Artificial Sequence
  Synthetic Peptide
PPNPPDPDI

SEQ ID NO: 3478 - protein, 9 aa, Artificial Sequence
  Synthetic Peptide
IPEDSEKEV

SEQ ID NO: 3479 - protein, 9 aa, Artificial Sequence
  Synthetic Peptide
EPAPFDETL

SEQ ID NO: 3480 - protein, 9 aa, Artificial Sequence
  Synthetic Peptide
QPRPRGDNF

SEQ ID NO: 3481 - protein, 9 aa, Artificial Sequence
  Synthetic Peptide
LPNDKSDRY

SEQ ID NO: 3482 - protein, 10 aa, Artificial Sequence
  Synthetic Peptide
NPPNPPNPDI

SEQ ID NO: 3483 - protein, 10 aa, Artificial Sequence
  Synthetic Peptide
LPDNKSDRYI

SEQ ID NO: 3484 - protein, 10 aa, Artificial Sequence
  Synthetic Peptide
IPYSPLSPKV

SEQ ID NO: 3485 - protein, 10 aa, Artificial Sequence
  Synthetic Peptide
HPSDGKCNLY

SEQ ID NO: 3486 - protein, 10 aa, Artificial Sequence
  Synthetic Peptide
NPEDDREENF

SEQ ID NO: 3487 - protein, 10 aa, Artificial Sequence
  Synthetic Peptide
TPYAGEPAPF

SEQ ID NO: 3488 - protein, 9 aa, Artificial Sequence
  Synthetic Peptide
YPAEITLTW

SEQ ID NO: 3489 - protein, 9 aa, Artificial Sequence
  Synthetic Peptide
MPLETQLAI

SEQ ID NO: 3490 - protein, 9 aa, Artificial Sequence
  Synthetic Peptide
LPSDFFPSV

SEQ ID NO: 3491 - protein, 9 aa, Artificial Sequence
  Synthetic Peptide
  VARIANT 1, 5: Xaa = Any Amino Acid
XPSDXAAEA

SEQ ID NO: 3492 - protein, 9 aa, Artificial Sequence
  Synthetic Peptide
LPFDFTPGY

SEQ ID NO: 3493 - protein, 9 aa, Artificial Sequence
  Synthetic Peptide
APRTVALTA

SEQ ID NO: 3494 - protein, 9 aa, Artificial Sequence
  Synthetic Peptide
LPGPKFLQY

SEQ ID NO: 3495 - protein, 9 aa, Artificial Sequence
  Synthetic Peptide
DPKVKQWPL

SEQ ID NO: 3496 - protein, 9 aa, Artificial Sequence
  Synthetic Peptide
MPNDPNRNV

SEQ ID NO: 3497 - protein, 9 aa, Artificial Sequence
  Synthetic Peptide
APRTLVYLL

SEQ ID NO: 3498 - protein, 10 aa, Artificial Sequence
  Synthetic Peptide
APRTVALTAL

SEQ ID NO: 3499 - protein, 9 aa, Artificial Sequence
  Synthetic Peptide
APRASRPSL

SEQ ID NO: 3500 - protein, 8 aa, Artificial Sequence
  Synthetic Peptide
YPFQPPKV

SEQ ID NO: 3501 - protein, 9 aa, Artificial Sequence
  Synthetic Peptide
KPIVQYDNF

SEQ ID NO: 3502 - protein, 9 aa, Artificial Sequence
  Synthetic Peptide
TPYDINQML

SEQ ID NO: 3503 - protein, 9 aa, Artificial Sequence
  Synthetic Peptide
DPYEVSYRI

SEQ ID NO: 3504 - protein, 9 aa, Artificial Sequence
  Synthetic Peptide
YPAEITLTW

SEQ ID NO: 3505 - protein, 9 aa, Artificial Sequence
  Synthetic Peptide
MPLETQLAI

SEQ ID NO: 3506 - protein, 9 aa, Artificial Sequence
  Synthetic Peptide
LPSDFFPSV

SEQ ID NO: 3507 - protein, 9 aa, Artificial Sequence
  Synthetic Peptide
  VARIANT 1, 5: Xaa = Any Amino Acid
XPSDXAAEA

SEQ ID NO: 3508 - protein, 9 aa, Artificial Sequence
  Synthetic Peptide
LPFDFTPGY

SEQ ID NO: 3509 - protein, 9 aa, Artificial Sequence
  Synthetic Peptide
APRTVALTA

SEQ ID NO: 3510 - protein, 9 aa, Artificial Sequence
  Synthetic Peptide
LPGPKFLQY

SEQ ID NO: 3511 - protein, 9 aa, Artificial Sequence
  Synthetic Peptide
DPKVKQWPL

SEQ ID NO: 3512 - protein, 9 aa, Artificial Sequence
  Synthetic Peptide
MPNDPNRNV

SEQ ID NO: 3513 - protein, 9 aa, Artificial Sequence
  Synthetic Peptide
APRTLVYLL

SEQ ID NO: 3514 - protein, 10 aa, Artificial Sequence
  Synthetic Peptide
APRTVALTAL

SEQ ID NO: 3515 - protein, 9 aa, Artificial Sequence
  Synthetic Peptide
APRASRPSL

SEQ ID NO: 3516 - protein, 8 aa, Artificial Sequence
  Synthetic Peptide
YPFQPPKV

SEQ ID NO: 3517 - protein, 9 aa, Artificial Sequence
  Synthetic Peptide
KPIVQYDNF

SEQ ID NO: 3518 - protein, 9 aa, Artificial Sequence
  Synthetic Peptide
TPYDINQML

SEQ ID NO: 3519 - protein, 9 aa, Artificial Sequence
  Synthetic Peptide
DPYEVSYRI

SEQ ID NO: 3520 - protein, 9 aa, Artificial Sequence
  Synthetic Peptide
FPVRPQVPL

SEQ ID NO: 3521 - protein, 9 aa, Artificial Sequence
  Synthetic Peptide
IPIPSSWAF

SEQ ID NO: 3522 - protein, 10 aa, Artificial Sequence
  Synthetic Peptide
FPHCLAFSYM

SEQ ID NO: 3523 - protein, 9 aa, Artificial Sequence
  Synthetic Peptide
LPGCSFSIF

SEQ ID NO: 3524 - protein, 9 aa, Artificial Sequence
  Synthetic Peptide
VPISHLYIL

SEQ ID NO: 3525 - protein, 9 aa, Artificial Sequence
  Synthetic Peptide
MPKAGLLII

SEQ ID NO: 3526 - protein, 9 aa, Artificial Sequence
  Synthetic Peptide
LPVCAFSSA

SEQ ID NO: 3527 - protein, 9 aa, Artificial Sequence
  Synthetic Peptide
YPCTVNFTI

SEQ ID NO: 3528 - protein, 9 aa, Artificial Sequence
  Synthetic Peptide
FPYLVAYQA

SEQ ID NO: 3529 - protein, 8 aa, Artificial Sequence
  Synthetic Peptide
EPRIWLHL

SEQ ID NO: 3530 - protein, 9 aa, Artificial Sequence
  Synthetic Peptide
EPISPIETV

SEQ ID NO: 3531 - protein, 9 aa, Artificial Sequence
  Synthetic Peptide
LPTTMNYPI

SEQ ID NO: 3532 - protein, 9 aa, Artificial Sequence
  Synthetic Peptide
APLLLARAA

SEQ ID NO: 3533 - protein, 9 aa, Artificial Sequence
  Synthetic Peptide
HPQWVLTAA

SEQ ID NO: 3534 - protein, 9 aa, Artificial Sequence
  Synthetic Peptide
IPQSLDSWW

SEQ ID NO: 3535 - protein, 9 aa, Artificial Sequence
  Synthetic Peptide
TPARVTGGV

SEQ ID NO: 3536 - protein, 9 aa, Artificial Sequence
  Synthetic Peptide
LPIFFCLWV

SEQ ID NO: 3537 - protein, 9 aa, Artificial Sequence
  Synthetic Peptide
HPAAMPHLL

SEQ ID NO: 3538 - protein, 9 aa, Artificial Sequence
  Synthetic Peptide
DPSRGRLGL

SEQ ID NO: 3539 - protein, 9 aa, Artificial Sequence
  Synthetic Peptide
FPDHQLDPA

SEQ ID NO: 3540 - protein, 9 aa, Artificial Sequence
  Synthetic Peptide
YPALMPLYA

SEQ ID NO: 3541 - protein, 9 aa, Artificial Sequence
  Synthetic Peptide
QPRGRRQPI

SEQ ID NO: 3542 - protein, 9 aa, Artificial Sequence
  Synthetic Peptide
SPRGSRPSW

SEQ ID NO: 3543 - protein, 9 aa, Artificial Sequence
  Synthetic Peptide
DPRRRSRNL

SEQ ID NO: 3544 - protein, 9 aa, Artificial Sequence
  Synthetic Peptide
LPALSTGLI

SEQ ID NO: 3545 - protein, 9 aa, Artificial Sequence
  Synthetic Peptide
LPNLEEVAL

SEQ ID NO: 3546 - protein, 9 aa, Artificial Sequence
  Synthetic Peptide
SPGALVVGV

SEQ ID NO: 3547 - protein, 9 aa, Artificial Sequence
  Synthetic Peptide
SPGQRVEFL

SEQ ID NO: 3548 - protein, 9 aa, Artificial Sequence
  Synthetic Peptide
APTLWARMI

SEQ ID NO: 3549 - protein, 9 aa, Artificial Sequence
  Synthetic Peptide
APLGGAARA

SEQ ID NO: 3550 - protein, 9 aa, Artificial Sequence
  Synthetic Peptide
LPAILSPGA

SEQ ID NO: 3551 - protein, 9 aa, Artificial Sequence
  Synthetic Peptide
NPAIASLMA

SEQ ID NO: 3552 - protein, 9 aa, Artificial Sequence
  Synthetic Peptide
TPLLYRLGA

SEQ ID NO: 3553 - protein, 9 aa, Artificial Sequence
  Synthetic Peptide
WPLLLLLLA

SEQ ID NO: 3554 - protein, 9 aa, Artificial Sequence
  Synthetic Peptide
SPTRRELQV

SEQ ID NO: 3555 - protein, 9 aa, Artificial Sequence
  Synthetic Peptide
RPQVPLRPM

SEQ ID NO: 3556 - protein, 9 aa, Artificial Sequence
  Synthetic Peptide
KPCVKLTPL

SEQ ID NO: 3557 - protein, 9 aa, Artificial Sequence
  Synthetic Peptide
SPRTLNAWV

SEQ ID NO: 3558 - protein, 9 aa, Artificial Sequence
  Synthetic Peptide
GPKVKQWPL

SEQ ID NO: 3559 - protein, 9 aa, Artificial Sequence
  Synthetic Peptide
SPAIFQSSM

SEQ ID NO: 3560 - protein, 9 aa, Artificial Sequence
  Synthetic Peptide
NPDIVIYQY

SEQ ID NO: 3561 - protein, 9 aa, Artificial Sequence
  Synthetic Peptide
GPGHKARVL

SEQ ID NO: 3562 - protein, 9 aa, Artificial Sequence
  Synthetic Peptide
YPLASLRSL

SEQ ID NO: 3563 - protein, 9 aa, Artificial Sequence
  Synthetic Peptide
VPRRKAKII

SEQ ID NO: 3564 - protein, 9 aa, Artificial Sequence
  Synthetic Peptide
NPYNTPVFA

SEQ ID NO: 3565 - protein, 9 aa, Artificial Sequence
  Synthetic Peptide
TPTLHEYML

SEQ ID NO: 3566 - protein, 9 aa, Artificial Sequence
  Synthetic Peptide
KPLNPAEKL

SEQ ID NO: 3567 - protein, 9 aa, Artificial Sequence
  Synthetic Peptide
MPKTGLLII

SEQ ID NO: 3568 - protein, 9 aa, Artificial Sequence
  Synthetic Peptide
DPACYEFLW

SEQ ID NO: 3569 - protein, 9 aa, Artificial Sequence
  Synthetic Peptide
EPHISYPPL

SEQ ID NO: 3570 - protein, 10 aa, Artificial Sequence
  Synthetic Peptide
YPPLHEARAL

SEQ ID NO: 3571 - protein, 9 aa, Artificial Sequence
  Synthetic Peptide
GPHISYPPL

SEQ ID NO: 3572 - protein, 9 aa, Artificial Sequence
  Synthetic Peptide
HPSDGKCNL

SEQ ID NO: 3573 - protein, 9 aa, Artificial Sequence
  Synthetic Peptide
RPRGDNFAV

SEQ ID NO: 3574 - protein, 9 aa, Artificial Sequence
  Synthetic Peptide
QPRPRGDNF

SEQ ID NO: 3575 - protein, 9 aa, Artificial Sequence
  Synthetic Peptide
CPGYRWMCL

SEQ ID NO: 3576 - protein, 9 aa, Artificial Sequence
  Synthetic Peptide
WPKFAVPNL

SEQ ID NO: 3577 - protein, 9 aa, Artificial Sequence
  Synthetic Peptide
PPKFAVPNL

SEQ ID NO: 3578 - protein, 9 aa, Artificial Sequence
  Synthetic Peptide
QPGYPWPLY

SEQ ID NO: 3579 - protein, 9 aa, Artificial Sequence
  Synthetic Peptide
WPLYGNEGL

SEQ ID NO: 3580 - protein, 9 aa, Artificial Sequence
  Synthetic Peptide
IPQAVVDMV

SEQ ID NO: 3581 - protein, 9 aa, Artificial Sequence
  Synthetic Peptide
SPWLTPRCM

SEQ ID NO: 3582 - protein, 9 aa, Artificial Sequence
  Synthetic Peptide
APPPSWDQM

SEQ ID NO: 3583 - protein, 9 aa, Artificial Sequence
  Synthetic Peptide
PPPSWDQMW

SEQ ID NO: 3584 - protein, 9 aa, Artificial Sequence
  Synthetic Peptide
SPTPLLYRL

SEQ ID NO: 3585 - protein, 9 aa, Artificial Sequence
  Synthetic Peptide
GPGEGAVQW

SEQ ID NO: 3586 - protein, 9 aa, Artificial Sequence
  Synthetic Peptide
LPCEPEPDV

SEQ ID NO: 3587 - protein, 9 aa, Artificial Sequence
  Synthetic Peptide
EPEPDVAVL

SEQ ID NO: 3588 - protein, 9 aa, Artificial Sequence
  Synthetic Peptide
DPDLSDGSW

SEQ ID NO: 3589 - protein, 9 aa, Artificial Sequence
  Synthetic Peptide
PPHSALSKF

SEQ ID NO: 3590 - protein, 9 aa, Artificial Sequence
  Synthetic Peptide
DPPQPEYDL

SEQ ID NO: 3591 - protein, 9 aa, Artificial Sequence
  Synthetic Peptide
WPEYDLELI

SEQ ID NO: 3592 - protein, 9 aa, Artificial Sequence
  Synthetic Peptide
DPTTPLARA

SEQ ID NO: 3593 - protein, 9 aa, Artificial Sequence
  Synthetic Peptide
SPGEINRVA

SEQ ID NO: 3594 - protein, 9 aa, Artificial Sequence
  Synthetic Peptide
TPTLAARNA

SEQ ID NO: 3595 - protein, 9 aa, Artificial Sequence
  Synthetic Peptide
DPDLADQLI

SEQ ID NO: 3596 - protein, 9 aa, Artificial Sequence
  Synthetic Peptide
LPGRWKPKM

SEQ ID NO: 3597 - protein, 8 aa, Artificial Sequence
  Synthetic Peptide
PPLPSVKL

SEQ ID NO: 3598 - protein, 9 aa, Artificial Sequence
  Synthetic Peptide
VPVKLKPGM

SEQ ID NO: 3599 - protein, 9 aa, Artificial Sequence
  Synthetic Peptide
KPGMDGPKV

SEQ ID NO: 3600 - protein, 9 aa, Artificial Sequence
  Synthetic Peptide
TPQDLNTML

SEQ ID NO: 3601 - protein, 9 aa, Artificial Sequence
  Synthetic Peptide
NPPIPVGEI

SEQ ID NO: 3602 - protein, 9 aa, Artificial Sequence
  Synthetic Peptide
PPIPVGEIV

SEQ ID NO: 3603 - protein, 9 aa, Artificial Sequence
  Synthetic Peptide
GPKEPFRDV

SEQ ID NO: 3604 - protein, 9 aa, Artificial Sequence
  Synthetic Peptide
GPAATLEEM

SEQ ID NO: 3605 - protein, 9 aa, Artificial Sequence
  Synthetic Peptide
EPPFLWMGY

SEQ ID NO: 3606 - protein, 9 aa, Artificial Sequence
  Synthetic Peptide
DPEIVMHSF

SEQ ID NO: 3607 - protein, 9 aa, Artificial Sequence
  Synthetic Peptide
LPEKDSWTV

SEQ ID NO: 3608 - protein, 9 aa, Artificial Sequence
  Synthetic Peptide
APTKALRRV

SEQ ID NO: 3609 - protein, 9 aa, Artificial Sequence
  Synthetic Peptide
TPPLVKLWV

SEQ ID NO: 3610 - protein, 9 aa, Artificial Sequence
  Synthetic Peptide
EPIVGAETF

SEQ ID NO: 3611 - protein, 9 aa, Artificial Sequence
  Synthetic Peptide
QPDKSESEL

SEQ ID NO: 3612 - protein, 9 aa, Artificial Sequence
  Synthetic Peptide
LPPVVAKEI

SEQ ID NO: 3613 - protein, 9 aa, Artificial Sequence
  Synthetic Peptide
PPVVAKEIV

SEQ ID NO: 3614 - protein, 9 aa, Artificial Sequence
  Synthetic Peptide
EPAADGVGA

SEQ ID NO: 3615 - protein, 9 aa, Artificial Sequence
  Synthetic Peptide
DPQERPRKL

SEQ ID NO: 3616 - protein, 9 aa, Artificial Sequence
  Synthetic Peptide
EPDRAHYNI

SEQ ID NO: 3617 - protein, 9 aa, Artificial Sequence
  Synthetic Peptide
CPEEKQRHL

SEQ ID NO: 3618 - protein, 9 aa, Artificial Sequence
  Synthetic Peptide
GPKATLQDI

SEQ ID NO: 3619 - protein, 9 aa, Artificial Sequence
  Synthetic Peptide
DPTRRPYKL

SEQ ID NO: 3620 - protein, 9 aa, Artificial Sequence
  Synthetic Peptide
NPAEKLRHL

SEQ ID NO: 3621 - protein, 9 aa, Artificial Sequence
  Synthetic Peptide
SPPHSPQGA

SEQ ID NO: 3622 - protein, 9 aa, Artificial Sequence
  Synthetic Peptide
EPVTKAEML

SEQ ID NO: 3623 - protein, 9 aa, Artificial Sequence
  Synthetic Peptide
VPGSDPACY

SEQ ID NO: 3624 - protein, 9 aa, Artificial Sequence
  Synthetic Peptide
DPIGHLYIF

SEQ ID NO: 3625 - protein, 9 aa, Artificial Sequence
  Synthetic Peptide
YPPLHEWVL

SEQ ID NO: 3626 - protein, 9 aa, Artificial Sequence
  Synthetic Peptide
DPPQSPQGA

SEQ ID NO: 3627 - protein, 9 aa, Artificial Sequence
  Synthetic Peptide
MPNDPNRNV

SEQ ID NO: 3628 - protein, 9 aa, Artificial Sequence
  Synthetic Peptide
IPDSIQDSL

SEQ ID NO: 3629 - protein, 9 aa, Artificial Sequence
  Synthetic Peptide
GPFMKAVCV

SEQ ID NO: 3630 - protein, 9 aa, Artificial Sequence
  Synthetic Peptide
LPKREPLDV

SEQ ID NO: 3631 - protein, 9 aa, Artificial Sequence
  Synthetic Peptide
PPNPPNPDI

SEQ ID NO: 3632 - protein, 9 aa, Artificial Sequence
  Synthetic Peptide
IPEDSEKEV

SEQ ID NO: 3633 - protein, 9 aa, Artificial Sequence
  Synthetic Peptide
EPAPFDETL

SEQ ID NO: 3634 - protein, 9 aa, Artificial Sequence
  Synthetic Peptide
LPNDKSDRY

SEQ ID NO: 3635 - protein, 9 aa, Artificial Sequence
  Synthetic Peptide
LPSENERGY

SEQ ID NO: 3636 - protein, 9 aa, Artificial Sequence
  Synthetic Peptide
KPIVQYDNF

SEQ ID NO: 3637 - protein, 9 aa, Artificial Sequence
  Synthetic Peptide
DPQVTAQDV

SEQ ID NO: 3638 - protein, 9 aa, Artificial Sequence
  Synthetic Peptide
EPLIDVHDL

SEQ ID NO: 3639 - protein, 9 aa, Artificial Sequence
  Synthetic Peptide
QPQGDDNNL

SEQ ID NO: 3640 - protein, 9 aa, Artificial Sequence
  Synthetic Peptide
VPGAATPYA

SEQ ID NO: 3641 - protein, 10 aa, Artificial Sequence
  Synthetic Peptide
FPHCLAFSYM

SEQ ID NO: 3642 - protein, 10 aa, Artificial Sequence
  Synthetic Peptide
YPLASLRSLF

SEQ ID NO: 3643 - protein, 10 aa, Artificial Sequence
  Synthetic Peptide
TPYAGEPAPF

SEQ ID NO: 3644 - protein, 10 aa, Artificial Sequence
  Synthetic Peptide
TPARVTGGVF

SEQ ID NO: 3645 - protein, 10 aa, Artificial Sequence
  Synthetic Peptide
YPCTVNFTIF

SEQ ID NO: 3646 - protein, 10 aa, Artificial Sequence
  Synthetic Peptide
IPQAVVDMVA

SEQ ID NO: 3647 - protein, 10 aa, Artificial Sequence
  Synthetic Peptide
LPCSFTTLPA

SEQ ID NO: 3648 - protein, 10 aa, Artificial Sequence
  Synthetic Peptide
LPQGWKGSPA

SEQ ID NO: 3649 - protein, 10 aa, Artificial Sequence
  Synthetic Peptide
LPLDKGIKPY

SEQ ID NO: 3650 - protein, 10 aa, Artificial Sequence
  Synthetic Peptide
IPIPSSWAFA

SEQ ID NO: 3651 - protein, 10 aa, Artificial Sequence
  Synthetic Peptide
APFTQCGYPA

SEQ ID NO: 3652 - protein, 10 aa, Artificial Sequence
  Synthetic Peptide
LPIHTAELLA

SEQ ID NO: 3653 - protein, 10 aa, Artificial Sequence
  Synthetic Peptide
GPCALRFTSA

SEQ ID NO: 3654 - protein, 10 aa, Artificial Sequence
  Synthetic Peptide
LPRRGPRLGV

SEQ ID NO: 3655 - protein, 10 aa, Artificial Sequence
  Synthetic Peptide
APLGGAARAL

SEQ ID NO: 3656 - protein, 10 aa, Artificial Sequence
  Synthetic Peptide
VPASQVCGPV

SEQ ID NO: 3657 - protein, 10 aa, Artificial Sequence
  Synthetic Peptide
SPLLLSTTEQ

SEQ ID NO: 3658 - protein, 10 aa, Artificial Sequence
  Synthetic Peptide
RPSGMFDSSV

SEQ ID NO: 3659 - protein, 10 aa, Artificial Sequence
  Synthetic Peptide
KPTLHGPTPL

SEQ ID NO: 3660 - protein, 10 aa, Artificial Sequence
  Synthetic Peptide
TPLLYRLGAV

SEQ ID NO: 3661 - protein, 10 aa, Artificial Sequence
  Synthetic Peptide
NPAIASLMAF

SEQ ID NO: 3662 - protein, 10 aa, Artificial Sequence
  Synthetic Peptide
LPAILSPGAL

SEQ ID NO: 3663 - protein, 10 aa, Artificial Sequence
  Synthetic Peptide
SPGALVVGVV

SEQ ID NO: 3664 - protein, 10 aa, Artificial Sequence
  Synthetic Peptide
APTLWARMIL

SEQ ID NO: 3665 - protein, 10 aa, Artificial Sequence
  Synthetic Peptide
VPHPNIEEVA

SEQ ID NO: 3666 - protein, 10 aa, Artificial Sequence
  Synthetic Peptide
IPVGEIYKRW

SEQ ID NO: 3667 - protein, 10 aa, Artificial Sequence
  Synthetic Peptide
APTKAKRRVV

SEQ ID NO: 3668 - protein, 10 aa, Artificial Sequence
  Synthetic Peptide
VPISHLYILV

SEQ ID NO: 3669 - protein, 10 aa, Artificial Sequence
  Synthetic Peptide
MPKTGLLIIV

SEQ ID NO: 3670 - protein, 10 aa, Artificial Sequence
  Synthetic Peptide
HPRKLLMQDL

SEQ ID NO: 3671 - protein, 10 aa, Artificial Sequence
  Synthetic Peptide
FPDLESEFQA

SEQ ID NO: 3672 - protein, 10 aa, Artificial Sequence
  Synthetic Peptide
LPTTMNYPLW

SEQ ID NO: 3673 - protein, 10 aa, Artificial Sequence
  Synthetic Peptide
MPKAGLLIIV

SEQ ID NO: 3674 - protein, 10 aa, Artificial Sequence
  Synthetic Peptide
DPIGHLYIFA

SEQ ID NO: 3675 - protein, 10 aa, Artificial Sequence
  Synthetic Peptide
GPLEEELPRL

SEQ ID NO: 3676 - protein, 10 aa, Artificial Sequence
  Synthetic Peptide
IPQTHKVGNF

SEQ ID NO: 3677 - protein, 10 aa, Artificial Sequence
  Synthetic Peptide
PPNAPILSTL

SEQ ID NO: 3678 - protein, 10 aa, Artificial Sequence
  Synthetic Peptide
GPLLVLQAGF

SEQ ID NO: 3679 - protein, 10 aa, Artificial Sequence
  Synthetic Peptide
VPFVQWFVGL

SEQ ID NO: 3680 - protein, 10 aa, Artificial Sequence
  Synthetic Peptide
LPIFFCLWVY

SEQ ID NO: 3681 - protein, 10 aa, Artificial Sequence
  Synthetic Peptide
VPNLQSLTNL

SEQ ID NO: 3682 - protein, 10 aa, Artificial Sequence
  Synthetic Peptide
SPHHTALRQA

SEQ ID NO: 3683 - protein, 10 aa, Artificial Sequence
  Synthetic Peptide
TPPAYRPPNA

SEQ ID NO: 3684 - protein, 10 aa, Artificial Sequence
  Synthetic Peptide
LPGCSFSIFL

SEQ ID NO: 3685 - protein, 10 aa, Artificial Sequence
  Synthetic Peptide
IPTTTIRRHV

SEQ ID NO: 3686 - protein, 10 aa, Artificial Sequence
  Synthetic Peptide
YPGHVSGHRM

SEQ ID NO: 3687 - protein, 10 aa, Artificial Sequence
  Synthetic Peptide
GPQLTPRCMV

SEQ ID NO: 3688 - protein, 10 aa, Artificial Sequence
  Synthetic Peptide
WPLLLLLLAL

SEQ ID NO: 3689 - protein, 10 aa, Artificial Sequence
  Synthetic Peptide
TPCTCGSSDL

SEQ ID NO: 3690 - protein, 10 aa, Artificial Sequence
  Synthetic Peptide
VPAAYAAQGY

SEQ ID NO: 3691 - protein, 10 aa, Artificial Sequence
  Synthetic Peptide
NPSVAATLGF

SEQ ID NO: 3692 - protein, 10 aa, Artificial Sequence
  Synthetic Peptide
LPVCQDHLEF

SEQ ID NO: 3693 - protein, 10 aa, Artificial Sequence
  Synthetic Peptide
APPPSWDQMW

SEQ ID NO: 3694 - protein, 10 aa, Artificial Sequence
  Synthetic Peptide
LPGNPAIASL

SEQ ID NO: 3695 - protein, 10 aa, Artificial Sequence
  Synthetic Peptide
GPGEGAVQWM

SEQ ID NO: 3696 - protein, 10 aa, Artificial Sequence
  Synthetic Peptide
VPESDAAARV

SEQ ID NO: 3697 - protein, 10 aa, Artificial Sequence
  Synthetic Peptide
EPDVAVLTSM

SEQ ID NO: 3698 - protein, 10 aa, Artificial Sequence
  Synthetic Peptide
SPGQRVEFLV

SEQ ID NO: 3699 - protein, 10 aa, Artificial Sequence
  Synthetic Peptide
PPGDPPQPEY

SEQ ID NO: 3700 - protein, 10 aa, Artificial Sequence
  Synthetic Peptide
PPQPEYDLEL

SEQ ID NO: 3701 - protein, 10 aa, Artificial Sequence
  Synthetic Peptide
TPVNSQLGNI

SEQ ID NO: 3702 - protein, 10 aa, Artificial Sequence
  Synthetic Peptide
DPSHITAETA

SEQ ID NO: 3703 - protein, 10 aa, Artificial Sequence
  Synthetic Peptide
DPTTPLARAA

SEQ ID NO: 3704 - protein, 10 aa, Artificial Sequence
  Synthetic Peptide
LPCEPEPDVA

SEQ ID NO: 3705 - protein, 10 aa, Artificial Sequence
  Synthetic Peptide
QPEKGGRKPA

SEQ ID NO: 3706 - protein, 10 aa, Artificial Sequence
  Synthetic Peptide
EPVDPRLEPW

SEQ ID NO: 3707 - protein, 10 aa, Artificial Sequence
  Synthetic Peptide
SPTRRELQVW

SEQ ID NO: 3708 - protein, 10 aa, Artificial Sequence
  Synthetic Peptide
LPGRWKPKMI

SEQ ID NO: 3709 - protein, 10 aa, Artificial Sequence
  Synthetic Peptide
TPVNIIGRNL

SEQ ID NO: 3710 - protein, 9 aa, Artificial Sequence
  Synthetic Peptide
KPPLPSVKL

SEQ ID NO: 3711 - protein, 10 aa, Artificial Sequence
  Synthetic Peptide
SPIETVPVKL

SEQ ID NO: 3712 - protein, 10 aa, Artificial Sequence
  Synthetic Peptide
GPENPYNTPV

SEQ ID NO: 3713 - protein, 10 aa, Artificial Sequence
  Synthetic Peptide
NPYNTPVFAI

SEQ ID NO: 3714 - protein, 10 aa, Artificial Sequence
  Synthetic Peptide
NPPIPVGEIY

SEQ ID NO: 3715 - protein, 10 aa, Artificial Sequence
  Synthetic Peptide
VPLDKDFRKY

SEQ ID NO: 3716 - protein, 10 aa, Artificial Sequence
  Synthetic Peptide
GPKEPFRDYV

SEQ ID NO: 3717 - protein, 10 aa, Artificial Sequence
  Synthetic Peptide
EPFRDYVDRF

SEQ ID NO: 3718 - protein, 10 aa, Artificial Sequence
  Synthetic Peptide
TPGIRYQYNV

SEQ ID NO: 3719 - protein, 10 aa, Artificial Sequence
  Synthetic Peptide
EPFRKQNPDI

SEQ ID NO: 3720 - protein, 10 aa, Artificial Sequence
  Synthetic Peptide
GPAATLEEMM

SEQ ID NO: 3721 - protein, 10 aa, Artificial Sequence
  Synthetic Peptide
NPDIVIYQYM

SEQ ID NO: 3722 - protein, 10 aa, Artificial Sequence
  Synthetic Peptide
PPFLWMGYEL

SEQ ID NO: 3723 - protein, 10 aa, Artificial Sequence
  Synthetic Peptide
HPDKWTVWPI

SEQ ID NO: 3724 - protein, 10 aa, Artificial Sequence
  Synthetic Peptide
EPTAPPEESF

SEQ ID NO: 3725 - protein, 10 aa, Artificial Sequence
  Synthetic Peptide
PPLVKLWYQL

SEQ ID NO: 3726 - protein, 10 aa, Artificial Sequence
  Synthetic Peptide
EPIVGAETFY

SEQ ID NO: 3727 - protein, 10 aa, Artificial Sequence
  Synthetic Peptide
QPDKSESELV

SEQ ID NO: 3728 - protein, 10 aa, Artificial Sequence
  Synthetic Peptide
LPPVVAKEIV

SEQ ID NO: 3729 - protein, 10 aa, Artificial Sequence
  Synthetic Peptide
EPYNPQDQGV

SEQ ID NO: 3730 - protein, 10 aa, Artificial Sequence
  Synthetic Peptide
DPLWKGPAKL

SEQ ID NO: 3731 - protein, 10 aa, Artificial Sequence
  Synthetic Peptide
GPGHKARVLA

SEQ ID NO: 3732 - protein, 10 aa, Artificial Sequence
  Synthetic Peptide
NPDCKTILKA

SEQ ID NO: 3733 - protein, 10 aa, Artificial Sequence
  Synthetic Peptide
SPEVIPMFSA

SEQ ID NO: 3734 - protein, 10 aa, Artificial Sequence
  Synthetic Peptide
IPAETGQETA

SEQ ID NO: 3735 - protein, 10 aa, Artificial Sequence
  Synthetic Peptide
PPVVAKEIVA

SEQ ID NO: 3736 - protein, 10 aa, Artificial Sequence
  Synthetic Peptide
EPDRAHYNIV

SEQ ID NO: 3737 - protein, 10 aa, Artificial Sequence
  Synthetic Peptide
NPYAVCDKCL

SEQ ID NO: 3738 - protein, 10 aa, Artificial Sequence
  Synthetic Peptide
GPKATLQDIV

SEQ ID NO: 3739 - protein, 10 aa, Artificial Sequence
  Synthetic Peptide
EPQNEIPVDL

SEQ ID NO: 3740 - protein, 10 aa, Artificial Sequence
  Synthetic Peptide
EPQRHTMLCM

SEQ ID NO: 3741 - protein, 10 aa, Artificial Sequence
  Synthetic Peptide
IPHAACHKCI

SEQ ID NO: 3742 - protein, 10 aa, Artificial Sequence
  Synthetic Peptide
GPRALIETSY

SEQ ID NO: 3743 - protein, 10 aa, Artificial Sequence
  Synthetic Peptide
APATEEQQTA

SEQ ID NO: 3744 - protein, 10 aa, Artificial Sequence
  Synthetic Peptide
APEEKIWEEL

SEQ ID NO: 3745 - protein, 10 aa, Artificial Sequence
  Synthetic Peptide
DPKKLLTQHF

SEQ ID NO: 3746 - protein, 10 aa, Artificial Sequence
  Synthetic Peptide
GPRALVETSY

SEQ ID NO: 3747 - protein, 10 aa, Artificial Sequence
  Synthetic Peptide
APATEEQEAA

SEQ ID NO: 3748 - protein, 10 aa, Artificial Sequence
  Synthetic Peptide
NPDPNANPNV

SEQ ID NO: 3749 - protein, 10 aa, Artificial Sequence
  Synthetic Peptide
EPSDKHIKEY

SEQ ID NO: 3750 - protein, 10 aa, Artificial Sequence
  Synthetic Peptide
NPPNPPNPDI

SEQ ID NO: 3751 - protein, 10 aa, Artificial Sequence
  Synthetic Peptide
LPNDKSDRYI

SEQ ID NO: 3752 - protein, 10 aa, Artificial Sequence
  Synthetic Peptide
IPYSPLSPKV

SEQ ID NO: 3753 - protein, 10 aa, Artificial Sequence
  Synthetic Peptide
HPSDGKCNLY

SEQ ID NO: 3754 - protein, 10 aa, Artificial Sequence
  Synthetic Peptide
NPEDDREENF

SEQ ID NO: 3755 - protein, 10 aa, Artificial Sequence
  Synthetic Peptide
LPSENERGYY

SEQ ID NO: 3756 - protein, 10 aa, Artificial Sequence
  Synthetic Peptide
DPNRNVDENA

SEQ ID NO: 3757 - protein, 10 aa, Artificial Sequence
  Synthetic Peptide
EPLIDVHDLI

SEQ ID NO: 3758 - protein, 10 aa, Artificial Sequence
  Synthetic Peptide
QPQGDDNNLV

SEQ ID NO: 3759 - protein, 10 aa, Artificial Sequence
  Synthetic Peptide
DPADNANPDA

SEQ ID NO: 3760 - protein, 9 aa, Artificial Sequence
  Synthetic Peptide
PNADPQVTA

SEQ ID NO: 3761 - protein, 9 aa, Artificial Sequence
  Synthetic Peptide
PEQKEDKSA

SEQ ID NO: 3762 - protein, 10 aa, Artificial Sequence
  Synthetic Peptide
QPRPRGDNFA

SEQ ID NO: 3763 - protein, 10 aa, Artificial Sequence
  Synthetic Peptide
SPSCPLERFA

SEQ ID NO: 3764 - protein, 10 aa, Artificial Sequence
  Synthetic Peptide
EPALGTTCYA

SEQ ID NO: 3765 - protein, 9 aa, Artificial Sequence
  Synthetic Peptide
YLVAYQATV

SEQ ID NO: 3766 - protein, 9 aa, Artificial Sequence
  Synthetic Peptide
KLVAYQATV

SEQ ID NO: 3767 - protein, 9 aa, Artificial Sequence
  Synthetic Peptide
YKVAYQATV

SEQ ID NO: 3768 - protein, 9 aa, Artificial Sequence
  Synthetic Peptide
YLKAYQATV

SEQ ID NO: 3769 - protein, 9 aa, Artificial Sequence
  Synthetic Peptide
YLVKYQATV

SEQ ID NO: 3770 - protein, 9 aa, Artificial Sequence
  Synthetic Peptide
YLVAKQATV

SEQ ID NO: 3771 - protein, 9 aa, Artificial Sequence
  Synthetic Peptide
YLVAYKATV

SEQ ID NO: 3772 - protein, 9 aa, Artificial Sequence
  Synthetic Peptide
YLVAYQKTV

SEQ ID NO: 3773 - protein, 9 aa, Artificial Sequence
  Synthetic Peptide
YLVAYQAKV

SEQ ID NO: 3774 - protein, 9 aa, Artificial Sequence
  Synthetic Peptide
YLVAYQATK

SEQ ID NO: 3775 - protein, 10 aa, Artificial Sequence
  Synthetic Peptide
FLPSDYFPSV

SEQ ID NO: 3776 - protein, 10 aa, Artificial Sequence
  Synthetic Peptide
KLPSDYFPSV

SEQ ID NO: 3777 - protein, 10 aa, Artificial Sequence
  Synthetic Peptide
FKPSDYFPSV

SEQ ID NO: 3778 - protein, 10 aa, Artificial Sequence
  Synthetic Peptide
FLKSDYFPSV

SEQ ID NO: 3779 - protein, 10 aa, Artificial Sequence
  Synthetic Peptide
FLPKDYFPSV

SEQ ID NO: 3780 - protein, 10 aa, Artificial Sequence
  Synthetic Peptide
FLPSKYFPSV

SEQ ID NO: 3781 - protein, 10 aa, Artificial Sequence
  Synthetic Peptide
FLPSDKFPSV

SEQ ID NO: 3782 - protein, 10 aa, Artificial Sequence
  Synthetic Peptide
FLPSDYKPSV

SEQ ID NO: 3783 - protein, 10 aa, Artificial Sequence
  Synthetic Peptide
FLPSDYFKSV

SEQ ID NO: 3784 - protein, 10 aa, Artificial Sequence
  Synthetic Peptide
FLPSDYFPKV

SEQ ID NO: 3785 - protein, 10 aa, Artificial Sequence
  Synthetic Peptide
FLPSDYFPSK

SEQ ID NO: 3786 - protein, 9 aa, Artificial Sequence
  Synthetic Peptide
ALAKAAAAV

SEQ ID NO: 3787 - protein, 9 aa, Artificial Sequence
  Synthetic Peptide
EDTPIGHLY

SEQ ID NO: 3788 - protein, 9 aa, Artificial Sequence
  Synthetic Peptide
AVDPIGHLY

SEQ ID NO: 3789 - protein, 9 aa, Artificial Sequence
  Synthetic Peptide
EVDPIAHLY

SEQ ID NO: 3790 - protein, 10 aa, Artificial Sequence
  Synthetic Peptide
FSPAFDNLYY

SEQ ID NO: 3791 - protein, 9 aa, Artificial Sequence
  Synthetic Peptide
EVDAIGHLY

SEQ ID NO: 3792 - protein, 9 aa, Artificial Sequence
  Synthetic Peptide
EVDPIGALY

SEQ ID NO: 3793 - protein, 9 aa, Artificial Sequence
  Synthetic Peptide
EVDPIGHAY

SEQ ID NO: 3794 - protein, 9 aa, Artificial Sequence
  Synthetic Peptide
EADPIGHLY

SEQ ID NO: 3795 - protein, 9 aa, Artificial Sequence
  Synthetic Peptide
EVDPTGHLY

SEQ ID NO: 3796 - protein, 9 aa, Artificial Sequence
  Synthetic Peptide
EVDPIGHSY

SEQ ID NO: 3797 - protein, 9 aa, Artificial Sequence
  Synthetic Peptide
EVDPAGHLY

SEQ ID NO: 3798 - protein, 9 aa, Artificial Sequence
  Synthetic Peptide
EVDPASNTY

SEQ ID NO: 3799 - protein, 9 aa, Artificial Sequence
  Synthetic Peptide
PLSEDQLLY

SEQ ID NO: 3800 - protein, 9 aa, Artificial Sequence
  Synthetic Peptide
LSAFSLHSY

SEQ ID NO: 3801 - protein, 10 aa, Artificial Sequence
  Synthetic Peptide
IPSYKKLIMY

SEQ ID NO: 3802 - protein, 10 aa, Artificial Sequence
  Synthetic Peptide
YASCHLTELY

SEQ ID NO: 3803 - protein, 9 aa, Artificial Sequence
  Synthetic Peptide
EVDPIGHLA

SEQ ID NO: 3804 - protein, 10 aa, Artificial Sequence
  Synthetic Peptide
CMQIAKGMSY

SEQ ID NO: 3805 - protein, 10 aa, Artificial Sequence
  Synthetic Peptide
VGSDCTTIHY

SEQ ID NO: 3806 - protein, 9 aa, Artificial Sequence
  Synthetic Peptide
EVAPIGHLY

SEQ ID NO: 3807 - protein, 10 aa, Artificial Sequence
  Synthetic Peptide
ESMPNPEGRY

SEQ ID NO: 3808 - protein, 9 aa, Artificial Sequence
  Synthetic Peptide
ASCVTACPY

SEQ ID NO: 3809 - protein, 10 aa, Artificial Sequence
  Synthetic Peptide
FSPAFDNLYY

SEQ ID NO: 3810 - protein, 9 aa, Artificial Sequence
  Synthetic Peptide
ASPLDSTFY

SEQ ID NO: 3811 - protein, 10 aa, Artificial Sequence
  Synthetic Peptide
RGTQLFENDY

SEQ ID NO: 3812 - protein, 10 aa, Artificial Sequence
  Synthetic Peptide
PASPLDSTFY

SEQ ID NO: 3813 - protein, 10 aa, Artificial Sequence
  Synthetic Peptide
PSQKTYQGSY

SEQ ID NO: 3814 - protein, 9 aa, Artificial Sequence
  Synthetic Peptide
KSTKVPAAY

SEQ ID NO: 3815 - protein, 9 aa, Artificial Sequence
  Synthetic Peptide
DSSVLCECY

SEQ ID NO: 3816 - protein, 10 aa, Artificial Sequence
  Synthetic Peptide
KISEYRHYCY

SEQ ID NO: 3817 - protein, 10 aa, Artificial Sequence
  Synthetic Peptide
NLYVSLMLLY

SEQ ID NO: 3818 - protein, 10 aa, Artificial Sequence
  Synthetic Peptide
GTRVRAMAIY

SEQ ID NO: 3819 - protein, 11 aa, Artificial Sequence
  Synthetic Peptide
LTCGFADLMGY

SEQ ID NO: 3820 - protein, 9 aa, Artificial Sequence
  Synthetic Peptide
VMAGVGSPY

SEQ ID NO: 3821 - protein, 9 aa, Artificial Sequence
  Synthetic Peptide
TLWKAGILY

SEQ ID NO: 3822 - protein, 9 aa, Artificial Sequence
  Synthetic Peptide
KLNWASQIY

SEQ ID NO: 3823 - protein, 9 aa, Artificial Sequence
  Synthetic Peptide
LVGFLLLKY

SEQ ID NO: 3824 - protein, 9 aa, Artificial Sequence
  Synthetic Peptide
ILRGTSFVY

SEQ ID NO: 3825 - protein, 9 aa, Artificial Sequence
  Synthetic Peptide
RVLGLPREY

SEQ ID NO: 3826 - protein, 9 aa, Artificial Sequence
  Synthetic Peptide
QLVTQLMPY

SEQ ID NO: 3827 - protein, 9 aa, Artificial Sequence
  Synthetic Peptide
GLNKIVRMY

SEQ ID NO: 3828 - protein, 10 aa, Artificial Sequence
  Synthetic Peptide
LLGDNQVMPK

SEQ ID NO: 3829 - protein, 10 aa, Artificial Sequence
  Synthetic Peptide
QVRDQAEHLK

SEQ ID NO: 3830 - protein, 8 aa, Artificial Sequence
  Synthetic Peptide
LVSAGIRK

SEQ ID NO: 3831 - protein, 8 aa, Artificial Sequence
  Synthetic Peptide
VTDRGRQK

SEQ ID NO: 3832 - protein, 11 aa, Artificial Sequence
  Synthetic Peptide
TVFDAKRLIGR

SEQ ID NO: 3833 - protein, 9 aa, Artificial Sequence
  Synthetic Peptide
KTGGPIYKR

SEQ ID NO: 3834 - protein, 9 aa, Artificial Sequence
  Synthetic Peptide
SLYTKVVHY

SEQ ID NO: 3835 - protein, 9 aa, Artificial Sequence
  Synthetic Peptide
AVAAVAARR

SEQ ID NO: 3836 - protein, 9 aa, Artificial Sequence
  Synthetic Peptide
KIQNFRVYY

SEQ ID NO: 3837 - protein, 11 aa, Artificial Sequence
  Synthetic Peptide
EMLESVIKNYK

SEQ ID NO: 3838 - protein, 10 aa, Artificial Sequence
  Synthetic Peptide
EVAPPEYHRK

SEQ ID NO: 3839 - protein, 8 aa, Artificial Sequence
  Synthetic Peptide
ETAYFLLK

SEQ ID NO: 3840 - protein, 9 aa, Artificial Sequence
  Synthetic Peptide
RWGLLLALL

SEQ ID NO: 3841 - protein, 9 aa, Artificial Sequence
  Synthetic Peptide
PYVSRLLGI

SEQ ID NO: 3842 - protein, 9 aa, Artificial Sequence
  Synthetic Peptide
VYMIMVKCW

SEQ ID NO: 3843 - protein, 9 aa, Artificial Sequence
  Synthetic Peptide
SYGVTVWEL

SEQ ID NO: 3844 - protein, 10 aa, Artificial Sequence
  Synthetic Peptide
LYISAWPDSL

SEQ ID NO: 3845 - protein, 9 aa, Artificial Sequence
  Synthetic Peptide
VWSYGVTVW

SEQ ID NO: 3846 - protein, 10 aa, Artificial Sequence
  Synthetic Peptide
SYGVTVWELM

SEQ ID NO: 3847 - protein, 9 aa, Artificial Sequence
  Synthetic Peptide
QYLAGLSTL

SEQ ID NO: 3848 - protein, 9 aa, Artificial Sequence
  Synthetic Peptide
TYLPTNASL

SEQ ID NO: 3849 - protein, 10 aa, Artificial Sequence
  Synthetic Peptide
EYLVSFGVWI

SEQ ID NO: 3850 - protein, 9 aa, Artificial Sequence
  Synthetic Peptide
KFMLCAGRW

SEQ ID NO: 3851 - skipped
  Synthetic Peptide

SEQ ID NO: 3852 - protein, 9 aa, Artificial Sequence
  Synthetic Peptide
WFHISCLTF

SEQ ID NO: 3853 - protein, 9 aa, Artificial Sequence
  Synthetic Peptide
TYSTYGKFL

SEQ ID NO: 3854 - protein, 10 aa, Artificial Sequence
  Synthetic Peptide
VYMIMVKCWM

SEQ ID NO: 3855 - protein, 9 aa, Artificial Sequence
  Synthetic Peptide
RFRELVSEF

SEQ ID NO: 3856 - protein, 9 aa, Artificial Sequence
  Synthetic Peptide
CYGLGMEHL

SEQ ID NO: 3857 - protein, 10 aa, Artificial Sequence
  Synthetic Peptide
QYSPGQRVEF

SEQ ID NO: 3858 - protein, 9 aa, Artificial Sequence
  Synthetic Peptide
KWMALESIL

SEQ ID NO: 3859 - protein, 10 aa, Artificial Sequence
  Synthetic Peptide
EYLVPQQGFF

SEQ ID NO: 3860 - protein, 10 aa, Artificial Sequence
  Synthetic Peptide
RYSEDPTVPL

SEQ ID NO: 3861 - protein, 9 aa, Artificial Sequence
  Synthetic Peptide
RFTHQSDVW

SEQ ID NO: 3862 - protein, 10 aa, Artificial Sequence
  Synthetic Peptide
IHDIILECVY

SEQ ID NO: 3863 - protein, 9 aa, Artificial Sequence
  Synthetic Peptide
VCDKCLKFY

SEQ ID NO: 3864 - protein, 10 aa, Artificial Sequence
  Synthetic Peptide
YSKISEYRHY

SEQ ID NO: 3865 - protein, 9 aa, Artificial Sequence
  Synthetic Peptide
ISEYRHYCY

SEQ ID NO: 3866 - protein, 10 aa, Artificial Sequence
  Synthetic Peptide
GTTLEQQYNK

SEQ ID NO: 3867 - protein, 9 aa, Artificial Sequence
  Synthetic Peptide
TTLEQQYNK

SEQ ID NO: 3868 - protein, 10 aa, Artificial Sequence
  Synthetic Peptide
LLIRCINCQK

SEQ ID NO: 3869 - protein, 10 aa, Artificial Sequence
  Synthetic Peptide
HGDTPTLHEY

SEQ ID NO: 3870 - protein, 10 aa, Artificial Sequence
  Synthetic Peptide
QPETTDLYCY

SEQ ID NO: 3871 - protein, 9 aa, Artificial Sequence
  Synthetic Peptide
QAEPDRAHY

SEQ ID NO: 3872 - protein, 9 aa, Artificial Sequence
  Synthetic Peptide
IVCPICSQK

SEQ ID NO: 3873 - protein, 10 aa, Artificial Sequence
  Synthetic Peptide
RFEDPTRRPY

SEQ ID NO: 3874 - protein, 9 aa, Artificial Sequence
  Synthetic Peptide
FEDPTRRPY

SEQ ID NO: 3875 - protein, 10 aa, Artificial Sequence
  Synthetic Peptide
LQDIEITCVY

SEQ ID NO: 3876 - protein, 10 aa, Artificial Sequence
  Synthetic Peptide
LTEVFEFAFK

SEQ ID NO: 3877 - protein, 10 aa, Artificial Sequence
  Synthetic Peptide
YSRIRELRHY

SEQ ID NO: 3878 - protein, 9 aa, Artificial Sequence
  Synthetic Peptide
SVYGDTLEK

SEQ ID NO: 3879 - protein, 10 aa, Artificial Sequence
  Synthetic Peptide
LLIRCLRCQK

SEQ ID NO: 3880 - protein, 9 aa, Artificial Sequence
  Synthetic Peptide
HTMLCMCCK

SEQ ID NO: 3881 - protein, 9 aa, Artificial Sequence
  Synthetic Peptide
HSNLNDTTY

SEQ ID NO: 3882 - protein, 9 aa, Artificial Sequence
  Synthetic Peptide
FVEALFQEY

SEQ ID NO: 3883 - protein, 9 aa, Artificial Sequence
  Synthetic Peptide
AADAAAAAY

SEQ ID NO: 3884 - protein, 9 aa, Artificial Sequence
  Synthetic Peptide
DADAAAAAY

SEQ ID NO: 3885 - protein, 9 aa, Artificial Sequence
  Synthetic Peptide
AADSAAAAY

SEQ ID NO: 3886 - protein, 9 aa, Artificial Sequence
  Synthetic Peptide
AADAPAAAY

SEQ ID NO: 3887 - protein, 9 aa, Artificial Sequence
  Synthetic Peptide
AADAAAQAY

SEQ ID NO: 3888 - protein, 9 aa, Artificial Sequence
  Synthetic Peptide
QADAAAAAY

SEQ ID NO: 3889 - protein, 9 aa, Artificial Sequence
  Synthetic Peptide
AADADAAAY

SEQ ID NO: 3890 - protein, 9 aa, Artificial Sequence
  Synthetic Peptide
AADAGAAAY

SEQ ID NO: 3891 - protein, 9 aa, Artificial Sequence
  Synthetic Peptide
AADAAKAAY

SEQ ID NO: 3892 - protein, 9 aa, Artificial Sequence
  Synthetic Peptide
AADAAAPAY

SEQ ID NO: 3893 - protein, 9 aa, Artificial Sequence
  Synthetic Peptide
AADAAAAPY

SEQ ID NO: 3894 - protein, 9 aa, Artificial Sequence
  Synthetic Peptide
ATAAAAAAY

SEQ ID NO: 3895 - protein, 9 aa, Artificial Sequence
  Synthetic Peptide
DTAAAAAAY

SEQ ID NO: 3896 - protein, 9 aa, Artificial Sequence
  Synthetic Peptide
ATASAAAAY

SEQ ID NO: 3897 - protein, 9 aa, Artificial Sequence
  Synthetic Peptide
ATAAPAAAY

SEQ ID NO: 3898 - protein, 9 aa, Artificial Sequence
  Synthetic Peptide
ATAAAAQAY

SEQ ID NO: 3899 - protein, 9 aa, Artificial Sequence
  Synthetic Peptide
ATAAAAAKY

SEQ ID NO: 3900 - protein, 9 aa, Artificial Sequence
  Synthetic Peptide
QTAAAAAAY

SEQ ID NO: 3901 - protein, 9 aa, Artificial Sequence
  Synthetic Peptide
ATAADAAAY

SEQ ID NO: 3902 - protein, 9 aa, Artificial Sequence
  Synthetic Peptide
ATAAGAAAY

SEQ ID NO: 3903 - protein, 9 aa, Artificial Sequence
  Synthetic Peptide
ATAAAKAAY

SEQ ID NO: 3904 - protein, 9 aa, Artificial Sequence
  Synthetic Peptide
ATAAAAPAY

SEQ ID NO: 3905 - protein, 9 aa, Artificial Sequence
  Synthetic Peptide
ATAAAAAPY

SEQ ID NO: 3906 - protein, 9 aa, Artificial Sequence
  Synthetic Peptide
TYLISSIPL

SEQ ID NO: 3907 - protein, 9 aa, Artificial Sequence
  Synthetic Peptide
FYTNRTVQI

SEQ ID NO: 3908 - protein, 10 aa, Artificial Sequence
  Synthetic Peptide
PLQGAFNYKY

SEQ ID NO: 3909 - protein, 10 aa, Artificial Sequence
  Synthetic Peptide
LCDDNPKTFY

SEQ ID NO: 3910 - protein, 9 aa, Artificial Sequence
  Synthetic Peptide
TTNLRPTTY

SEQ ID NO: 3911 - protein, 9 aa, Artificial Sequence
  Synthetic Peptide
CLELAEYLY

SEQ ID NO: 3912 - protein, 9 aa, Artificial Sequence
  Synthetic Peptide
LLSPRPISY

SEQ ID NO: 3913 - protein, 9 aa, Artificial Sequence
  Synthetic Peptide
LLSPRPVSY

SEQ ID NO: 3914 - protein, 9 aa, Artificial Sequence
  Synthetic Peptide
PTVTVFHVY

SEQ ID NO: 3915 - protein, 9 aa, Artificial Sequence
  Synthetic Peptide
ETAGRHVGY

SEQ ID NO: 3916 - protein, 9 aa, Artificial Sequence
  Synthetic Peptide
GSGPELLFY

SEQ ID NO: 3917 - protein, 9 aa, Artificial Sequence
  Synthetic Peptide
LSPQWVADY

SEQ ID NO: 3918 - protein, 9 aa, Artificial Sequence
  Synthetic Peptide
VVERTDVYY

SEQ ID NO: 3919 - protein, 9 aa, Artificial Sequence
  Synthetic Peptide
SLEHTLCTY

SEQ ID NO: 3920 - protein, 9 aa, Artificial Sequence
  Synthetic Peptide
PSQRHGSKY

SEQ ID NO: 3921 - protein, 9 aa, Artificial Sequence
  Synthetic Peptide
CSAVPVYIY

SEQ ID NO: 3922 - protein, 9 aa, Artificial Sequence
  Synthetic Peptide
LTFMIAATY

SEQ ID NO: 3923 - protein, 9 aa, Artificial Sequence
  Synthetic Peptide
GTASFFFLY

SEQ ID NO: 3924 - protein, 9 aa, Artificial Sequence
  Synthetic Peptide
GTEKLIETY

SEQ ID NO: 3925 - protein, 9 aa, Artificial Sequence
  Synthetic Peptide
TTWCSQTSY

SEQ ID NO: 3926 - protein, 9 aa, Artificial Sequence
  Synthetic Peptide
RTWENHCTY

SEQ ID NO: 3927 - protein, 9 aa, Artificial Sequence
  Synthetic Peptide
QSSINISGY

SEQ ID NO: 3928 - protein, 9 aa, Artificial Sequence
  Synthetic Peptide
ITEMLRKDY

SEQ ID NO: 3929 - protein, 9 aa, Artificial Sequence
  Synthetic Peptide
QSSFYSDWY

SEQ ID NO: 3930 - protein, 9 aa, Artificial Sequence
  Synthetic Peptide
SSALTLAIY

SEQ ID NO: 3931 - protein, 9 aa, Artificial Sequence
  Synthetic Peptide
ATWLGDDGY

SEQ ID NO: 3932 - protein, 9 aa, Artificial Sequence
  Synthetic Peptide
QSTSINLPY

SEQ ID NO: 3933 - protein, 9 aa, Artificial Sequence
  Synthetic Peptide
QSSFYSDWY

SEQ ID NO: 3934 - protein, 9 aa, Artificial Sequence
  Synthetic Peptide
YAELMTADY

SEQ ID NO: 3935 - protein, 9 aa, Artificial Sequence
  Synthetic Peptide
STNEVTRIY

SEQ ID NO: 3936 - protein, 9 aa, Artificial Sequence
  Synthetic Peptide
RVDCTPLMY

SEQ ID NO: 3937 - protein, 9 aa, Artificial Sequence
  Synthetic Peptide
RGRRQPIPK

SEQ ID NO: 3938 - protein, 9 aa, Artificial Sequence
  Synthetic Peptide
KTKRNTNRR

SEQ ID NO: 3939 - protein, 9 aa, Artificial Sequence
  Synthetic Peptide
LGFGAYMSK

SEQ ID NO: 3940 - protein, 9 aa, Artificial Sequence
  Synthetic Peptide
VAGALVAFK

SEQ ID NO: 3941 - protein, 9 aa, Artificial Sequence
  Synthetic Peptide
NFISGIQYL

SEQ ID NO: 3942 - protein, 9 aa, Artificial Sequence
  Synthetic Peptide
FWAKHMWNF

SEQ ID NO: 3943 - protein, 10 aa, Artificial Sequence
  Synthetic Peptide
EVDGVRLHRY

SEQ ID NO: 3944 - protein, 10 aa, Artificial Sequence
  Synthetic Peptide
DLSGWFVAGY

SEQ ID NO: 3945 - protein, 10 aa, Artificial Sequence
  Synthetic Peptide
AACNWTRGER

SEQ ID NO: 3946 - protein, 9 aa, Artificial Sequence
  Synthetic Peptide
KVYLAWVPA

SEQ ID NO: 3947 - protein, 9 aa, Artificial Sequence
  Synthetic Peptide
TLFCASDAK

SEQ ID NO: 3948 - protein, 9 aa, Artificial Sequence
  Synthetic Peptide
ISLWDQSLK

SEQ ID NO: 3949 - protein, 9 aa, Artificial Sequence
  Synthetic Peptide
RIVELLGRR

SEQ ID NO: 3950 - protein, 9 aa, Artificial Sequence
  Synthetic Peptide
MVHQAISPR

SEQ ID NO: 3951 - protein, 9 aa, Artificial Sequence
  Synthetic Peptide
TIKIGGQLK

SEQ ID NO: 3952 - protein, 9 aa, Artificial Sequence
  Synthetic Peptide
KLVSAGIRK

SEQ ID NO: 3953 - protein, 9 aa, Artificial Sequence
  Synthetic Peptide
KGLGISYGR

SEQ ID NO: 3954 - protein, 9 aa, Artificial Sequence
  Synthetic Peptide
GLGISYGRK

SEQ ID NO: 3955 - protein, 9 aa, Artificial Sequence
  Synthetic Peptide
VMIVWQVDR

SEQ ID NO: 3956 - protein, 9 aa, Artificial Sequence
  Synthetic Peptide
QMAVFIHNF

SEQ ID NO: 3957 - protein, 9 aa, Artificial Sequence
  Synthetic Peptide
SMTKILEPF

SEQ ID NO: 3958 - protein, 9 aa, Artificial Sequence
  Synthetic Peptide
IWGCSGKLI

SEQ ID NO: 3959 - protein, 9 aa, Artificial Sequence
  Synthetic Peptide
LYKYKVVKI

SEQ ID NO: 3960 - protein, 9 aa, Artificial Sequence
  Synthetic Peptide
VWKEATTTL

SEQ ID NO: 3961 - protein, 9 aa, Artificial Sequence
  Synthetic Peptide
GWMTNNPPI

SEQ ID NO: 3962 - protein, 9 aa, Artificial Sequence
  Synthetic Peptide
RFAVNPGLL

SEQ ID NO: 3963 - protein, 9 aa, Artificial Sequence
  Synthetic Peptide
PYNTPVFAI

SEQ ID NO: 3964 - protein, 9 aa, Artificial Sequence
  Synthetic Peptide
WWAGIKQEF

SEQ ID NO: 3965 - protein, 9 aa, Artificial Sequence
  Synthetic Peptide
LWQRPLVTI

SEQ ID NO: 3966 - protein, 9 aa, Artificial Sequence
  Synthetic Peptide
IYETYGDTW

SEQ ID NO: 3967 - protein, 9 aa, Artificial Sequence
  Synthetic Peptide
PYNEWTLEL

SEQ ID NO: 3968 - protein, 10 aa, Artificial Sequence
  Synthetic Peptide
ILQQLLFIHF

SEQ ID NO: 3969 - protein, 10 aa, Artificial Sequence
  Synthetic Peptide
TTLFCASDAK

SEQ ID NO: 3970 - protein, 10 aa, Artificial Sequence
  Synthetic Peptide
LLGIWGCSGK

SEQ ID NO: 3971 - protein, 10 aa, Artificial Sequence
  Synthetic Peptide
IISLWDQSLK

SEQ ID NO: 3972 - protein, 10 aa, Artificial Sequence
  Synthetic Peptide
LLQLTVWGIK

SEQ ID NO: 3973 - protein, 10 aa, Artificial Sequence
  Synthetic Peptide
SILDIRQGPK

SEQ ID NO: 3974 - protein, 10 aa, Artificial Sequence
  Synthetic Peptide
QMVHQAISPR

SEQ ID NO: 3975 - protein, 10 aa, Artificial Sequence
  Synthetic Peptide
TAVQMAVFIH

SEQ ID NO: 3976 - protein, 10 aa, Artificial Sequence
  Synthetic Peptide
ISPIETVPVK

SEQ ID NO: 3977 - protein, 10 aa, Artificial Sequence
  Synthetic Peptide
LGIPHPAGLK

SEQ ID NO: 3978 - protein, 10 aa, Artificial Sequence
  Synthetic Peptide
PAIFQSSMTK

SEQ ID NO: 3979 - protein, 10 aa, Artificial Sequence
  Synthetic Peptide
KVYLAWVPAH

SEQ ID NO: 3980 - protein, 10 aa, Artificial Sequence
  Synthetic Peptide
DIIATDIQTK

SEQ ID NO: 3981 - protein, 10 aa, Artificial Sequence
  Synthetic Peptide
VTIKIGGQLK

SEQ ID NO: 3982 - protein, 10 aa, Artificial Sequence
  Synthetic Peptide
KAACWWAGIK

SEQ ID NO: 3983 - protein, 10 aa, Artificial Sequence
  Synthetic Peptide
VSQIIEQLIK

SEQ ID NO: 3984 - protein, 10 aa, Artificial Sequence
  Synthetic Peptide
KGLGISYGRK

SEQ ID NO: 3985 - protein, 10 aa, Artificial Sequence
  Synthetic Peptide
VWKEATTTLF

SEQ ID NO: 3986 - protein, 10 aa, Artificial Sequence
  Synthetic Peptide
YWQATWIPEW

SEQ ID NO: 3987 - protein, 10 aa, Artificial Sequence
  Synthetic Peptide
VYYDPSKDLI

SEQ ID NO: 3988 - protein, 9 aa, Artificial Sequence
  Synthetic Peptide
ALAAGAAAR

SEQ ID NO: 3989 - protein, 9 aa, Artificial Sequence
  Synthetic Peptide
AAAAGAAAK

SEQ ID NO: 3990 - protein, 9 aa, Artificial Sequence
  Synthetic Peptide
AFLPWHRLF

SEQ ID NO: 3991 - protein, 9 aa, Artificial Sequence
  Synthetic Peptide
AYGLDFYIL

SEQ ID NO: 3992 - protein, 9 aa, Artificial Sequence
  Synthetic Peptide
FLWTQSLRR

SEQ ID NO: 3993 - protein, 9 aa, Artificial Sequence
  Synthetic Peptide
GIPYCNYSK

SEQ ID NO: 3994 - protein, 9 aa, Artificial Sequence
  Synthetic Peptide
GVVRVWDVK

SEQ ID NO: 3995 - protein, 9 aa, Artificial Sequence
  Synthetic Peptide
MLRLFDFNK

SEQ ID NO: 3996 - protein, 9 aa, Artificial Sequence
  Synthetic Peptide
RTRDIYISR

SEQ ID NO: 3997 - protein, 9 aa, Artificial Sequence
  Synthetic Peptide
SAVIDALPR

SEQ ID NO: 3998 - protein, 9 aa, Artificial Sequence
  Synthetic Peptide
SVLRAVLPR

SEQ ID NO: 3999 - protein, 9 aa, Artificial Sequence
  Synthetic Peptide
VTFLLLCGR

SEQ ID NO: 4000 - protein, 10 aa, Artificial Sequence
  Synthetic Peptide
AMSCDFNGGK

SEQ ID NO: 4001 - protein, 10 aa, Artificial Sequence
  Synthetic Peptide
GSYIALDSGR

SEQ ID NO: 4002 - protein, 10 aa, Artificial Sequence
  Synthetic Peptide
KSFLWTQSLR

SEQ ID NO: 4003 - protein, 10 aa, Artificial Sequence
  Synthetic Peptide
LTYSQLMTLK

SEQ ID NO: 4004 - protein, 10 aa, Artificial Sequence
  Synthetic Peptide
RTRDIYISRR

SEQ ID NO: 4005 - protein, 9 aa, Artificial Sequence
  Synthetic Peptide
YRHLLCLER

SEQ ID NO: 4006 - protein, 10 aa, Artificial Sequence
  Synthetic Peptide
GTYEGLLRRR

SEQ ID NO: 4007 - protein, 9 aa, Artificial Sequence
  Synthetic Peptide
LLRRNQMGR

SEQ ID NO: 4008 - protein, 9 aa, Artificial Sequence
  Synthetic Peptide
FQNSTFSFR

SEQ ID NO: 4009 - protein, 9 aa, Artificial Sequence
  Synthetic Peptide
LLAFLQYRR

SEQ ID NO: 4010 - protein, 9 aa, Artificial Sequence
  Synthetic Peptide
DLVGFLLLK

SEQ ID NO: 4011 - protein, 9 aa, Artificial Sequence
  Synthetic Peptide
QLVFGIDVK

SEQ ID NO: 4012 - protein, 10 aa, Artificial Sequence
  Synthetic Peptide
SLEQRSLHCK

SEQ ID NO: 4013 - protein, 10 aa, Artificial Sequence
  Synthetic Peptide
SLFRAVITKK

SEQ ID NO: 4014 - protein, 10 aa, Artificial Sequence
  Synthetic Peptide
DLVGFLLLKY

SEQ ID NO: 4015 - protein, 10 aa, Artificial Sequence
  Synthetic Peptide
MLESVIKNYK

SEQ ID NO: 4016 - protein, 11 aa, Artificial Sequence
  Synthetic Peptide
WEELSVIKNYK

SEQ ID NO: 4017 - protein, 10 aa, Artificial Sequence
  Synthetic Peptide
VYDGREHSAY

SEQ ID NO: 4018 - protein, 9 aa, Artificial Sequence
  Synthetic Peptide
LVGFLLLKY

SEQ ID NO: 4019 - protein, 9 aa, Artificial Sequence
  Synthetic Peptide
LVTCLGLSY

SEQ ID NO: 4020 - protein, 10 aa, Artificial Sequence
  Synthetic Peptide
VLVTCLGLSY

SEQ ID NO: 4021 - protein, 9 aa, Artificial Sequence
  Synthetic Peptide
FLLLKYRAR

SEQ ID NO: 4022 - protein, 10 aa, Artificial Sequence
  Synthetic Peptide
PTTINFTRQR

SEQ ID NO: 4023 - protein, 10 aa, Artificial Sequence
  Synthetic Peptide
LVGFLLLKYR

SEQ ID NO: 4024 - protein, 10 aa, Artificial Sequence
  Synthetic Peptide
EKYLEYGRCR

SEQ ID NO: 4025 - protein, 9 aa, Artificial Sequence
  Synthetic Peptide
ELVHFLLLK

SEQ ID NO: 4026 - protein, 9 aa, Artificial Sequence
  Synthetic Peptide
AYGEPRKLL

SEQ ID NO: 4027 - protein, 10 aa, Artificial Sequence
  Synthetic Peptide
SYVLVTCLGL

SEQ ID NO: 4028 - protein, 9 aa, Artificial Sequence
  Synthetic Peptide
EVVPISHLY

SEQ ID NO: 4029 - protein, 9 aa, Artificial Sequence
  Synthetic Peptide
EVVRIGHLY

SEQ ID NO: 4030 - protein, 9 aa, Artificial Sequence
  Synthetic Peptide
EVDPASNTY

SEQ ID NO: 4031 - protein, 9 aa, Artificial Sequence
  Synthetic Peptide
EADPTSNTY

SEQ ID NO: 4032 - protein, 9 aa, Artificial Sequence
  Synthetic Peptide
EVDPIGHVY

SEQ ID NO: 4033 - protein, 8 aa, Artificial Sequence
  Synthetic Peptide
EMLESVIK

SEQ ID NO: 4034 - protein, 8 aa, Artificial Sequence
  Synthetic Peptide
LVFGIDVK

SEQ ID NO: 4035 - protein, 8 aa, Artificial Sequence
  Synthetic Peptide
GVQGPSLK

SEQ ID NO: 4036 - protein, 8 aa, Artificial Sequence
  Synthetic Peptide
VMEVYDGR

SEQ ID NO: 4037 - protein, 8 aa, Artificial Sequence
  Synthetic Peptide
VQEKYLEY

SEQ ID NO: 4038 - protein, 9 aa, Artificial Sequence
  Synthetic Peptide
AYGEPRKLL

SEQ ID NO: 4039 - protein, 11 aa, Artificial Sequence
  Synthetic Peptide
VKEADPTGHSY

SEQ ID NO: 4040 - protein, 11 aa, Artificial Sequence
  Synthetic Peptide
IWEELSVMEVY

SEQ ID NO: 4041 - protein, 11 aa, Artificial Sequence
  Synthetic Peptide
EMLESVIKNYK

SEQ ID NO: 4042 - protein, 9 aa, Artificial Sequence
  Synthetic Peptide
EADPTSHTY

SEQ ID NO: 4043 - protein, 9 aa, Artificial Sequence
  Synthetic Peptide
EVDPTSNTY

SEQ ID NO: 4044 - protein, 9 aa, Artificial Sequence
  Synthetic Peptide
EALEAQQEA

SEQ ID NO: 4045 - protein, 9 aa, Artificial Sequence
  Synthetic Peptide
MSELQRSLH

SEQ ID NO: 4046 - protein, 8 aa, Artificial Sequence
  Synthetic Peptide
QSPQASAF

SEQ ID NO: 4047 - protein, 9 aa, Artificial Sequence
  Synthetic Peptide
SAFPTTINF

SEQ ID NO: 4048 - protein, 9 aa, Artificial Sequence
  Synthetic Peptide
TSCILESLF

SEQ ID NO: 4049 - protein, 9 aa, Artificial Sequence
  Synthetic Peptide
SCILESLFR

SEQ ID NO: 4050 - protein, 9 aa, Artificial Sequence
  Synthetic Peptide
LFRAVITKK

SEQ ID NO: 4051 - protein, 9 aa, Artificial Sequence
  Synthetic Peptide
VGFLLLKYR

SEQ ID NO: 4052 - protein, 9 aa, Artificial Sequence
  Synthetic Peptide
ESVIKNYKH

SEQ ID NO: 4053 - protein, 9 aa, Artificial Sequence
  Synthetic Peptide
VIKNYKHCF

SEQ ID NO: 4054 - protein, 9 aa, Artificial Sequence
  Synthetic Peptide
ASESLQLVF

SEQ ID NO: 4055 - protein, 9 aa, Artificial Sequence
  Synthetic Peptide
LGDNQIMPK

SEQ ID NO: 4056 - protein, 9 aa, Artificial Sequence
  Synthetic Peptide
VMIAMEGGH

SEQ ID NO: 4057 - protein, 9 aa, Artificial Sequence
  Synthetic Peptide
YDGREHSAY

SEQ ID NO: 4058 - protein, 9 aa, Artificial Sequence
  Synthetic Peptide
LTQDLVQEK

SEQ ID NO: 4059 - protein, 9 aa, Artificial Sequence
  Synthetic Peptide
CGVQGPSLK

SEQ ID NO: 4060 - protein, 11 aa, Artificial Sequence
  Synthetic Peptide
EMLESVIKNYK

SEQ ID NO: 4061 - protein, 10 aa, Artificial Sequence
  Synthetic Peptide
KEADPTGHSY

SEQ ID NO: 4062 - protein, 10 aa, Artificial Sequence
  Synthetic Peptide
ASAFPTTINF

SEQ ID NO: 4063 - protein, 10 aa, Artificial Sequence
  Synthetic Peptide
AFPTTINFTR

SEQ ID NO: 4064 - protein, 10 aa, Artificial Sequence
  Synthetic Peptide
PTTINFTRQR

SEQ ID NO: 4065 - protein, 10 aa, Artificial Sequence
  Synthetic Peptide
STSCILESLF

SEQ ID NO: 4066 - protein, 9 aa, Artificial Sequence
  Synthetic Peptide
GFLLKYRAR

SEQ ID NO: 4067 - protein, 10 aa, Artificial Sequence
  Synthetic Peptide
KAEMLESVIK

SEQ ID NO: 4068 - protein, 10 aa, Artificial Sequence
  Synthetic Peptide
SVIKNYKHCF

SEQ ID NO: 4069 - protein, 10 aa, Artificial Sequence
  Synthetic Peptide
KASESLQLVF

SEQ ID NO: 4070 - protein, 10 aa, Artificial Sequence
  Synthetic Peptide
DVKEADPTGH

SEQ ID NO: 4071 - protein, 10 aa, Artificial Sequence
  Synthetic Peptide
LVMIAMEGGH

SEQ ID NO: 4072 - protein, 10 aa, Artificial Sequence
  Synthetic Peptide
LSVMEVYDGR

SEQ ID NO: 4073 - protein, 10 aa, Artificial Sequence
  Synthetic Peptide
VMEVYDGREH

SEQ ID NO: 4074 - protein, 10 aa, Artificial Sequence
  Synthetic Peptide
YGRCRTVIPH

SEQ ID NO: 4075 - protein, 10 aa, Artificial Sequence
  Synthetic Peptide
SCGVQGPSLK

SEQ ID NO: 4076 - protein, 9 aa, Artificial Sequence
  Synthetic Peptide
VPDSDPARY

SEQ ID NO: 4077 - protein, 9 aa, Artificial Sequence
  Synthetic Peptide
GVPDSDPAR

SEQ ID NO: 4078 - protein, 9 aa, Artificial Sequence
  Synthetic Peptide
VIKVSARVR

SEQ ID NO: 4079 - protein, 9 aa, Artificial Sequence
  Synthetic Peptide
PSLREAALR

SEQ ID NO: 4080 - protein, 9 aa, Artificial Sequence
  Synthetic Peptide
EFLWGPRAL

SEQ ID NO: 4081 - protein, 10 aa, Artificial Sequence
  Synthetic Peptide
ETSYVKVLEY

SEQ ID NO: 4082 - protein, 10 aa, Artificial Sequence
  Synthetic Peptide
LVQEKYLEYR

SEQ ID NO: 4083 - protein, 10 aa, Artificial Sequence
  Synthetic Peptide
QVPDSDPARY

SEQ ID NO: 4084 - protein, 10 aa, Artificial Sequence
  Synthetic Peptide
YVKVLEYVIK

SEQ ID NO: 4085 - protein, 10 aa, Artificial Sequence
  Synthetic Peptide
YVIKVSARVR

SEQ ID NO: 4086 - protein, 10 aa, Artificial Sequence
  Synthetic Peptide
RALAETSYVK

SEQ ID NO: 4087 - protein, 10 aa, Artificial Sequence
  Synthetic Peptide
SYVKVLEYVI

SEQ ID NO: 4088 - protein, 10 aa, Artificial Sequence
  Synthetic Peptide
FFPSLREAAL

SEQ ID NO: 4089 - protein, 10 aa, Artificial Sequence
  Synthetic Peptide
SVIKNYKHCF

SEQ ID NO: 4090 - protein, 13 aa, Artificial Sequence
  Synthetic Peptide
PVTKAEMLESVIK

SEQ ID NO: 4091 - protein, 13 aa, Artificial Sequence
  Synthetic Peptide
ETSYVKVLEYVIK

SEQ ID NO: 4092 - protein, 15 aa, Artificial Sequence
  Synthetic Peptide
ITKKVADLVGFLLLK

SEQ ID NO: 4093 - protein, 15 aa, Artificial Sequence
  Synthetic Peptide
VTKAEMLESVIKNYK

SEQ ID NO: 4094 - protein, 15 aa, Artificial Sequence
  Synthetic Peptide
VVGNWQYFFPVIFSK

SEQ ID NO: 4095 - protein, 9 aa, Artificial Sequence
  Synthetic Peptide
PRALAETSY

SEQ ID NO: 4096 - protein, 9 aa, Artificial Sequence
  Synthetic Peptide
FATCLGLSY

SEQ ID NO: 4097 - protein, 9 aa, Artificial Sequence
  Synthetic Peptide
LEQRSLHCK

SEQ ID NO: 4098 - protein, 9 aa, Artificial Sequence
  Synthetic Peptide
AEMLESVIK

SEQ ID NO: 4099 - protein, 9 aa, Artificial Sequence
  Synthetic Peptide
LESVIKNYK

SEQ ID NO: 4100 - protein, 9 aa, Artificial Sequence
  Synthetic Peptide
EELSVMEVY

SEQ ID NO: 4101 - protein, 9 aa, Artificial Sequence
  Synthetic Peptide
MEVYDGREH

SEQ ID NO: 4102 - protein, 9 aa, Artificial Sequence
  Synthetic Peptide
DSDPARYEF

SEQ ID NO: 4103 - protein, 9 aa, Artificial Sequence
  Synthetic Peptide
KVSARVRFF

SEQ ID NO: 4104 - protein, 9 aa, Artificial Sequence
  Synthetic Peptide
VSARVRFFF

SEQ ID NO: 4105 - protein, 9 aa, Artificial Sequence
  Synthetic Peptide
HSPQGASSF

SEQ ID NO: 4106 - protein, 9 aa, Artificial Sequence
  Synthetic Peptide
TTINYTLWR

SEQ ID NO: 4107 - protein, 9 aa, Artificial Sequence
  Synthetic Peptide
QEEEGPRMF

SEQ ID NO: 4108 - protein, 9 aa, Artificial Sequence
  Synthetic Peptide
MFPDLESEF

SEQ ID NO: 4109 - protein, 9 aa, Artificial Sequence
  Synthetic Peptide
SEFQAAISR

SEQ ID NO: 4110 - protein, 9 aa, Artificial Sequence
  Synthetic Peptide
EFQAAISRK

SEQ ID NO: 4111 - protein, 9 aa, Artificial Sequence
  Synthetic Peptide
LVHFLLLKY

SEQ ID NO: 4112 - protein, 9 aa, Artificial Sequence
  Synthetic Peptide
AEMLESVLR

SEQ ID NO: 4113 - protein, 9 aa, Artificial Sequence
  Synthetic Peptide
SVLRNCQDF

SEQ ID NO: 4114 - protein, 9 aa, Artificial Sequence
  Synthetic Peptide
VLRNCQDFF

SEQ ID NO: 4115 - protein, 9 aa, Artificial Sequence
  Synthetic Peptide
DFFPVIFSK

SEQ ID NO: 4116 - protein, 9 aa, Artificial Sequence
  Synthetic Peptide
VIFSKASEY

SEQ ID NO: 4117 - protein, 9 aa, Artificial Sequence
  Synthetic Peptide
VVEVVPISH

SEQ ID NO: 4118 - protein, 9 aa, Artificial Sequence
  Synthetic Peptide
LGDNQVMPK

SEQ ID NO: 4119 - protein, 9 aa, Artificial Sequence
  Synthetic Peptide
EGDCAPEEK

SEQ ID NO: 4120 - protein, 9 aa, Artificial Sequence
  Synthetic Peptide
QEEEGPSTF

SEQ ID NO: 4121 - protein, 9 aa, Artificial Sequence
  Synthetic Peptide
TFPDLESEF

SEQ ID NO: 4122 - protein, 9 aa, Artificial Sequence
  Synthetic Peptide
SEFQAALSR

SEQ ID NO: 4123 - protein, 9 aa, Artificial Sequence
  Synthetic Peptide
EFQAALSRK

SEQ ID NO: 4124 - protein, 9 aa, Artificial Sequence
  Synthetic Peptide
SVVGNWQYF

SEQ ID NO: 4125 - protein, 9 aa, Artificial Sequence
  Synthetic Peptide
VVGNWQYFF

SEQ ID NO: 4126 - protein, 9 aa, Artificial Sequence
  Synthetic Peptide
YFFPVIFSK

SEQ ID NO: 4127 - protein, 9 aa, Artificial Sequence
  Synthetic Peptide
ASSSLQLVF

SEQ ID NO: 4128 - protein, 9 aa, Artificial Sequence
  Synthetic Peptide
LMEVDPIGH

SEQ ID NO: 4129 - protein, 9 aa, Artificial Sequence
  Synthetic Peptide
IIVLAIIAR

SEQ ID NO: 4130 - protein, 9 aa, Artificial Sequence
  Synthetic Peptide
VQEKYLERY

SEQ ID NO: 4131 - protein, 8 aa, Artificial Sequence
  Synthetic Peptide
SNQEEGPR

SEQ ID NO: 4132 - protein, 9 aa, Artificial Sequence
  Synthetic Peptide
NYKHCFPEI

SEQ ID NO: 4133 - protein, 9 aa, Artificial Sequence
  Synthetic Peptide
IFGKASESL

SEQ ID NO: 4134 - protein, 9 aa, Artificial Sequence
  Synthetic Peptide
GFLIIVLVM

SEQ ID NO: 4135 - protein, 9 aa, Artificial Sequence
  Synthetic Peptide
IFSKASEYL

SEQ ID NO: 4136 - protein, 9 aa, Artificial Sequence
  Synthetic Peptide
EYLQLVFGI

SEQ ID NO: 4137 - protein, 9 aa, Artificial Sequence
  Synthetic Peptide
NWQYFFPVI

SEQ ID NO: 4138 - protein, 9 aa, Artificial Sequence
  Synthetic Peptide
IFSKASSSL

SEQ ID NO: 4139 - protein, 10 aa, Artificial Sequence
  Synthetic Peptide
LGSVVGNWQY

SEQ ID NO: 4140 - protein, 10 aa, Artificial Sequence
  Synthetic Peptide
IFATCLGLSY

SEQ ID NO: 4141 - protein, 10 aa, Artificial Sequence
  Synthetic Peptide
TSCILESLFR

SEQ ID NO: 4142 - protein, 10 aa, Artificial Sequence
  Synthetic Peptide
LESVIKNYKH

SEQ ID NO: 4143 - protein, 10 aa, Artificial Sequence
  Synthetic Peptide
REHSAYGEPR

SEQ ID NO: 4144 - protein, 10 aa, Artificial Sequence
  Synthetic Peptide
PDSDPARYEF

SEQ ID NO: 4145 - protein, 10 aa, Artificial Sequence
  Synthetic Peptide
LEYVIKVSAR

SEQ ID NO: 4146 - protein, 10 aa, Artificial Sequence
  Synthetic Peptide
VIKVSARVRF

SEQ ID NO: 4147 - protein, 10 aa, Artificial Sequence
  Synthetic Peptide
KVSARVRFFF

SEQ ID NO: 4148 - protein, 10 aa, Artificial Sequence
  Synthetic Peptide
STTINYTLWR

SEQ ID NO: 4149 - protein, 10 aa, Artificial Sequence
  Synthetic Peptide
SSNQEEEGPR

SEQ ID NO: 4150 - protein, 11 aa, Artificial Sequence
  Synthetic Peptide
RMFPDLESSEF

SEQ ID NO: 4151 - protein, 10 aa, Artificial Sequence
  Synthetic Peptide
ESEFQAAISR

SEQ ID NO: 4152 - protein, 10 aa, Artificial Sequence
  Synthetic Peptide
SEFQAAISRK

SEQ ID NO: 4153 - protein, 10 aa, Artificial Sequence
  Synthetic Peptide
ISRKMVELVH

SEQ ID NO: 4154 - protein, 10 aa, Artificial Sequence
  Synthetic Peptide
VELVHFLLLK

SEQ ID NO: 4155 - protein, 10 aa, Artificial Sequence
  Synthetic Peptide
ELVHFLLLKY

SEQ ID NO: 4156 - protein, 10 aa, Artificial Sequence
  Synthetic Peptide
LVHFLLLKYR

SEQ ID NO: 4157 - protein, 10 aa, Artificial Sequence
  Synthetic Peptide
HFLLLKYRAR

SEQ ID NO: 4158 - protein, 10 aa, Artificial Sequence
  Synthetic Peptide
KAEMLESVLR

SEQ ID NO: 4159 - protein, 10 aa, Artificial Sequence
  Synthetic Peptide
ESVLRNCQDR

SEQ ID NO: 4160 - protein, 10 aa, Artificial Sequence
  Synthetic Peptide
SVLRNCQDFF

SEQ ID NO: 4161 - protein, 10 aa, Artificial Sequence
  Synthetic Peptide
NCQDFFPVIF

SEQ ID NO: 4162 - protein, 10 aa, Artificial Sequence
  Synthetic Peptide
QDFFPVIFSK

SEQ ID NO: 4163 - protein, 10 aa, Artificial Sequence
  Synthetic Peptide
PVIFSKASEY

SEQ ID NO: 4164 - protein, 10 aa, Artificial Sequence
  Synthetic Peptide
KASEYLQLVF

SEQ ID NO: 4165 - protein, 10 aa, Artificial Sequence
  Synthetic Peptide
EVVEVVPISH

SEQ ID NO: 4166 - protein, 10 aa, Artificial Sequence
  Synthetic Peptide
VEVVPISHLY

SEQ ID NO: 4167 - protein, 10 aa, Artificial Sequence
  Synthetic Peptide
ILVTCLGLSY

SEQ ID NO: 4168 - protein, 10 aa, Artificial Sequence
  Synthetic Peptide
LLGDNQVMPK

SEQ ID NO: 4169 - protein, 10 aa, Artificial Sequence
  Synthetic Peptide
IEGDCAPEEK

SEQ ID NO: 4170 - protein, 10 aa, Artificial Sequence
  Synthetic Peptide
STFPDLESEF

SEQ ID NO: 4171 - protein, 10 aa, Artificial Sequence
  Synthetic Peptide
ESEFQAALSR

SEQ ID NO: 4172 - protein, 10 aa, Artificial Sequence
  Synthetic Peptide
SEFQAALSRK

SEQ ID NO: 4173 - protein, 10 aa, Artificial Sequence
  Synthetic Peptide
LSRKVAELVH

SEQ ID NO: 4174 - protein, 10 aa, Artificial Sequence
  Synthetic Peptide
AELVHFLLLK

SEQ ID NO: 4175 - protein, 10 aa, Artificial Sequence
  Synthetic Peptide
LVHFLLLKYR

SEQ ID NO: 4176 - protein, 10 aa, Artificial Sequence
  Synthetic Peptide
GSVVGNWQYF

SEQ ID NO: 4177 - protein, 10 aa, Artificial Sequence
  Synthetic Peptide
SVVGNWQYFF

SEQ ID NO: 4178 - protein, 10 aa, Artificial Sequence
  Synthetic Peptide
KASSSLQLVF

SEQ ID NO: 4179 - protein, 10 aa, Artificial Sequence
  Synthetic Peptide
ELMEVDPIGH

SEQ ID NO: 4180 - protein, 10 aa, Artificial Sequence
  Synthetic Peptide
MEVDPIGHLY

SEQ ID NO: 4181 - protein, 10 aa, Artificial Sequence
  Synthetic Peptide
VDPIGHLYIF

SEQ ID NO: 4182 - protein, 10 aa, Artificial Sequence
  Synthetic Peptide
LIIVLAIIAR

SEQ ID NO: 4183 - protein, 10 aa, Artificial Sequence
  Synthetic Peptide
REGDCAPEEK

SEQ ID NO: 4184 - protein, 10 aa, Artificial Sequence
  Synthetic Peptide
RQPSEGSSSR

SEQ ID NO: 4185 - protein, 10 aa, Artificial Sequence
  Synthetic Peptide
LQLVFGIDVK

SEQ ID NO: 4186 - protein, 10 aa, Artificial Sequence
  Synthetic Peptide
RQVPDSDPAR

SEQ ID NO: 4187 - protein, 10 aa, Artificial Sequence
  Synthetic Peptide
MNYPLWSQSY

SEQ ID NO: 4188 - protein, 10 aa, Artificial Sequence
  Synthetic Peptide
GFLIIVLVMI

SEQ ID NO: 4189 - protein, 10 aa, Artificial Sequence
  Synthetic Peptide
SFSTTINYTL

SEQ ID NO: 4190 - protein, 10 aa, Artificial Sequence
  Synthetic Peptide
EFQAAISRKM

SEQ ID NO: 4191 - protein, 10 aa, Artificial Sequence
  Synthetic Peptide
LYILVGCLGL

SEQ ID NO: 4192 - protein, 10 aa, Artificial Sequence
  Synthetic Peptide
NWQYFFPVIF

SEQ ID NO: 4193 - protein, 9 aa, Artificial Sequence
  Synthetic Peptide
AVDPIGHLY

SEQ ID NO: 4194 - protein, 9 aa, Artificial Sequence
  Synthetic Peptide
EADPIGHLY

SEQ ID NO: 4195 - protein, 9 aa, Artificial Sequence
  Synthetic Peptide
EVDPASNTY

SEQ ID NO: 4196 - protein, 9 aa, Artificial Sequence
  Synthetic Peptide
EDTPIGHLY

SEQ ID NO: 4197 - protein, 9 aa, Artificial Sequence
  Synthetic Peptide
EVDPTGHLY

SEQ ID NO: 4198 - protein, 9 aa, Artificial Sequence
  Synthetic Peptide
AADSPSPPH

SEQ ID NO: 4199 - protein, 9 aa, Artificial Sequence
  Synthetic Peptide
VPISHLYIL

SEQ ID NO: 4200 - protein, 9 aa, Artificial Sequence
  Synthetic Peptide
MPKTGLLII

SEQ ID NO: 4201 - protein, 9 aa, Artificial Sequence
  Synthetic Peptide
SMLEVFEGR

SEQ ID NO: 4202 - protein, 9 aa, Artificial Sequence
  Synthetic Peptide
DSVVAHPRK

SEQ ID NO: 4203 - protein, 9 aa, Artificial Sequence
  Synthetic Peptide
VFAHPRKLL

SEQ ID NO: 4204 - protein, 9 aa, Artificial Sequence
  Synthetic Peptide
MQDLVQENY

SEQ ID NO: 4205 - protein, 9 aa, Artificial Sequence
  Synthetic Peptide
DPACYEFLW

SEQ ID NO: 4206 - protein, 9 aa, Artificial Sequence
  Synthetic Peptide
FLWGPRALI

SEQ ID NO: 4207 - protein, 9 aa, Artificial Sequence
  Synthetic Peptide
ALIETSYVK

SEQ ID NO: 4208 - protein, 9 aa, Artificial Sequence
  Synthetic Peptide
TSYVKVLHH

SEQ ID NO: 4209 - protein, 9 aa, Artificial Sequence
  Synthetic Peptide
EPHISYPPL

SEQ ID NO: 4210 - protein, 9 aa, Artificial Sequence
  Synthetic Peptide
ISYPPLHER

SEQ ID NO: 4211 - protein, 9 aa, Artificial Sequence
  Synthetic Peptide
YPPLHERAL

SEQ ID NO: 4212 - protein, 9 aa, Artificial Sequence
  Synthetic Peptide
EPVTKAEML

SEQ ID NO: 4213 - protein, 9 aa, Artificial Sequence
  Synthetic Peptide
VPGSDPACY

SEQ ID NO: 4214 - protein, 9 aa, Artificial Sequence
  Synthetic Peptide
EGLEARGEA

SEQ ID NO: 4215 - protein, 9 aa, Artificial Sequence
  Synthetic Peptide
GLEARGEAL

SEQ ID NO: 4216 - protein, 9 aa, Artificial Sequence
  Synthetic Peptide
EARGEALGL

SEQ ID NO: 4217 - protein, 9 aa, Artificial Sequence
  Synthetic Peptide
ALGLVGAQA

SEQ ID NO: 4218 - protein, 9 aa, Artificial Sequence
  Synthetic Peptide
GLVGAQAPA

SEQ ID NO: 4219 - protein, 9 aa, Artificial Sequence
  Synthetic Peptide
LVGAQAPAT

SEQ ID NO: 4220 - protein, 9 aa, Artificial Sequence
  Synthetic Peptide
PATEEQEAA

SEQ ID NO: 4221 - protein, 9 aa, Artificial Sequence
  Synthetic Peptide
EAASSSSTL

SEQ ID NO: 4222 - protein, 9 aa, Artificial Sequence
  Synthetic Peptide
LVEVTLGEV

SEQ ID NO: 4223 - protein, 9 aa, Artificial Sequence
  Synthetic Peptide
EVTLGEVPA

SEQ ID NO: 4224 - protein, 9 aa, Artificial Sequence
  Synthetic Peptide
VTLGEVPAA

SEQ ID NO: 4225 - protein, 9 aa, Artificial Sequence
  Synthetic Peptide
LPTTMNYPL

SEQ ID NO: 4226 - protein, 9 aa, Artificial Sequence
  Synthetic Peptide
PDLESEFQA

SEQ ID NO: 4227 - protein, 10 aa, Artificial Sequence
  Synthetic Peptide
HFLLLLKYRA

SEQ ID NO: 4228 - protein, 9 aa, Artificial Sequence
  Synthetic Peptide
FFPVIFSKA

SEQ ID NO: 4229 - protein, 9 aa, Artificial Sequence
  Synthetic Peptide
DPIGHLYIF

SEQ ID NO: 4230 - protein, 9 aa, Artificial Sequence
  Synthetic Peptide
GDNAIMPKA

SEQ ID NO: 4231 - protein, 9 aa, Artificial Sequence
  Synthetic Peptide
MPKAGLLII

SEQ ID NO: 4232 - protein, 9 aa, Artificial Sequence
  Synthetic Peptide
AGLLIIVLA

SEQ ID NO: 4233 - protein, 9 aa, Artificial Sequence
  Synthetic Peptide
KIQEELSVL

SEQ ID NO: 4234 - protein, 9 aa, Artificial Sequence
  Synthetic Peptide
SVELVFEGR

SEQ ID NO: 4235 - protein, 9 aa, Artificial Sequence
  Synthetic Peptide
EDSILGDPK

SEQ ID NO: 4236 - protein, 9 aa, Artificial Sequence
  Synthetic Peptide
SILGDPKKL

SEQ ID NO: 4237 - protein, 9 aa, Artificial Sequence
  Synthetic Peptide
ILGDPKKLL

SEQ ID NO: 4238 - protein, 9 aa, Artificial Sequence
  Synthetic Peptide
FLWGPRALV

SEQ ID NO: 4239 - protein, 9 aa, Artificial Sequence
  Synthetic Peptide
PRALVETSY

SEQ ID NO: 4240 - protein, 9 aa, Artificial Sequence
  Synthetic Peptide
RALVETSYV

SEQ ID NO: 4241 - protein, 9 aa, Artificial Sequence
  Synthetic Peptide
ALVETSYVK

SEQ ID NO: 4242 - protein, 9 aa, Artificial Sequence
  Synthetic Peptide
LVETSYVKV

SEQ ID NO: 4243 - protein, 9 aa, Artificial Sequence
  Synthetic Peptide
YVKVLHHMV

SEQ ID NO: 4244 - protein, 9 aa, Artificial Sequence
  Synthetic Peptide
KVLHHMVKI

SEQ ID NO: 4245 - protein, 9 aa, Artificial Sequence
  Synthetic Peptide
MVKISGGPH

SEQ ID NO: 4246 - protein, 9 aa, Artificial Sequence
  Synthetic Peptide
ISGGPHISY

SEQ ID NO: 4247 - protein, 9 aa, Artificial Sequence
  Synthetic Peptide
GPHISYPPL

SEQ ID NO: 4248 - protein, 9 aa, Artificial Sequence
  Synthetic Peptide
YPPLHEWVL

SEQ ID NO: 4249 - protein, 10 aa, Artificial Sequence
  Synthetic Peptide
VPISHLYILV

SEQ ID NO: 4250 - protein, 10 aa, Artificial Sequence
  Synthetic Peptide
MPKTGLLIIV

SEQ ID NO: 4251 - protein, 10 aa, Artificial Sequence
  Synthetic Peptide
VFEGREDSVF

SEQ ID NO: 4252 - protein, 10 aa, Artificial Sequence
  Synthetic Peptide
HPRKLLMQDL

SEQ ID NO: 4253 - protein, 10 aa, Artificial Sequence
  Synthetic Peptide
LMQDLVQENY

SEQ ID NO: 4254 - protein, 10 aa, Artificial Sequence
  Synthetic Peptide
EFLWGPRALI

SEQ ID NO: 4255 - protein, 10 aa, Artificial Sequence
  Synthetic Peptide
GPRALIETSY

SEQ ID NO: 4256 - protein, 10 aa, Artificial Sequence
  Synthetic Peptide
RALIETSYVK

SEQ ID NO: 4257 - protein, 10 aa, Artificial Sequence
  Synthetic Peptide
SYVKVLHHTL

SEQ ID NO: 4258 - protein, 10 aa, Artificial Sequence
  Synthetic Peptide
SYPPLHERAL

SEQ ID NO: 4259 - protein, 10 aa, Artificial Sequence
  Synthetic Peptide
APEEKIWEEL

SEQ ID NO: 4260 - protein, 10 aa, Artificial Sequence
  Synthetic Peptide
PLEQRSQHCK

SEQ ID NO: 4261 - protein, 10 aa, Artificial Sequence
  Synthetic Peptide
HCKPEEGLEA

SEQ ID NO: 4262 - protein, 10 aa, Artificial Sequence
  Synthetic Peptide
EARGEALGLV

SEQ ID NO: 4263 - protein, 10 aa, Artificial Sequence
  Synthetic Peptide
RGEALGLVGA

SEQ ID NO: 4264 - protein, 10 aa, Artificial Sequence
  Synthetic Peptide
EALGLVGAQA

SEQ ID NO: 4265 - protein, 10 aa, Artificial Sequence
  Synthetic Peptide
LGLVGAQAPA

SEQ ID NO: 4266 - protein, 10 aa, Artificial Sequence
  Synthetic Peptide
GLVGAQAPAT

SEQ ID NO: 4267 - protein, 10 aa, Artificial Sequence
  Synthetic Peptide
QAPATEEQEA

SEQ ID NO: 4268 - protein, 10 aa, Artificial Sequence
  Synthetic Peptide
EAASSSSTLV

SEQ ID NO: 4269 - protein, 10 aa, Artificial Sequence
  Synthetic Peptide
TLVEVTLGEV

SEQ ID NO: 4270 - protein, 10 aa, Artificial Sequence
  Synthetic Peptide
EVTLGEVPAA

SEQ ID NO: 4271 - protein, 10 aa, Artificial Sequence
  Synthetic Peptide
PDPPQSPQGA

SEQ ID NO: 4272 - protein, 10 aa, Artificial Sequence
  Synthetic Peptide
LPTTMNYPLW

SEQ ID NO: 4273 - protein, 10 aa, Artificial Sequence
  Synthetic Peptide
PDLESEFQAA

SEQ ID NO: 4274 - protein, 10 aa, Artificial Sequence
  Synthetic Peptide
YFFPVIFSKA

SEQ ID NO: 4275 - protein, 10 aa, Artificial Sequence
  Synthetic Peptide
LGDNQIMPKA

SEQ ID NO: 4276 - protein, 10 aa, Artificial Sequence
  Synthetic Peptide
MPKAGLLIIV

SEQ ID NO: 4277 - protein, 10 aa, Artificial Sequence
  Synthetic Peptide
EVFEGREDSK

SEQ ID NO: 4278 - protein, 10 aa, Artificial Sequence
  Synthetic Peptide
EDSILGDPKK

SEQ ID NO: 4279 - protein, 10 aa, Artificial Sequence
  Synthetic Peptide
SILGDPKKLL

SEQ ID NO: 4280 - protein, 10 aa, Artificial Sequence
  Synthetic Peptide
ILGDPKKLLT

SEQ ID NO: 4281 - protein, 10 aa, Artificial Sequence
  Synthetic Peptide
GDPKKLLTQH

SEQ ID NO: 4282 - protein, 10 aa, Artificial Sequence
  Synthetic Peptide
DPKKLLTQHF

SEQ ID NO: 4283 - protein, 10 aa, Artificial Sequence
  Synthetic Peptide
LTQHFVQENY

SEQ ID NO: 4284 - protein, 10 aa, Artificial Sequence
  Synthetic Peptide
FVGENYLEYR

SEQ ID NO: 4285 - protein, 10 aa, Artificial Sequence
  Synthetic Peptide
ACYEFLQGPR

SEQ ID NO: 4286 - protein, 10 aa, Artificial Sequence
  Synthetic Peptide
GPRALVETSY

SEQ ID NO: 4287 - protein, 10 aa, Artificial Sequence
  Synthetic Peptide
RALVETSYVK

SEQ ID NO: 4288 - protein, 10 aa, Artificial Sequence
  Synthetic Peptide
ALVETSYVKV

SEQ ID NO: 4289 - protein, 10 aa, Artificial Sequence
  Synthetic Peptide
LVETSYVKVL

SEQ ID NO: 4290 - protein, 10 aa, Artificial Sequence
  Synthetic Peptide
YVKVLHHMVK

SEQ ID NO: 4291 - protein, 10 aa, Artificial Sequence
  Synthetic Peptide
MVKISGGPHI

SEQ ID NO: 4292 - protein, 10 aa, Artificial Sequence
  Synthetic Peptide
KISGGPHISY

SEQ ID NO: 4293 - protein, 9 aa, Artificial Sequence
  Synthetic Peptide
APPHSPQGA

SEQ ID NO: 4294 - protein, 9 aa, Artificial Sequence
  Synthetic Peptide
APATEEQEA

SEQ ID NO: 4295 - protein, 9 aa, Artificial Sequence
  Synthetic Peptide
DPPQSPQGA

SEQ ID NO: 4296 - protein, 10 aa, Artificial Sequence
  Synthetic Peptide
APATEEQQTA

SEQ ID NO: 4297 - protein, 10 aa, Artificial Sequence
  Synthetic Peptide
DPIGHLYIFA

SEQ ID NO: 4298 - protein, 9 aa, Artificial Sequence
  Synthetic Peptide
EADPTGHSY

SEQ ID NO: 4299 - protein, 10 aa, Artificial Sequence
  Synthetic Peptide
KVADLVGFLL

SEQ ID NO: 4300 - protein, 10 aa, Artificial Sequence
  Synthetic Peptide
ASSLPTTMNY

SEQ ID NO: 4301 - protein, 9 aa, Artificial Sequence
  Synthetic Peptide
TQDLVQEKY

SEQ ID NO: 4302 - protein, 10 aa, Artificial Sequence
  Synthetic Peptide
LVQEKYLEYR

SEQ ID NO: 4303 - protein, 9 aa, Artificial Sequence
  Synthetic Peptide
ILLWQPIPV

SEQ ID NO: 4304 - protein, 9 aa, Artificial Sequence
  Synthetic Peptide
EVDPIGHLF

SEQ ID NO: 4305 - protein, 10 aa, Artificial Sequence
  Synthetic Peptide
ASSFSTTINY

SEQ ID NO: 4306 - protein, 8 aa, Artificial Sequence
  Synthetic Peptide
VTCLGLSY

SEQ ID NO: 4307 - protein, 9 aa, Artificial Sequence
  Synthetic Peptide
SSLPTTMNY

SEQ ID NO: 4308 - protein, 10 aa, Artificial Sequence
  Synthetic Peptide
GSVVGNWQYF

SEQ ID NO: 4309 - protein, 10 aa, Artificial Sequence
  Synthetic Peptide
DLVQEKYLEY

SEQ ID NO: 4310 - protein, 9 aa, Artificial Sequence
  Synthetic Peptide
SSFSTTINY

SEQ ID NO: 4311 - protein, 10 aa, Artificial Sequence
  Synthetic Peptide
MLESVIKNYK

SEQ ID NO: 4312 - protein, 9 aa, Artificial Sequence
  Synthetic Peptide
KMVELVHFL

SEQ ID NO: 4313 - protein, 10 aa, Artificial Sequence
  Synthetic Peptide
KMVELVHFLL

SEQ ID NO: 4314 - protein, 10 aa, Artificial Sequence
  Synthetic Peptide
LVFGIELMEV

SEQ ID NO: 4315 - protein, 9 aa, Artificial Sequence
  Synthetic Peptide
SLFRAVITK

SEQ ID NO: 4316 - protein, 10 aa, Artificial Sequence
  Synthetic Peptide
ADLVGFLLLK

SEQ ID NO: 4317 - protein, 10 aa, Artificial Sequence
  Synthetic Peptide
ESLFRAVITY

SEQ ID NO: 4318 - protein, 10 aa, Artificial Sequence
  Synthetic Peptide
MLESVIKNYK

SEQ ID NO: 4319 - protein, 8 aa, Artificial Sequence
  Synthetic Peptide
LVGFLLLK

SEQ ID NO: 4320 - protein, 9 aa, Artificial Sequence
  Synthetic Peptide
TTINFTRQR

SEQ ID NO: 4321 - protein, 10 aa, Artificial Sequence
  Synthetic Peptide
LLGDNQIMPK

SEQ ID NO: 4322 - protein, 9 aa, Artificial Sequence
  Synthetic Peptide
SYMEVYDGR

SEQ ID NO: 4323 - protein, 9 aa, Artificial Sequence
  Synthetic Peptide
HSAYGEPRK

SEQ ID NO: 4324 - protein, 10 aa, Artificial Sequence
  Synthetic Peptide
LLTQDLVQEK

SEQ ID NO: 4325 - protein, 9 aa, Artificial Sequence
  Synthetic Peptide
LTQDLVQEK

SEQ ID NO: 4326 - protein, 10 aa, Artificial Sequence
  Synthetic Peptide
NYKHCFPEIF

SEQ ID NO: 4327 - protein, 10 aa, Artificial Sequence
  Synthetic Peptide
LYIFATCLGL

SEQ ID NO: 4328 - protein, 9 aa, Artificial Sequence
  Synthetic Peptide
NYPLWSQSY

SEQ ID NO: 4329 - protein, 10 aa, Artificial Sequence
  Synthetic Peptide
SYVLVTCLGL

SEQ ID NO: 4330 - protein, 10 aa, Artificial Sequence
  Synthetic Peptide
ETSYVKVLEY

SEQ ID NO: 4331 - protein, 9 aa, Artificial Sequence
  Synthetic Peptide
TSYVKVLEY

SEQ ID NO: 4332 - protein, 9 aa, Artificial Sequence
  Synthetic Peptide
FLQGPRALA

SEQ ID NO: 4333 - protein, 10 aa, Artificial Sequence
  Synthetic Peptide
ALAETSYVKV

SEQ ID NO: 4334 - protein, 10 aa, Artificial Sequence
  Synthetic Peptide
RVRFFFPSLR

SEQ ID NO: 4335 - protein, 10 aa, Artificial Sequence
  Synthetic Peptide
ALAETSYVKV

SEQ ID NO: 4336 - protein, 10 aa, Artificial Sequence
  Synthetic Peptide
LTQDLVQEKY

SEQ ID NO: 4337 - protein, 9 aa, Artificial Sequence
  Synthetic Peptide
CFLLLKYRA

SEQ ID NO: 4338 - protein, 9 aa, Artificial Sequence
  Synthetic Peptide
CFPEIFGKA

SEQ ID NO: 4339 - protein, 9 aa, Artificial Sequence
  Synthetic Peptide
FFFPSLREA

SEQ ID NO: 4340 - protein, 10 aa, Artificial Sequence
  Synthetic Peptide
FFPSLREAAL

SEQ ID NO: 4341 - protein, 9 aa, Artificial Sequence
  Synthetic Peptide
HCFPEIFGK

SEQ ID NO: 4342 - protein, 10 aa, Artificial Sequence
  Synthetic Peptide
RSLHCKPEEA

SEQ ID NO: 4343 - protein, 10 aa, Artificial Sequence
  Synthetic Peptide
EFLWGPRALA

SEQ ID NO: 4344 - protein, 10 aa, Artificial Sequence
  Synthetic Peptide
RFFFPSLREA

SEQ ID NO: 4345 - protein, 10 aa, Artificial Sequence
  Synthetic Peptide
FFFPSLREAA

SEQ ID NO: 4346 - protein, 10 aa, Artificial Sequence
  Synthetic Peptide
SLEQRSLHCK

SEQ ID NO: 4347 - protein, 9 aa, Artificial Sequence
  Synthetic Peptide
SLFRAVITK

SEQ ID NO: 4348 - protein, 10 aa, Artificial Sequence
  Synthetic Peptide
SLFRAVITKK

SEQ ID NO: 4349 - protein, 9 aa, Artificial Sequence
  Synthetic Peptide
DLVGFLLLK

SEQ ID NO: 4350 - protein, 10 aa, Artificial Sequence
  Synthetic Peptide
MLESVIKNYK

SEQ ID NO: 4351 - protein, 9 aa, Artificial Sequence
  Synthetic Peptide
MLESVIKNY

SEQ ID NO: 4352 - protein, 9 aa, Artificial Sequence
  Synthetic Peptide
QLVFGIDVK

SEQ ID NO: 4353 - protein, 9 aa, Artificial Sequence
  Synthetic Peptide
EADPTGHSY

SEQ ID NO: 4354 - protein, 10 aa, Artificial Sequence
  Synthetic Peptide
LLGDNQIMPK

SEQ ID NO: 4355 - protein, 10 aa, Artificial Sequence
  Synthetic Peptide
WEELSVMEVY

SEQ ID NO: 4356 - protein, 10 aa, Artificial Sequence
  Synthetic Peptide
VYDGREHSAY

SEQ ID NO: 4357 - protein, 10 aa, Artificial Sequence
  Synthetic Peptide
LLTQDLVQEK

SEQ ID NO: 4358 - protein, 9 aa, Artificial Sequence
  Synthetic Peptide
LTQDLVQEK

SEQ ID NO: 4359 - protein, 10 aa, Artificial Sequence
  Synthetic Peptide
LTQDLVQEKY

SEQ ID NO: 4360 - protein, 9 aa, Artificial Sequence
  Synthetic Peptide
TQDLVQEKY

SEQ ID NO: 4361 - protein, 11 aa, Artificial Sequence
  Synthetic Peptide
HTLWKAGILYK

SEQ ID NO: 4362 - protein, 9 aa, Artificial Sequence
  Synthetic Peptide
SVVRRAFPH

SEQ ID NO: 4363 - protein, 9 aa, Artificial Sequence
  Synthetic Peptide
AFTFSPTYK

SEQ ID NO: 4364 - protein, 9 aa, Artificial Sequence
  Synthetic Peptide
SSAGPCALR

SEQ ID NO: 4365 - protein, 9 aa, Artificial Sequence
  Synthetic Peptide
CALRFTSAR

SEQ ID NO: 4366 - protein, 9 aa, Artificial Sequence
  Synthetic Peptide
WMNSTGFTK

SEQ ID NO: 4367 - protein, 9 aa, Artificial Sequence
  Synthetic Peptide
LGFGAYMSK

SEQ ID NO: 4368 - protein, 9 aa, Artificial Sequence
  Synthetic Peptide
VAGALVAFK

SEQ ID NO: 4369 - protein, 9 aa, Artificial Sequence
  Synthetic Peptide
MVHQAISPR

SEQ ID NO: 4370 - protein, 10 aa, Artificial Sequence
  Synthetic Peptide
QMVHQAISPR

SEQ ID NO: 4371 - protein, 9 aa, Artificial Sequence
  Synthetic Peptide
TIKIGGQLK

SEQ ID NO: 4372 - protein, 9 aa, Artificial Sequence
  Synthetic Peptide
TLFCASDAK

SEQ ID NO: 4373 - protein, 10 aa, Artificial Sequence
  Synthetic Peptide
TTLFCASDAK

SEQ ID NO: 4374 - protein, 9 aa, Artificial Sequence
  Synthetic Peptide
RIVELLGRR

SEQ ID NO: 4375 - protein, 10 aa, Artificial Sequence
  Synthetic Peptide
VTIKIGGQLK

SEQ ID NO: 4376 - protein, 9 aa, Artificial Sequence
  Synthetic Peptide
VMIVWQVDR

SEQ ID NO: 4377 - protein, 9 aa, Artificial Sequence
  Synthetic Peptide
HLFGYSWYK

SEQ ID NO: 4378 - protein, 9 aa, Artificial Sequence
  Synthetic Peptide
HTQVLFIAK

SEQ ID NO: 4379 - protein, 10 aa, Artificial Sequence
  Synthetic Peptide
TISPSYTYYR

SEQ ID NO: 4380 - protein, 10 aa, Artificial Sequence
  Synthetic Peptide
RTLTLFNVTR

SEQ ID NO: 4381 - protein, 9 aa, Artificial Sequence
  Synthetic Peptide
ISPSYTYYR

SEQ ID NO: 4382 - protein, 10 aa, Artificial Sequence
  Synthetic Peptide
TISPLNTSYR

SEQ ID NO: 4383 - protein, 10 aa, Artificial Sequence
  Synthetic Peptide
RTLTLLSVTR

SEQ ID NO: 4384 - protein, 10 aa, Artificial Sequence
  Synthetic Peptide
RTEILDLWVY

SEQ ID NO: 4385 - protein, 10 aa, Artificial Sequence
  Synthetic Peptide
RQDILDLWVY

SEQ ID NO: 4386 - protein, 10 aa, Artificial Sequence
  Synthetic Peptide
RTDILDLWVY

SEQ ID NO: 4387 - protein, 9 aa, Artificial Sequence
  Synthetic Peptide
YTDGPGIRY

SEQ ID NO: 4388 - protein, 8 aa, Artificial Sequence
  Synthetic Peptide
ATELHPEY

SEQ ID NO: 4389 - protein, 8 aa, Artificial Sequence
  Synthetic Peptide
ARDLHPEY

SEQ ID NO: 4390 - protein, 9 aa, Artificial Sequence
  Synthetic Peptide
ATELHPEYY

SEQ ID NO: 4391 - protein, 9 aa, Artificial Sequence
  Synthetic Peptide
ARDLHPEYY

SEQ ID NO: 4392 - protein, 11 aa, Artificial Sequence
  Synthetic Peptide
PTDQGPQREPY

SEQ ID NO: 4393 - protein, 9 aa, Artificial Sequence
  Synthetic Peptide
WTKSSIVGW

SEQ ID NO: 4394 - protein, 9 aa, Artificial Sequence
  Synthetic Peptide
WSKSSIVGY

SEQ ID NO: 4395 - protein, 9 aa, Artificial Sequence
  Synthetic Peptide
QTPLRPMTY

SEQ ID NO: 4396 - protein, 8 aa, Artificial Sequence
  Synthetic Peptide
ETLDLWVY

SEQ ID NO: 4397 - protein, 8 aa, Artificial Sequence
  Synthetic Peptide
DTLDLWVY

SEQ ID NO: 4398 - protein, 10 aa, Artificial Sequence
  Synthetic Peptide
DTWVYHTQGY

SEQ ID NO: 4399 - protein, 11 aa, Artificial Sequence
  Synthetic Peptide
DTWVYHTQGYF

SEQ ID NO: 4400 - protein, 11 aa, Artificial Sequence
  Synthetic Peptide
DLWVYHTQGYY

SEQ ID NO: 4401 - protein, 8 aa, Artificial Sequence
  Synthetic Peptide
WTYHTQGY

SEQ ID NO: 4402 - protein, 9 aa, Artificial Sequence
  Synthetic Peptide
WTYHTQGYF

SEQ ID NO: 4403 - protein, 9 aa, Artificial Sequence
  Synthetic Peptide
WVYHTQGYY

SEQ ID NO: 4404 - protein, 8 aa, Artificial Sequence
  Synthetic Peptide
PTTFGWCF

SEQ ID NO: 4405 - protein, 8 aa, Artificial Sequence
  Synthetic Peptide
PLTFGWCY

SEQ ID NO: 4406 - protein, 8 aa, Artificial Sequence
  Synthetic Peptide
ETLDLWVY

SEQ ID NO: 4407 - protein, 9 aa, Artificial Sequence
  Synthetic Peptide
QTPLRPMTY

SEQ ID NO: 4408 - protein, 11 aa, Artificial Sequence
  Synthetic Peptide
ITKILYQSNPY

SEQ ID NO: 4409 - protein, 9 aa, Artificial Sequence
  Synthetic Peptide
KTLYQSNPY

SEQ ID NO: 4410 - protein, 8 aa, Artificial Sequence
  Synthetic Peptide
ITYQSNPY

SEQ ID NO: 4411 - protein, 9 aa, Artificial Sequence
  Synthetic Peptide
PTDPNLEPW

SEQ ID NO: 4412 - protein, 9 aa, Artificial Sequence
  Synthetic Peptide
PVDPNLEPY

SEQ ID NO: 4413 - protein, 8 aa, Artificial Sequence
  Synthetic Peptide
STVKHHMY

SEQ ID NO: 4414 - protein, 9 aa, Artificial Sequence
  Synthetic Peptide
QLEPAAAGV

SEQ ID NO: 4415 - protein, 11 aa, Artificial Sequence
  Synthetic Peptide
QLEPAAAGVGA

SEQ ID NO: 4416 - protein, 11 aa, Artificial Sequence
  Synthetic Peptide
QAEPAAAGVGV

SEQ ID NO: 4417 - protein, 8 aa, Artificial Sequence
  Synthetic Peptide
PLAEGVGA

SEQ ID NO: 4418 - protein, 8 aa, Artificial Sequence
  Synthetic Peptide
PAAEGVGV

SEQ ID NO: 4419 - protein, 8 aa, Artificial Sequence
  Synthetic Peptide
ALEGVGAV

SEQ ID NO: 4420 - protein, 9 aa, Artificial Sequence
  Synthetic Peptide
GLGAVSRDL

SEQ ID NO: 4421 - protein, 9 aa, Artificial Sequence
  Synthetic Peptide
GVGAVSRDV

SEQ ID NO: 4422 - protein, 8 aa, Artificial Sequence
  Synthetic Peptide
GLITSSNT

SEQ ID NO: 4423 - protein, 8 aa, Artificial Sequence
  Synthetic Peptide
GAITSSNV

SEQ ID NO: 4424 - protein, 9 aa, Artificial Sequence
  Synthetic Peptide
GLITSSNTA

SEQ ID NO: 4425 - protein, 9 aa, Artificial Sequence
  Synthetic Peptide
GAITSSNTV

SEQ ID NO: 4426 - protein, 8 aa, Artificial Sequence
  Synthetic Peptide
ALTSSNTA

SEQ ID NO: 4427 - protein, 8 aa, Artificial Sequence
  Synthetic Peptide
AITSSNTV

SEQ ID NO: 4428 - protein, 9 aa, Artificial Sequence
  Synthetic Peptide
NLDCAWLEA

SEQ ID NO: 4429 - protein, 9 aa, Artificial Sequence
  Synthetic Peptide
NADCAWLEV

SEQ ID NO: 4430 - protein, 8 aa, Artificial Sequence
  Synthetic Peptide
ELQEEEEV

SEQ ID NO: 4431 - protein, 11 aa, Artificial Sequence
  Synthetic Peptide
ALEEEEVGFPV

SEQ ID NO: 4432 - protein, 10 aa, Artificial Sequence
  Synthetic Peptide
ELGFPVRPQV

SEQ ID NO: 4433 - protein, 8 aa, Artificial Sequence
  Synthetic Peptide
PLRPQVPL

SEQ ID NO: 4434 - protein, 8 aa, Artificial Sequence
  Synthetic Peptide
PVRPQVPV

SEQ ID NO: 4435 - protein, 11 aa, Artificial Sequence
  Synthetic Peptide
PLRPQVPLRPM

SEQ ID NO: 4436 - protein, 11 aa, Artificial Sequence
  Synthetic Peptide
PVRPQVPLRPV

SEQ ID NO: 4437 - protein, 8 aa, Artificial Sequence
  Synthetic Peptide
PLVPLRPM

SEQ ID NO: 4438 - protein, 8 aa, Artificial Sequence
  Synthetic Peptide
PQVPLRPV

SEQ ID NO: 4439 - protein, 9 aa, Artificial Sequence
  Synthetic Peptide
PLVPLRPMT

SEQ ID NO: 4440 - protein, 9 aa, Artificial Sequence
  Synthetic Peptide
PQVPLRPMV

SEQ ID NO: 4441 - protein, 8 aa, Artificial Sequence
  Synthetic Peptide
QLPLRPMT

SEQ ID NO: 4442 - protein, 8 aa, Artificial Sequence
  Synthetic Peptide
QVPLRPMV

SEQ ID NO: 4443 - protein, 11 aa, Artificial Sequence
  Synthetic Peptide
QLPLRPMTYKA

SEQ ID NO: 4444 - protein, 11 aa, Artificial Sequence
  Synthetic Peptide
QVPLRPMTYKV

SEQ ID NO: 4445 - protein, 10 aa, Artificial Sequence
  Synthetic Peptide
PLRPMTYKGV

SEQ ID NO: 4446 - protein, 9 aa, Artificial Sequence
  Synthetic Peptide
PLRPMTYKV

SEQ ID NO: 4447 - protein, 10 aa, Artificial Sequence
  Synthetic Peptide
PLRPMTYKAV

SEQ ID NO: 4448 - protein, 8 aa, Artificial Sequence
  Synthetic Peptide
FLKEKGGV

SEQ ID NO: 4449 - protein, 11 aa, Artificial Sequence
  Synthetic Peptide
FLKEKGGLEGV

SEQ ID NO: 4450 - protein, 11 aa, Artificial Sequence
  Synthetic Peptide
FLKEKGGLDGV

SEQ ID NO: 4451 - protein, 11 aa, Artificial Sequence
  Synthetic Peptide
GLIYSKKRQEV

SEQ ID NO: 4452 - protein, 10 aa, Artificial Sequence
  Synthetic Peptide
LLYSKKRQEI

SEQ ID NO: 4453 - protein, 10 aa, Artificial Sequence
  Synthetic Peptide
LIYSKKRQEV

SEQ ID NO: 4454 - protein, 11 aa, Artificial Sequence
  Synthetic Peptide
LLYSKKRQEIL

SEQ ID NO: 4455 - protein, 11 aa, Artificial Sequence
  Synthetic Peptide
LIYSKKRQEIV

SEQ ID NO: 4456 - protein, 9 aa, Artificial Sequence
  Synthetic Peptide
RLEILDLWV

SEQ ID NO: 4457 - protein, 9 aa, Artificial Sequence
  Synthetic Peptide
RLDILDLWV

SEQ ID NO: 4458 - protein, 10 aa, Artificial Sequence
  Synthetic Peptide
ELLDLWVYHT

SEQ ID NO: 4459 - protein, 10 aa, Artificial Sequence
  Synthetic Peptide
EILDLWVYHV

SEQ ID NO: 4460 - protein, 9 aa, Artificial Sequence
  Synthetic Peptide
ILDLWVYHV

SEQ ID NO: 4461 - protein, 9 aa, Artificial Sequence
  Synthetic Peptide
ILDLWVYNV

SEQ ID NO: 4462 - protein, 10 aa, Artificial Sequence
  Synthetic Peptide
WLNYTPGPGT

SEQ ID NO: 4463 - protein, 10 aa, Artificial Sequence
  Synthetic Peptide
WQNYTPGPGV

SEQ ID NO: 4464 - protein, 10 aa, Artificial Sequence
  Synthetic Peptide
WLNYTPGPGI

SEQ ID NO: 4465 - protein, 10 aa, Artificial Sequence
  Synthetic Peptide
WQNYTPGPGV

SEQ ID NO: 4466 - protein, 11 aa, Artificial Sequence
  Synthetic Peptide
YLPGPGIRYPL

SEQ ID NO: 4467 - protein, 11 aa, Artificial Sequence
  Synthetic Peptide
YTPGPGIRYPV

SEQ ID NO: 4468 - protein, 10 aa, Artificial Sequence
  Synthetic Peptide
PLTFGWCFKV

SEQ ID NO: 4469 - protein, 9 aa, Artificial Sequence
  Synthetic Peptide
LLFGWCFKL

SEQ ID NO: 4470 - protein, 9 aa, Artificial Sequence
  Synthetic Peptide
LTFGWCFKV

SEQ ID NO: 4471 - protein, 10 aa, Artificial Sequence
  Synthetic Peptide
LLFGWCFKLV

SEQ ID NO: 4472 - protein, 8 aa, Artificial Sequence
  Synthetic Peptide
PVRPQVPV

SEQ ID NO: 4473 - protein, 8 aa, Artificial Sequence
  Synthetic Peptide
FLKEKGGV

SEQ ID NO: 4474 - protein, 8 aa, Artificial Sequence
  Synthetic Peptide
PQVPLRPV

SEQ ID NO: 4475 - protein, 9 aa, Artificial Sequence
  Synthetic Peptide
PQVPLRPMV

SEQ ID NO: 4476 - protein, 8 aa, Artificial Sequence
  Synthetic Peptide
QVPLRPMV

SEQ ID NO: 4477 - protein, 8 aa, Artificial Sequence
  Synthetic Peptide
PLRPQVPL

SEQ ID NO: 4478 - protein, 8 aa, Artificial Sequence
  Synthetic Peptide
FVKEKGGL

SEQ ID NO: 4479 - protein, 8 aa, Artificial Sequence
  Synthetic Peptide
PLVPLRPM

SEQ ID NO: 4480 - protein, 9 aa, Artificial Sequence
  Synthetic Peptide
PLVPLRPMT

SEQ ID NO: 4481 - protein, 8 aa, Artificial Sequence
  Synthetic Peptide
QLPLRPMT

SEQ ID NO: 4482 - protein, 8 aa, Artificial Sequence
  Synthetic Peptide
PVVPLRPM

SEQ ID NO: 4483 - protein, 9 aa, Artificial Sequence
  Synthetic Peptide
PVVPLRPMT

SEQ ID NO: 4484 - protein, 9 aa, Artificial Sequence
  Synthetic Peptide
PLEPVPLQL

SEQ ID NO: 4485 - protein, 9 aa, Artificial Sequence
  Synthetic Peptide
PAEPVPLQV

SEQ ID NO: 4486 - protein, 9 aa, Artificial Sequence
  Synthetic Peptide
PLPLQLPPL

SEQ ID NO: 4487 - protein, 9 aa, Artificial Sequence
  Synthetic Peptide
PVPLQLPPV

SEQ ID NO: 4488 - protein, 10 aa, Artificial Sequence
  Synthetic Peptide
PLQLPPLERV

SEQ ID NO: 4489 - protein, 9 aa, Artificial Sequence
  Synthetic Peptide
LLLPPLERL

SEQ ID NO: 4490 - protein, 9 aa, Artificial Sequence
  Synthetic Peptide
LQLPPLERV

SEQ ID NO: 4491 - protein, 10 aa, Artificial Sequence
  Synthetic Peptide
LLLPPLERLT

SEQ ID NO: 4492 - protein, 10 aa, Artificial Sequence
  Synthetic Peptide
LQLPPLERLV

SEQ ID NO: 4493 - protein, 11 aa, Artificial Sequence
  Synthetic Peptide
LLLPPLERLTL

SEQ ID NO: 4494 - protein, 11 aa, Artificial Sequence
  Synthetic Peptide
LQLPPLERLTV

SEQ ID NO: 4495 - protein, 9 aa, Artificial Sequence
  Synthetic Peptide
QLPPLERLV

SEQ ID NO: 4496 - protein, 8 aa, Artificial Sequence
  Synthetic Peptide
GLSGTQGV

SEQ ID NO: 4497 - protein, 8 aa, Artificial Sequence
  Synthetic Peptide
WQVDRMRV

SEQ ID NO: 4498 - protein, 10 aa, Artificial Sequence
  Synthetic Peptide
KVGSLQYLAV

SEQ ID NO: 4499 - protein, 8 aa, Artificial Sequence
  Synthetic Peptide
KVGSLQYV

SEQ ID NO: 4500 - protein, 9 aa, Artificial Sequence
  Synthetic Peptide
KVGSLQYLV

SEQ ID NO: 4501 - protein, 8 aa, Artificial Sequence
  Synthetic Peptide
IVWQVDRV

SEQ ID NO: 4502 - protein, 8 aa, Artificial Sequence
  Synthetic Peptide
WLVDRMRI

SEQ ID NO: 4503 - protein, 10 aa, Artificial Sequence
  Synthetic Peptide
KLGSLQYLAL

SEQ ID NO: 4504 - protein, 8 aa, Artificial Sequence
  Synthetic Peptide
KLGSLQYL

SEQ ID NO: 4505 - protein, 9 aa, Artificial Sequence
  Synthetic Peptide
KLGSLQYLA

SEQ ID NO: 4506 - protein, 8 aa, Artificial Sequence
  Synthetic Peptide
ILWQVDRM

SEQ ID NO: 4507 - protein, 8 aa, Artificial Sequence
  Synthetic Peptide
WVVDRMRI

SEQ ID NO: 4508 - protein, 8 aa, Artificial Sequence
  Synthetic Peptide
RVLEKHGA

SEQ ID NO: 4509 - protein, 8 aa, Artificial Sequence
  Synthetic Peptide
RDLEKHGK

SEQ ID NO: 4510 - protein, 10 aa, Artificial Sequence
  Synthetic Peptide
HVAITSSNTA

SEQ ID NO: 4511 - protein, 10 aa, Artificial Sequence
  Synthetic Peptide
HGAITSSNTK

SEQ ID NO: 4512 - protein, 8 aa, Artificial Sequence
  Synthetic Peptide
AVCAWLEA

SEQ ID NO: 4513 - protein, 8 aa, Artificial Sequence
  Synthetic Peptide
ADCAWLEK

SEQ ID NO: 4514 - protein, 10 aa, Artificial Sequence
  Synthetic Peptide
EVQEEEEVGF

SEQ ID NO: 4515 - protein, 10 aa, Artificial Sequence
  Synthetic Peptide
EAQEEEEVGK

SEQ ID NO: 4516 - protein, 11 aa, Artificial Sequence
  Synthetic Peptide
GVPVRPQVPLR

SEQ ID NO: 4517 - protein, 11 aa, Artificial Sequence
  Synthetic Peptide
GFPVRPQVPLK

SEQ ID NO: 4518 - protein, 9 aa, Artificial Sequence
  Synthetic Peptide
PVRPQVPLK

SEQ ID NO: 4519 - protein, 8 aa, Artificial Sequence
  Synthetic Peptide
PVRPMTYK

SEQ ID NO: 4520 - protein, 9 aa, Artificial Sequence
  Synthetic Peptide
AVDLSFFLK

SEQ ID NO: 4521 - protein, 11 aa, Artificial Sequence
  Synthetic Peptide
AVDLSFFLKEK

SEQ ID NO: 4522 - protein, 8 aa, Artificial Sequence
  Synthetic Peptide
FVLSFFLK

SEQ ID NO: 4523 - protein, 10 aa, Artificial Sequence
  Synthetic Peptide
FVLSFFLKEK

SEQ ID NO: 4524 - protein, 9 aa, Artificial Sequence
  Synthetic Peptide
DVSHFLKEK

SEQ ID NO: 4525 - protein, 9 aa, Artificial Sequence
  Synthetic Peptide
DVSFFLKEK

SEQ ID NO: 4526 - protein, 8 aa, Artificial Sequence
  Synthetic Peptide
LVHFLKEK

SEQ ID NO: 4527 - protein, 8 aa, Artificial Sequence
  Synthetic Peptide
LVFFLKEK

SEQ ID NO: 4528 - protein, 9 aa, Artificial Sequence
  Synthetic Peptide
KVGLEGLIY

SEQ ID NO: 4529 - protein, 9 aa, Artificial Sequence
  Synthetic Peptide
KGGLEGLIK

SEQ ID NO: 4530 - protein, 8 aa, Artificial Sequence
  Synthetic Peptide
GVLEGLIY

SEQ ID NO: 4531 - protein, 8 aa, Artificial Sequence
  Synthetic Peptide
GGLEGLIK

SEQ ID NO: 4532 - protein, 10 aa, Artificial Sequence
  Synthetic Peptide
GVLDGLIYSK

SEQ ID NO: 4533 - protein, 9 aa, Artificial Sequence
  Synthetic Peptide
GVDGLIYSK

SEQ ID NO: 4534 - protein, 8 aa, Artificial Sequence
  Synthetic Peptide
LVGLIYSK

SEQ ID NO: 4535 - protein, 8 aa, Artificial Sequence
  Synthetic Peptide
GVIYSKKR

SEQ ID NO: 4536 - protein, 8 aa, Artificial Sequence
  Synthetic Peptide
GLIYSKKK

SEQ ID NO: 4537 - protein, 9 aa, Artificial Sequence
  Synthetic Peptide
QVILDLWVY

SEQ ID NO: 4538 - protein, 9 aa, Artificial Sequence
  Synthetic Peptide
QDILDLWVK

SEQ ID NO: 4539 - protein, 9 aa, Artificial Sequence
  Synthetic Peptide
EVLDLWVYH

SEQ ID NO: 4540 - protein, 9 aa, Artificial Sequence
  Synthetic Peptide
EILDLWVYK

SEQ ID NO: 4541 - protein, 8 aa, Artificial Sequence
  Synthetic Peptide
IVDLWVYH

SEQ ID NO: 4542 - protein, 8 aa, Artificial Sequence
  Synthetic Peptide
ILDLWVYK

SEQ ID NO: 4543 - protein, 11 aa, Artificial Sequence
  Synthetic Peptide
LVLWVYHTQGY

SEQ ID NO: 4544 - protein, 11 aa, Artificial Sequence
  Synthetic Peptide
LDLWVYHTQGK

SEQ ID NO: 4545 - protein, 10 aa, Artificial Sequence
  Synthetic Peptide
QVFFPDWQNY

SEQ ID NO: 4546 - protein, 10 aa, Artificial Sequence
  Synthetic Peptide
QGFFPDWQNK

SEQ ID NO: 4547 - protein, 9 aa, Artificial Sequence
  Synthetic Peptide
GVFPDWQNY

SEQ ID NO: 4548 - protein, 9 aa, Artificial Sequence
  Synthetic Peptide
GFFPDWQNK

SEQ ID NO: 4549 - protein, 8 aa, Artificial Sequence
  Synthetic Peptide
FVPDWQNY

SEQ ID NO: 4550 - protein, 8 aa, Artificial Sequence
  Synthetic Peptide
FFPDWQNK

SEQ ID NO: 4551 - protein, 8 aa, Artificial Sequence
  Synthetic Peptide
YTPGPGTK

SEQ ID NO: 4552 - protein, 8 aa, Artificial Sequence
  Synthetic Peptide
YTPGPGIK

SEQ ID NO: 4553 - protein, 10 aa, Artificial Sequence
  Synthetic Peptide
RVPLTFGWCF

SEQ ID NO: 4554 - protein, 10 aa, Artificial Sequence
  Synthetic Peptide
RFPLTFGWCK

SEQ ID NO: 4555 - protein, 11 aa, Artificial Sequence
  Synthetic Peptide
RVPLTFGWCFK

SEQ ID NO: 4556 - protein, 9 aa, Artificial Sequence
  Synthetic Peptide
PVTFGWCFK

SEQ ID NO: 4557 - protein, 8 aa, Artificial Sequence
  Synthetic Peptide
LVHPICQH

SEQ ID NO: 4558 - protein, 8 aa, Artificial Sequence
  Synthetic Peptide
LLHPICQK

SEQ ID NO: 4559 - protein, 8 aa, Artificial Sequence
  Synthetic Peptide
LVHPMSQH

SEQ ID NO: 4560 - protein, 8 aa, Artificial Sequence
  Synthetic Peptide
LLHPMSQK

SEQ ID NO: 4561 - protein, 9 aa, Artificial Sequence
  Synthetic Peptide
PTRPQVPLR

SEQ ID NO: 4562 - protein, 11 aa, Artificial Sequence
  Synthetic Peptide
GTPVRPQVPLR

SEQ ID NO: 4563 - protein, 8 aa, Artificial Sequence
  Synthetic Peptide
PTRPMTYK

SEQ ID NO: 4564 - protein, 8 aa, Artificial Sequence
  Synthetic Peptide
EVTRQARR

SEQ ID NO: 4565 - protein, 8 aa, Artificial Sequence
  Synthetic Peptide
EGTRQARK

SEQ ID NO: 4566 - protein, 10 aa, Artificial Sequence
  Synthetic Peptide
EVTRQARRNR

SEQ ID NO: 4567 - protein, 10 aa, Artificial Sequence
  Synthetic Peptide
EGTRQARRNK

SEQ ID NO: 4568 - protein, 11 aa, Artificial Sequence
  Synthetic Peptide
EVTRQARRNRR

SEQ ID NO: 4569 - protein, 11 aa, Artificial Sequence
  Synthetic Peptide
EGTRQARRNRK

SEQ ID NO: 4570 - protein, 9 aa, Artificial Sequence
  Synthetic Peptide
GTRQARRNK

SEQ ID NO: 4571 - protein, 10 aa, Artificial Sequence
  Synthetic Peptide
GTRQARRNRK

SEQ ID NO: 4572 - protein, 11 aa, Artificial Sequence
  Synthetic Peptide
GTRQARRNRRK

SEQ ID NO: 4573 - protein, 9 aa, Artificial Sequence
  Synthetic Peptide
GTRQTRKNK

SEQ ID NO: 4574 - protein, 10 aa, Artificial Sequence
  Synthetic Peptide
GTRQTRKNRK

SEQ ID NO: 4575 - protein, 11 aa, Artificial Sequence
  Synthetic Peptide
GTRQTRKNRRK

SEQ ID NO: 4576 - protein, 11 aa, Artificial Sequence
  Synthetic Peptide
TTRQARRNRRK

SEQ ID NO: 4577 - protein, 8 aa, Artificial Sequence
  Synthetic Peptide
QVRRNRRR

SEQ ID NO: 4578 - protein, 8 aa, Artificial Sequence
  Synthetic Peptide
QARRNRRK

SEQ ID NO: 4579 - protein, 9 aa, Artificial Sequence
  Synthetic Peptide
QVRRNRRRR

SEQ ID NO: 4580 - protein, 9 aa, Artificial Sequence
  Synthetic Peptide
QARRNRRRK

SEQ ID NO: 4581 - protein, 11 aa, Artificial Sequence
  Synthetic Peptide
QVRRNRRRRWR

SEQ ID NO: 4582 - protein, 11 aa, Artificial Sequence
  Synthetic Peptide
QARRNRRRRWK

SEQ ID NO: 4583 - protein, 8 aa, Artificial Sequence
  Synthetic Peptide
QVRKNRRR

SEQ ID NO: 4584 - protein, 8 aa, Artificial Sequence
  Synthetic Peptide
QARKNRRK

SEQ ID NO: 4585 - protein, 9 aa, Artificial Sequence
  Synthetic Peptide
QVRKNRRRR

SEQ ID NO: 4586 - protein, 9 aa, Artificial Sequence
  Synthetic Peptide
QARKNRRRK

SEQ ID NO: 4587 - protein, 11 aa, Artificial Sequence
  Synthetic Peptide
QVRKNRRRRWR

SEQ ID NO: 4588 - protein, 11 aa, Artificial Sequence
  Synthetic Peptide
QARKNRRRRWK

SEQ ID NO: 4589 - protein, 11 aa, Artificial Sequence
  Synthetic Peptide
PVPLQLPPLEK

SEQ ID NO: 4590 - protein, 9 aa, Artificial Sequence
  Synthetic Peptide
PVQLPPLER

SEQ ID NO: 4591 - protein, 9 aa, Artificial Sequence
  Synthetic Peptide
PLQLPPLEK

SEQ ID NO: 4592 - protein, 10 aa, Artificial Sequence
  Synthetic Peptide
VVPNLEPWNH

SEQ ID NO: 4593 - protein, 10 aa, Artificial Sequence
  Synthetic Peptide
VDPNLEPWNK

SEQ ID NO: 4594 - protein, 8 aa, Artificial Sequence
  Synthetic Peptide
PVSQPKTA

SEQ ID NO: 4595 - protein, 8 aa, Artificial Sequence
  Synthetic Peptide
PGSQPKTK

SEQ ID NO: 4596 - protein, 9 aa, Artificial Sequence
  Synthetic Peptide
TVCNNCYCK

SEQ ID NO: 4597 - protein, 8 aa, Artificial Sequence
  Synthetic Peptide
AVNNCYCK

SEQ ID NO: 4598 - protein, 11 aa, Artificial Sequence
  Synthetic Peptide
LVISYGRKKRR

SEQ ID NO: 4599 - protein, 11 aa, Artificial Sequence
  Synthetic Peptide
LGISYGRKKRK

SEQ ID NO: 4600 - protein, 11 aa, Artificial Sequence
  Synthetic Peptide
IVYGRKKRRQR

SEQ ID NO: 4601 - protein, 11 aa, Artificial Sequence
  Synthetic Peptide
ISYGRKKRRQK

SEQ ID NO: 4602 - protein, 9 aa, Artificial Sequence
  Synthetic Peptide
YVRKKRRQR

SEQ ID NO: 4603 - protein, 9 aa, Artificial Sequence
  Synthetic Peptide
YGRKKRRQK

SEQ ID NO: 4604 - protein, 10 aa, Artificial Sequence
  Synthetic Peptide
YVRKKRRQRR

SEQ ID NO: 4605 - protein, 10 aa, Artificial Sequence
  Synthetic Peptide
YGRKKRRQRK

SEQ ID NO: 4606 - protein, 11 aa, Artificial Sequence
  Synthetic Peptide
YVRKKRRQRRR

SEQ ID NO: 4607 - protein, 11 aa, Artificial Sequence
  Synthetic Peptide
YGRKKRRQRRK

SEQ ID NO: 4608 - protein, 8 aa, Artificial Sequence
  Synthetic Peptide
RVDPTGPK

SEQ ID NO: 4609 - protein, 8 aa, Artificial Sequence
  Synthetic Peptide
TVPKESKK

SEQ ID NO: 4610 - protein, 10 aa, Artificial Sequence
  Synthetic Peptide
ETGPSGQPCK

SEQ ID NO: 4611 - protein, 10 aa, Artificial Sequence
  Synthetic Peptide
KVGPGGYPRR

SEQ ID NO: 4612 - protein, 10 aa, Artificial Sequence
  Synthetic Peptide
KAGPGGYPRK

SEQ ID NO: 4613 - protein, 11 aa, Artificial Sequence
  Synthetic Peptide
KVGPGGYPRRK

SEQ ID NO: 4614 - protein, 9 aa, Artificial Sequence
  Synthetic Peptide
AVPGGYPRR

SEQ ID NO: 4615 - protein, 9 aa, Artificial Sequence
  Synthetic Peptide
AGPGGYPRK

SEQ ID NO: 4616 - protein, 9 aa, Artificial Sequence
  Synthetic Peptide
TVPSGQPCH

SEQ ID NO: 4617 - protein, 9 aa, Artificial Sequence
  Synthetic Peptide
TGPSGQPCK

SEQ ID NO: 4618 - protein, 10 aa, Artificial Sequence
  Synthetic Peptide
AVPGGYPRRK

SEQ ID NO: 4619 - protein, 8 aa, Artificial Sequence
  Synthetic Peptide
PVGYPRRK

SEQ ID NO: 4620 - protein, 11 aa, Artificial Sequence
  Synthetic Peptide
GVYPRRKGSCH

SEQ ID NO: 4621 - protein, 11 aa, Artificial Sequence
  Synthetic Peptide
GGYPRRKGSCK

SEQ ID NO: 4622 - protein, 9 aa, Artificial Sequence
  Synthetic Peptide
KTLGISYGR

SEQ ID NO: 4623 - protein, 10 aa, Artificial Sequence
  Synthetic Peptide
KTLGISYGRK

SEQ ID NO: 4624 - protein, 11 aa, Artificial Sequence
  Synthetic Peptide
GTGISYGRKKR

SEQ ID NO: 4625 - protein, 11 aa, Artificial Sequence
  Synthetic Peptide
KTLGISYGRKK

SEQ ID NO: 4626 - protein, 8 aa, Artificial Sequence
  Synthetic Peptide
GTGISYGR

SEQ ID NO: 4627 - protein, 9 aa, Artificial Sequence
  Synthetic Peptide
GTGISYGRK

SEQ ID NO: 4628 - protein, 10 aa, Artificial Sequence
  Synthetic Peptide
GTGISYGRKK

SEQ ID NO: 4629 - protein, 9 aa, Artificial Sequence
  Synthetic Peptide
GTSYGRKKR

SEQ ID NO: 4630 - protein, 10 aa, Artificial Sequence
  Synthetic Peptide
LTISYGRKKR

SEQ ID NO: 4631 - protein, 8 aa, Artificial Sequence
  Synthetic Peptide
GTSYGRKK

SEQ ID NO: 4632 - protein, 8 aa, Artificial Sequence
  Synthetic Peptide
ITYGRKKR

SEQ ID NO: 4633 - protein, 8 aa, Artificial Sequence
  Synthetic Peptide
LTISYGRK

SEQ ID NO: 4634 - protein, 9 aa, Artificial Sequence
  Synthetic Peptide
LTISYGRKK

SEQ ID NO: 4635 - protein, 9 aa, Artificial Sequence
  Synthetic Peptide
KTGSLQYLA

SEQ ID NO: 4636 - protein, 8 aa, Artificial Sequence
  Synthetic Peptide
VTSLQYLA

SEQ ID NO: 4637 - protein, 9 aa, Artificial Sequence
  Synthetic Peptide
KVGSLQYLK

SEQ ID NO: 4638 - protein, 8 aa, Artificial Sequence
  Synthetic Peptide
VGSLQYLK

SEQ ID NO: 4639 - protein, 8 aa, Artificial Sequence
  Synthetic Peptide
ETVRHFPR

SEQ ID NO: 4640 - protein, 8 aa, Artificial Sequence
  Synthetic Peptide
EVHPEYYK

SEQ ID NO: 4641 - protein, 9 aa, Artificial Sequence
  Synthetic Peptide
PTRPQVPLR

SEQ ID NO: 4642 - protein, 8 aa, Artificial Sequence
  Synthetic Peptide
PTRPMTYK

SEQ ID NO: 4643 - protein, 11 aa, Artificial Sequence
  Synthetic Peptide
GTGISYGRKKR

SEQ ID NO: 4644 - protein, 8 aa, Artificial Sequence
  Synthetic Peptide
GTGISYGR

SEQ ID NO: 4645 - protein, 9 aa, Artificial Sequence
  Synthetic Peptide
GTGISYGRK

SEQ ID NO: 4646 - protein, 10 aa, Artificial Sequence
  Synthetic Peptide
GTGISYGRKK

SEQ ID NO: 4647 - protein, 9 aa, Artificial Sequence
  Synthetic Peptide
GTSYGRKKR

SEQ ID NO: 4648 - protein, 8 aa, Artificial Sequence
  Synthetic Peptide
GTSYGRKK

SEQ ID NO: 4649 - protein, 8 aa, Artificial Sequence
  Synthetic Peptide
ITYGRKKR

SEQ ID NO: 4650 - protein, 8 aa, Artificial Sequence
  Synthetic Peptide
ETVRHFPR

SEQ ID NO: 4651 - protein, 10 aa, Artificial Sequence
  Synthetic Peptide
QVYTPGPGTR

SEQ ID NO: 4652 - protein, 10 aa, Artificial Sequence
  Synthetic Peptide
QNYTPGPGTK

SEQ ID NO: 4653 - protein, 10 aa, Artificial Sequence
  Synthetic Peptide
QVYTPGPGIR

SEQ ID NO: 4654 - protein, 10 aa, Artificial Sequence
  Synthetic Peptide
QNYTPGPGIK

SEQ ID NO: 4655 - protein, 9 aa, Artificial Sequence
  Synthetic Peptide
PTRPQVPLR

SEQ ID NO: 4656 - protein, 11 aa, Artificial Sequence
  Synthetic Peptide
GTPVRPQVPLR

SEQ ID NO: 4657 - protein, 8 aa, Artificial Sequence
  Synthetic Peptide
PTRPMTYK

SEQ ID NO: 4658 - protein, 8 aa, Artificial Sequence
  Synthetic Peptide
RVRRRRWR

SEQ ID NO: 4659 - protein, 8 aa, Artificial Sequence
  Synthetic Peptide
RNRRRRWK

SEQ ID NO: 4660 - protein, 10 aa, Artificial Sequence
  Synthetic Peptide
RVRRRRWRAR

SEQ ID NO: 4661 - protein, 10 aa, Artificial Sequence
  Synthetic Peptide
RNRRRRWRAK

SEQ ID NO: 4662 - protein, 8 aa, Artificial Sequence
  Synthetic Peptide
KVRRRRWR

SEQ ID NO: 4663 - protein, 8 aa, Artificial Sequence
  Synthetic Peptide
KNRRRRWK

SEQ ID NO: 4664 - protein, 10 aa, Artificial Sequence
  Synthetic Peptide
KVRRRRWRAR

SEQ ID NO: 4665 - protein, 10 aa, Artificial Sequence
  Synthetic Peptide
KNRRRRWRAK

SEQ ID NO: 4666 - protein, 8 aa, Artificial Sequence
  Synthetic Peptide
PVLEPWNH

SEQ ID NO: 4667 - protein, 8 aa, Artificial Sequence
  Synthetic Peptide
PNLEPWNK

SEQ ID NO: 4668 - protein, 9 aa, Artificial Sequence
  Synthetic Peptide
KTLGISYGR

SEQ ID NO: 4669 - protein, 10 aa, Artificial Sequence
  Synthetic Peptide
KTLGISYGRK

SEQ ID NO: 4670 - protein, 11 aa, Artificial Sequence
  Synthetic Peptide
GTGISYGRKKR

SEQ ID NO: 4671 - protein, 11 aa, Artificial Sequence
  Synthetic Peptide
KTLGISYGRKK

SEQ ID NO: 4672 - protein, 8 aa, Artificial Sequence
  Synthetic Peptide
GTGISYGR

SEQ ID NO: 4673 - protein, 9 aa, Artificial Sequence
  Synthetic Peptide
GTGISYGRK

SEQ ID NO: 4674 - protein, 10 aa, Artificial Sequence
  Synthetic Peptide
GTGISYGRKK

SEQ ID NO: 4675 - protein, 9 aa, Artificial Sequence
  Synthetic Peptide
GTSYGRKKR

SEQ ID NO: 4676 - protein, 10 aa, Artificial Sequence
  Synthetic Peptide
LTISYGRKKR

SEQ ID NO: 4677 - protein, 8 aa, Artificial Sequence
  Synthetic Peptide
GTSYGRKK

SEQ ID NO: 4678 - protein, 8 aa, Artificial Sequence
  Synthetic Peptide
ITYGRKKR

SEQ ID NO: 4679 - protein, 8 aa, Artificial Sequence
  Synthetic Peptide
LTISYGRK

SEQ ID NO: 4680 - protein, 9 aa, Artificial Sequence
  Synthetic Peptide
LTISYGRKK

SEQ ID NO: 4681 - protein, 8 aa, Artificial Sequence
  Synthetic Peptide
ETVRHFPR

SEQ ID NO: 4682 - protein, 10 aa, Artificial Sequence
  Synthetic Peptide
KYSKSSIVGW

SEQ ID NO: 4683 - protein, 10 aa, Artificial Sequence
  Synthetic Peptide
KWSKSSIVGF

SEQ ID NO: 4684 - protein, 10 aa, Artificial Sequence
  Synthetic Peptide
GYPVRPQVPL

SEQ ID NO: 4685 - protein, 10 aa, Artificial Sequence
  Synthetic Peptide
GFPVRPQVPF

SEQ ID NO: 4686 - protein, 8 aa, Artificial Sequence
  Synthetic Peptide
AYDLSFFL

SEQ ID NO: 4687 - protein, 8 aa, Artificial Sequence
  Synthetic Peptide
AFDLSFFF

SEQ ID NO: 4688 - protein, 10 aa, Artificial Sequence
  Synthetic Peptide
SYFLKEKGGL

SEQ ID NO: 4689 - protein, 10 aa, Artificial Sequence
  Synthetic Peptide
SFFLKEKGGF

SEQ ID NO: 4690 - protein, 9 aa, Artificial Sequence
  Synthetic Peptide
HYLKEKGGL

SEQ ID NO: 4691 - protein, 9 aa, Artificial Sequence
  Synthetic Peptide
HFLKEKGGF

SEQ ID NO: 4692 - protein, 9 aa, Artificial Sequence
  Synthetic Peptide
FYLKEKGGL

SEQ ID NO: 4693 - protein, 9 aa, Artificial Sequence
  Synthetic Peptide
FFLKEKGGF

SEQ ID NO: 4694 - protein, 9 aa, Artificial Sequence
  Synthetic Peptide
IYSKKRQEF

SEQ ID NO: 4695 - protein, 10 aa, Artificial Sequence
  Synthetic Peptide
IYSKKRQEIF

SEQ ID NO: 4696 - protein, 10 aa, Artificial Sequence
  Synthetic Peptide
LYVYHTQGYF

SEQ ID NO: 4697 - protein, 11 aa, Artificial Sequence
  Synthetic Peptide
VYHTQGYFPDF

SEQ ID NO: 4698 - protein, 11 aa, Artificial Sequence
  Synthetic Peptide
DYQNYTPGPGI

SEQ ID NO: 4699 - protein, 11 aa, Artificial Sequence
  Synthetic Peptide
DWQNYTPGPGF

SEQ ID NO: 4700 - protein, 8 aa, Artificial Sequence
  Synthetic Peptide
NYTPGPGF

SEQ ID NO: 4701 - protein, 8 aa, Artificial Sequence
  Synthetic Peptide
RYPLTFGF

SEQ ID NO: 4702 - protein, 8 aa, Artificial Sequence
  Synthetic Peptide
RYPLTFGW

SEQ ID NO: 4703 - protein, 8 aa, Artificial Sequence
  Synthetic Peptide
RFPLTFGF

SEQ ID NO: 4704 - protein, 8 aa, Artificial Sequence
  Synthetic Peptide
TYGWCFKL

SEQ ID NO: 4705 - protein, 8 aa, Artificial Sequence
  Synthetic Peptide
TFGWCFKF

SEQ ID NO: 4706 - protein, 10 aa, Artificial Sequence
  Synthetic Peptide
GFPVRPQVPF

SEQ ID NO: 4707 - protein, 10 aa, Artificial Sequence
  Synthetic Peptide
GYPVRPQVPL

SEQ ID NO: 4708 - protein, 9 aa, Artificial Sequence
  Synthetic Peptide
RYRARQRQI

SEQ ID NO: 4709 - protein, 9 aa, Artificial Sequence
  Synthetic Peptide
RWRARQRQF

SEQ ID NO: 4710 - protein, 9 aa, Artificial Sequence
  Synthetic Peptide
VYQVDRMRI

SEQ ID NO: 4711 - protein, 9 aa, Artificial Sequence
  Synthetic Peptide
VWQVDRMRF

SEQ ID NO: 4712 - protein, 9 aa, Artificial Sequence
  Synthetic Peptide
GYGAVSQDL

SEQ ID NO: 4713 - protein, 9 aa, Artificial Sequence
  Synthetic Peptide
GVGAVSQDF

SEQ ID NO: 4714 - protein, 9 aa, Artificial Sequence
  Synthetic Peptide
LYVYHTQGY

SEQ ID NO: 4715 - protein, 9 aa, Artificial Sequence
  Synthetic Peptide
LWVYHTQGF

SEQ ID NO: 4716 - protein, 10 aa, Artificial Sequence
  Synthetic Peptide
NYTPGPGIRF

SEQ ID NO: 4717 - protein, 8 aa, Artificial Sequence
  Synthetic Peptide
PYRPQVPL

SEQ ID NO: 4718 - protein, 10 aa, Artificial Sequence
  Synthetic Peptide
GYPVRPQVPL

SEQ ID NO: 4719 - protein, 8 aa, Artificial Sequence
  Synthetic Peptide
FYKEKGGL

SEQ ID NO: 4720 - protein, 8 aa, Artificial Sequence
  Synthetic Peptide
QYPPLERL

SEQ ID NO: 4721 - protein, 8 aa, Artificial Sequence
  Synthetic Peptide
QLPPLERF

SEQ ID NO: 4722 - protein, 10 aa, Artificial Sequence
  Synthetic Peptide
QYPPLERLTL

SEQ ID NO: 4723 - protein, 10 aa, Artificial Sequence
  Synthetic Peptide
QLPPLERLTF

SEQ ID NO: 4724 - protein, 9 aa, Artificial Sequence
  Synthetic Peptide
VWQVDRMRF

SEQ ID NO: 4725 - protein, 10 aa, Artificial Sequence
  Synthetic Peptide
KYGSLQYLAL

SEQ ID NO: 4726 - protein, 8 aa, Artificial Sequence
  Synthetic Peptide
KYGSLQYL

SEQ ID NO: 4727 - protein, 8 aa, Artificial Sequence
  Synthetic Peptide
IYWQVDRM

SEQ ID NO: 4728 - protein, 8 aa, Artificial Sequence
  Synthetic Peptide
IVWQVDRF

SEQ ID NO: 4729 - protein, 8 aa, Artificial Sequence
  Synthetic Peptide
APTAAKGI

SEQ ID NO: 4730 - protein, 10 aa, Artificial Sequence
  Synthetic Peptide
APTAAKGVGI

SEQ ID NO: 4731 - protein, 11 aa, Artificial Sequence
  Synthetic Peptide
APTAAKGVGAI

SEQ ID NO: 4732 - protein, 9 aa, Artificial Sequence
  Synthetic Peptide
FPVRPQVPI

SEQ ID NO: 4733 - protein, 9 aa, Artificial Sequence
  Synthetic Peptide
RPQVPLRPI

SEQ ID NO: 4734 - protein, 11 aa, Artificial Sequence
  Synthetic Peptide
RPQVPLRPMTI

SEQ ID NO: 4735 - protein, 8 aa, Artificial Sequence
  Synthetic Peptide
VPLRPMTI

SEQ ID NO: 4736 - protein, 11 aa, Artificial Sequence
  Synthetic Peptide
VPLRPMTYKGI

SEQ ID NO: 4737 - protein, 10 aa, Artificial Sequence
  Synthetic Peptide
VPLRPMTYKI

SEQ ID NO: 4738 - protein, 11 aa, Artificial Sequence
  Synthetic Peptide
VPLRPMTYKAI

SEQ ID NO: 4739 - protein, 8 aa, Artificial Sequence
  Synthetic Peptide
RPMTYKAI

SEQ ID NO: 4740 - protein, 8 aa, Artificial Sequence
  Synthetic Peptide
TPGPGIRI

SEQ ID NO: 4741 - protein, 8 aa, Artificial Sequence
  Synthetic Peptide
GPGIRYPI

SEQ ID NO: 4742 - protein, 9 aa, Artificial Sequence
  Synthetic Peptide
YPLTFGWCI

SEQ ID NO: 4743 - protein, 9 aa, Artificial Sequence
  Synthetic Peptide
FPLTFGWCI

SEQ ID NO: 4744 - protein, 11 aa, Artificial Sequence
  Synthetic Peptide
FPLTFGWCFKI

SEQ ID NO: 4745 - protein, 11 aa, Artificial Sequence
  Synthetic Peptide
RPQVPLRPMTI

SEQ ID NO: 4746 - protein, 8 aa, Artificial Sequence
  Synthetic Peptide
VPLRPMTI

SEQ ID NO: 4747 - protein, 9 aa, Artificial Sequence
  Synthetic Peptide
RPQVPLRPI

SEQ ID NO: 4748 - protein, 9 aa, Artificial Sequence
  Synthetic Peptide
FPVRPQVPI

SEQ ID NO: 4749 - protein, 9 aa, Artificial Sequence
  Synthetic Peptide
FPVRPQVPI

SEQ ID NO: 4750 - protein, 8 aa, Artificial Sequence
  Synthetic Peptide
RPAEPVPI

SEQ ID NO: 4751 - protein, 10 aa, Artificial Sequence
  Synthetic Peptide
RPAEPVPLQI

SEQ ID NO: 4752 - protein, 8 aa, Artificial Sequence
  Synthetic Peptide
VPLQLPPI

SEQ ID NO: 4753 - protein, 9 aa, Artificial Sequence
  Synthetic Peptide
LPPLERLTI

SEQ ID NO: 4754 - protein, 8 aa, Artificial Sequence
  Synthetic Peptide
PPLERLTI

SEQ ID NO: 4755 - protein, 10 aa, Artificial Sequence
  Synthetic Peptide
EPVPLQLPPI

SEQ ID NO: 4756 - protein, 11 aa, Artificial Sequence
  Synthetic Peptide
VPLQLPPLERI

SEQ ID NO: 4757 - protein, 8 aa, Artificial Sequence
  Synthetic Peptide
VPLQLPPI

SEQ ID NO: 4758 - protein, 9 aa, Artificial Sequence
  Synthetic Peptide
HPGSQPKTI

SEQ ID NO: 4759 - protein, 10 aa, Artificial Sequence
  Synthetic Peptide
GPQREPYNEI

SEQ ID NO: 4760 - protein, 8 aa, Artificial Sequence
  Synthetic Peptide
QEILDLWV

SEQ ID NO: 4761 - protein, 8 aa, Artificial Sequence
  Synthetic Peptide
GESDEELL

SEQ ID NO: 4762 - protein, 11 aa, Artificial Sequence
  Synthetic Peptide
EECGTSGTQGV

SEQ ID NO: 4763 - protein, 8 aa, Artificial Sequence
  Synthetic Peptide
VEPNLEPW

SEQ ID NO: 4764 - protein, 10 aa, Artificial Sequence
  Synthetic Peptide
KYSKSSIVGW

SEQ ID NO: 4765 - protein, 10 aa, Artificial Sequence
  Synthetic Peptide
KWSKSSIVGF

SEQ ID NO: 4766 - protein, 9 aa, Artificial Sequence
  Synthetic Peptide
WTKSSIVGW

SEQ ID NO: 4767 - protein, 9 aa, Artificial Sequence
  Synthetic Peptide
WSKSSIVGY

SEQ ID NO: 4768 - protein, 9 aa, Artificial Sequence
  Synthetic Peptide
QLEPAAAGV

SEQ ID NO: 4769 - protein, 11 aa, Artificial Sequence
  Synthetic Peptide
QLEPAAAGVGA

SEQ ID NO: 4770 - protein, 11 aa, Artificial Sequence
  Synthetic Peptide
QAEPAAAGVGV

SEQ ID NO: 4771 - protein, 8 aa, Artificial Sequence
  Synthetic Peptide
APTAAKGI

SEQ ID NO: 4772 - protein, 10 aa, Artificial Sequence
  Synthetic Peptide
APTAAKGVGI

SEQ ID NO: 4773 - protein, 11 aa, Artificial Sequence
  Synthetic Peptide
APTAAKGVGAI

SEQ ID NO: 4774 - protein, 8 aa, Artificial Sequence
  Synthetic Peptide
PLAEGVGA

SEQ ID NO: 4775 - protein, 8 aa, Artificial Sequence
  Synthetic Peptide
PAAEGVGV

SEQ ID NO: 4776 - protein, 8 aa, Artificial Sequence
  Synthetic Peptide
ALEGVGAV

SEQ ID NO: 4777 - protein, 9 aa, Artificial Sequence
  Synthetic Peptide
GLGAVSRDL

SEQ ID NO: 4778 - protein, 9 aa, Artificial Sequence
  Synthetic Peptide
GVGAVSRDV

SEQ ID NO: 4779 - protein, 9 aa, Artificial Sequence
  Synthetic Peptide
GYGAVSQDL

SEQ ID NO: 4780 - protein, 9 aa, Artificial Sequence
  Synthetic Peptide
GVGAVSQDF

SEQ ID NO: 4781 - protein, 8 aa, Artificial Sequence
  Synthetic Peptide
RVLEKHGA

SEQ ID NO: 4782 - protein, 8 aa, Artificial Sequence
  Synthetic Peptide
RDLEKHGK

SEQ ID NO: 4783 - protein, 10 aa, Artificial Sequence
  Synthetic Peptide
HVAITSSNTA

SEQ ID NO: 4784 - protein, 10 aa, Artificial Sequence
  Synthetic Peptide
HGAITSSNTK

SEQ ID NO: 4785 - protein, 8 aa, Artificial Sequence
  Synthetic Peptide
GLITSSNT

SEQ ID NO: 4786 - protein, 8 aa, Artificial Sequence
  Synthetic Peptide
GAITSSNV

SEQ ID NO: 4787 - protein, 9 aa, Artificial Sequence
  Synthetic Peptide
GLITSSNTA

SEQ ID NO: 4788 - protein, 9 aa, Artificial Sequence
  Synthetic Peptide
GAITSSNTV

SEQ ID NO: 4789 - protein, 8 aa, Artificial Sequence
  Synthetic Peptide
ALTSSNTA

SEQ ID NO: 4790 - protein, 8 aa, Artificial Sequence
  Synthetic Peptide
AITSSNTV

SEQ ID NO: 4791 - protein, 9 aa, Artificial Sequence
  Synthetic Peptide
NLDCAWLEA

SEQ ID NO: 4792 - protein, 9 aa, Artificial Sequence
  Synthetic Peptide
NADCAWLEV

SEQ ID NO: 4793 - protein, 8 aa, Artificial Sequence
  Synthetic Peptide
AVCAWLEA

SEQ ID NO: 4794 - protein, 8 aa, Artificial Sequence
  Synthetic Peptide
ADCAWLEK

SEQ ID NO: 4795 - protein, 8 aa, Artificial Sequence
  Synthetic Peptide
ELQEEEEV

SEQ ID NO: 4796 - protein, 10 aa, Artificial Sequence
  Synthetic Peptide
EVQEEEEVGF

SEQ ID NO: 4797 - protein, 10 aa, Artificial Sequence
  Synthetic Peptide
EAQEEEEVGK

SEQ ID NO: 4798 - protein, 11 aa, Artificial Sequence
  Synthetic Peptide
ALEEEEVGFPV

SEQ ID NO: 4799 - protein, 10 aa, Artificial Sequence
  Synthetic Peptide
ELGFPVRPQV

SEQ ID NO: 4800 - protein, 11 aa, Artificial Sequence
  Synthetic Peptide
GVPVRPQVPLR

SEQ ID NO: 4801 - protein, 11 aa, Artificial Sequence
  Synthetic Peptide
GFPVRPQVPLK

SEQ ID NO: 4802 - protein, 10 aa, Artificial Sequence
  Synthetic Peptide
GYPVRPQVPL

SEQ ID NO: 4803 - protein, 10 aa, Artificial Sequence
  Synthetic Peptide
GFPVRPQVPF

SEQ ID NO: 4804 - protein, 9 aa, Artificial Sequence
  Synthetic Peptide
FPVRPQVPI

SEQ ID NO: 4805 - protein, 8 aa, Artificial Sequence
  Synthetic Peptide
PLRPQVPL

SEQ ID NO: 4806 - protein, 8 aa, Artificial Sequence
  Synthetic Peptide
PVRPQVPV

SEQ ID NO: 4807 - protein, 11 aa, Artificial Sequence
  Synthetic Peptide
PLRPQVPLRPM

SEQ ID NO: 4808 - protein, 11 aa, Artificial Sequence
  Synthetic Peptide
PVRPQVPLRPV

SEQ ID NO: 4809 - protein, 9 aa, Artificial Sequence
  Synthetic Peptide
PVRPQVPLK

SEQ ID NO: 4810 - protein, 9 aa, Artificial Sequence
  Synthetic Peptide
RPQVPLRPI

SEQ ID NO: 4811 - protein, 11 aa, Artificial Sequence
  Synthetic Peptide
RPQVPLRPMTI

SEQ ID NO: 4812 - protein, 8 aa, Artificial Sequence
  Synthetic Peptide
PLVPLRPM

SEQ ID NO: 4813 - protein, 8 aa, Artificial Sequence
  Synthetic Peptide
PQVPLRPV

SEQ ID NO: 4814 - protein, 9 aa, Artificial Sequence
  Synthetic Peptide
PLVPLRPMT

SEQ ID NO: 4815 - protein, 9 aa, Artificial Sequence
  Synthetic Peptide
PQVPLRPMV

SEQ ID NO: 4816 - protein, 9 aa, Artificial Sequence
  Synthetic Peptide
QTPLRPMTY

SEQ ID NO: 4817 - protein, 8 aa, Artificial Sequence
  Synthetic Peptide
QLPLRPMT

SEQ ID NO: 4818 - protein, 8 aa, Artificial Sequence
  Synthetic Peptide
QVPLRPMV

SEQ ID NO: 4819 - protein, 11 aa, Artificial Sequence
  Synthetic Peptide
QLPLRPMTYKA

SEQ ID NO: 4820 - protein, 11 aa, Artificial Sequence
  Synthetic Peptide
QVPLRPMTYKV

SEQ ID NO: 4821 - protein, 8 aa, Artificial Sequence
  Synthetic Peptide
VPLRPMTI

SEQ ID NO: 4822 - protein, 11 aa, Artificial Sequence
  Synthetic Peptide
VPLRPMTYKGI

SEQ ID NO: 4823 - protein, 10 aa, Artificial Sequence
  Synthetic Peptide
VPLRPMTYKI

SEQ ID NO: 4824 - protein, 11 aa, Artificial Sequence
  Synthetic Peptide
VPLRPMTYKAI

SEQ ID NO: 4825 - protein, 10 aa, Artificial Sequence
  Synthetic Peptide
PLRPMTYKGV

SEQ ID NO: 4826 - protein, 9 aa, Artificial Sequence
  Synthetic Peptide
PLRPMTYKV

SEQ ID NO: 4827 - protein, 10 aa, Artificial Sequence
  Synthetic Peptide
PLRPMTYKAV

SEQ ID NO: 4828 - protein, 8 aa, Artificial Sequence
  Synthetic Peptide
PVRPMTYK

SEQ ID NO: 4829 - protein, 8 aa, Artificial Sequence
  Synthetic Peptide
RPMTYKAI

SEQ ID NO: 4830 - protein, 9 aa, Artificial Sequence
  Synthetic Peptide
AVDLSFFLK

SEQ ID NO: 4831 - protein, 11 aa, Artificial Sequence
  Synthetic Peptide
AVDLSFFLKEK

SEQ ID NO: 4832 - protein, 8 aa, Artificial Sequence
  Synthetic Peptide
AYDLSFFL

SEQ ID NO: 4833 - protein, 8 aa, Artificial Sequence
  Synthetic Peptide
AFDLSFFF

SEQ ID NO: 4834 - protein, 8 aa, Artificial Sequence
  Synthetic Peptide
FVLSFFLK

SEQ ID NO: 4835 - protein, 10 aa, Artificial Sequence
  Synthetic Peptide
FVLSFFLKEK

SEQ ID NO: 4836 - protein, 9 aa, Artificial Sequence
  Synthetic Peptide
DVSHFLKEK

SEQ ID NO: 4837 - protein, 9 aa, Artificial Sequence
  Synthetic Peptide
DVSFFLKEK

SEQ ID NO: 4838 - protein, 8 aa, Artificial Sequence
  Synthetic Peptide
LVHFLKEK

SEQ ID NO: 4839 - protein, 8 aa, Artificial Sequence
  Synthetic Peptide
LVFFLKEK

SEQ ID NO: 4840 - protein, 10 aa, Artificial Sequence
  Synthetic Peptide
SYFLKEKGGL

SEQ ID NO: 4841 - protein, 10 aa, Artificial Sequence
  Synthetic Peptide
SFFLKEKGGF

SEQ ID NO: 4842 - protein, 9 aa, Artificial Sequence
  Synthetic Peptide
HYLKEKGGL

SEQ ID NO: 4843 - protein, 9 aa, Artificial Sequence
  Synthetic Peptide
HFLKEKGGF

SEQ ID NO: 4844 - protein, 9 aa, Artificial Sequence
  Synthetic Peptide
FYLKEKGGL

SEQ ID NO: 4845 - protein, 9 aa, Artificial Sequence
  Synthetic Peptide
FFLKEKGGF

SEQ ID NO: 4846 - protein, 8 aa, Artificial Sequence
  Synthetic Peptide
FLKEKGGV

SEQ ID NO: 4847 - protein, 11 aa, Artificial Sequence
  Synthetic Peptide
FLKEKGGLEGV

SEQ ID NO: 4848 - protein, 11 aa, Artificial Sequence
  Synthetic Peptide
FLKEKGGLDGV

SEQ ID NO: 4849 - protein, 9 aa, Artificial Sequence
  Synthetic Peptide
KVGLEGLIY

SEQ ID NO: 4850 - protein, 9 aa, Artificial Sequence
  Synthetic Peptide
KGGLEGLIK

SEQ ID NO: 4851 - protein, 8 aa, Artificial Sequence
  Synthetic Peptide
GVLEGLIY

SEQ ID NO: 4852 - protein, 8 aa, Artificial Sequence
  Synthetic Peptide
GGLEGLIK

SEQ ID NO: 4853 - protein, 10 aa, Artificial Sequence
  Synthetic Peptide
GVLDGLIYSK

SEQ ID NO: 4854 - protein, 9 aa, Artificial Sequence
  Synthetic Peptide
GVDGLIYSK

SEQ ID NO: 4855 - protein, 8 aa, Artificial Sequence
  Synthetic Peptide
LVGLIYSK

SEQ ID NO: 4856 - protein, 11 aa, Artificial Sequence
  Synthetic Peptide
GLIYSKKRQEV

SEQ ID NO: 4857 - protein, 8 aa, Artificial Sequence
  Synthetic Peptide
GVIYSKKR

SEQ ID NO: 4858 - protein, 8 aa, Artificial Sequence
  Synthetic Peptide
GLIYSKKK

SEQ ID NO: 4859 - protein, 10 aa, Artificial Sequence
  Synthetic Peptide
LLYSKKRQEI

SEQ ID NO: 4860 - protein, 10 aa, Artificial Sequence
  Synthetic Peptide
LIYSKKRQEV

SEQ ID NO: 4861 - protein, 11 aa, Artificial Sequence
  Synthetic Peptide
LLYSKKRQEIL

SEQ ID NO: 4862 - protein, 11 aa, Artificial Sequence
  Synthetic Peptide
LIYSKKRQEIV

SEQ ID NO: 4863 - protein, 9 aa, Artificial Sequence
  Synthetic Peptide
IYSKKRQEF

SEQ ID NO: 4864 - protein, 10 aa, Artificial Sequence
  Synthetic Peptide
IYSKKRQEIF

SEQ ID NO: 4865 - protein, 10 aa, Artificial Sequence
  Synthetic Peptide
RTEILDLWVY

SEQ ID NO: 4866 - protein, 10 aa, Artificial Sequence
  Synthetic Peptide
RQDILDLWVY

SEQ ID NO: 4867 - protein, 10 aa, Artificial Sequence
  Synthetic Peptide
RTDILDLWVY

SEQ ID NO: 4868 - protein, 9 aa, Artificial Sequence
  Synthetic Peptide
RLEILDLWV

SEQ ID NO: 4869 - protein, 9 aa, Artificial Sequence
  Synthetic Peptide
RLDILDLWV

SEQ ID NO: 4870 - protein, 9 aa, Artificial Sequence
  Synthetic Peptide
QVILDLWVY

SEQ ID NO: 4871 - protein, 9 aa, Artificial Sequence
  Synthetic Peptide
QDILDLWVK

SEQ ID NO: 4872 - protein, 8 aa, Artificial Sequence
  Synthetic Peptide
QEILDLWV

SEQ ID NO: 4873 - protein, 8 aa, Artificial Sequence
  Synthetic Peptide
ETLDLWVY

SEQ ID NO: 4874 - protein, 8 aa, Artificial Sequence
  Synthetic Peptide
DTLDLWVY

SEQ ID NO: 4875 - protein, 10 aa, Artificial Sequence
  Synthetic Peptide
ELLDLWVYHT

SEQ ID NO: 4876 - protein, 10 aa, Artificial Sequence
  Synthetic Peptide
EILDLWVYHV

SEQ ID NO: 4877 - protein, 9 aa, Artificial Sequence
  Synthetic Peptide
EVLDLWVYH

SEQ ID NO: 4878 - protein, 9 aa, Artificial Sequence
  Synthetic Peptide
EILDLWVYK

SEQ ID NO: 4879 - protein, 9 aa, Artificial Sequence
  Synthetic Peptide
ILDLWVYHV

SEQ ID NO: 4880 - protein, 9 aa, Artificial Sequence
  Synthetic Peptide
ILDLWVYNV

SEQ ID NO: 4881 - protein, 8 aa, Artificial Sequence
  Synthetic Peptide
IVDLWVYH

SEQ ID NO: 4882 - protein, 8 aa, Artificial Sequence
  Synthetic Peptide
ILDLWVYK

SEQ ID NO: 4883 - protein, 11 aa, Artificial Sequence
  Synthetic Peptide
LVLWVYHTQGY

SEQ ID NO: 4884 - protein, 11 aa, Artificial Sequence
  Synthetic Peptide
LDLWVYHTQGK

SEQ ID NO: 4885 - protein, 10 aa, Artificial Sequence
  Synthetic Peptide
DTWVYHTQGY

SEQ ID NO: 4886 - protein, 11 aa, Artificial Sequence
  Synthetic Peptide
DTWVYHTQGYF

SEQ ID NO: 4887 - protein, 11 aa, Artificial Sequence
  Synthetic Peptide
DLWVYHTQGYY

SEQ ID NO: 4888 - protein, 10 aa, Artificial Sequence
  Synthetic Peptide
LYVYHTQGYF

SEQ ID NO: 4889 - protein, 9 aa, Artificial Sequence
  Synthetic Peptide
LYVYHTQGY

SEQ ID NO: 4890 - protein, 9 aa, Artificial Sequence
  Synthetic Peptide
LWVYHTQGF

SEQ ID NO: 4891 - protein, 8 aa, Artificial Sequence
  Synthetic Peptide
WTYHTQGY

SEQ ID NO: 4892 - protein, 9 aa, Artificial Sequence
  Synthetic Peptide
WTYHTQGYF

SEQ ID NO: 4893 - protein, 9 aa, Artificial Sequence
  Synthetic Peptide
WVYHTQGYY

SEQ ID NO: 4894 - protein, 11 aa, Artificial Sequence
  Synthetic Peptide
VYHTQGYFPDF

SEQ ID NO: 4895 - protein, 10 aa, Artificial Sequence
  Synthetic Peptide
QVFFPDWQNY

SEQ ID NO: 4896 - protein, 10 aa, Artificial Sequence
  Synthetic Peptide
QGFFPDWQNK

SEQ ID NO: 4897 - protein, 9 aa, Artificial Sequence
  Synthetic Peptide
GVFPDWQNY

SEQ ID NO: 4898 - protein, 9 aa, Artificial Sequence
  Synthetic Peptide
GFFPDWQNK

SEQ ID NO: 4899 - protein, 8 aa, Artificial Sequence
  Synthetic Peptide
FVPDWQNY

SEQ ID NO: 4900 - protein, 8 aa, Artificial Sequence
  Synthetic Peptide
FFPDWQNK

SEQ ID NO: 4901 - protein, 11 aa, Artificial Sequence
  Synthetic Peptide
DYQNYTPGPGI

SEQ ID NO: 4902 - protein, 11 aa, Artificial Sequence
  Synthetic Peptide
DWQNYTPGPGF

SEQ ID NO: 4903 - protein, 10 aa, Artificial Sequence
  Synthetic Peptide
WLNYTPGPGT

SEQ ID NO: 4904 - protein, 10 aa, Artificial Sequence
  Synthetic Peptide
WQNYTPGPGV

SEQ ID NO: 4905 - protein, 10 aa, Artificial Sequence
  Synthetic Peptide
WLNYTPGPGI

SEQ ID NO: 4906 - protein, 10 aa, Artificial Sequence
  Synthetic Peptide
WQNYTPGPGV

SEQ ID NO: 4907 - protein, 10 aa, Artificial Sequence
  Synthetic Peptide
QVYTPGPGTR

SEQ ID NO: 4908 - protein, 10 aa, Artificial Sequence
  Synthetic Peptide
QNYTPGPGTK

SEQ ID NO: 4909 - protein, 10 aa, Artificial Sequence
  Synthetic Peptide
QVYTPGPGIR

SEQ ID NO: 4910 - protein, 10 aa, Artificial Sequence
  Synthetic Peptide
QNYTPGPGIK

SEQ ID NO: 4911 - protein, 8 aa, Artificial Sequence
  Synthetic Peptide
NYTPGPGF

SEQ ID NO: 4912 - protein, 10 aa, Artificial Sequence
  Synthetic Peptide
NYTPGPGIRF

SEQ ID NO: 4913 - protein, 9 aa, Artificial Sequence
  Synthetic Peptide
YTDGPGIRY

SEQ ID NO: 4914 - protein, 11 aa, Artificial Sequence
  Synthetic Peptide
YLPGPGIRYPL

SEQ ID NO: 4915 - protein, 11 aa, Artificial Sequence
  Synthetic Peptide
YTPGPGIRYPV

SEQ ID NO: 4916 - protein, 8 aa, Artificial Sequence
  Synthetic Peptide
YTPGPGTK

SEQ ID NO: 4917 - protein, 8 aa, Artificial Sequence
  Synthetic Peptide
YTPGPGIK

SEQ ID NO: 4918 - protein, 8 aa, Artificial Sequence
  Synthetic Peptide
TPGPGIRI

SEQ ID NO: 4919 - protein, 8 aa, Artificial Sequence
  Synthetic Peptide
GPGIRYPI

SEQ ID NO: 4920 - protein, 10 aa, Artificial Sequence
  Synthetic Peptide
RVPLTFGWCF

SEQ ID NO: 4921 - protein, 10 aa, Artificial Sequence
  Synthetic Peptide
RFPLTFGWCK

SEQ ID NO: 4922 - protein, 11 aa, Artificial Sequence
  Synthetic Peptide
RVPLTFGWCFK

SEQ ID NO: 4923 - protein, 8 aa, Artificial Sequence
  Synthetic Peptide
RYPLTFGF

SEQ ID NO: 4924 - protein, 8 aa, Artificial Sequence
  Synthetic Peptide
RYPLTFGW

SEQ ID NO: 4925 - protein, 8 aa, Artificial Sequence
  Synthetic Peptide
RFPLTFGF

SEQ ID NO: 4926 - protein, 9 aa, Artificial Sequence
  Synthetic Peptide
YPLTFGWCI

SEQ ID NO: 4927 - protein, 9 aa, Artificial Sequence
  Synthetic Peptide
FPLTFGWCI

SEQ ID NO: 4928 - protein, 11 aa, Artificial Sequence
  Synthetic Peptide
FPLTFGWCFKI

SEQ ID NO: 4929 - protein, 8 aa, Artificial Sequence
  Synthetic Peptide
PTTFGWCF

SEQ ID NO: 4930 - protein, 8 aa, Artificial Sequence
  Synthetic Peptide
PLTFGWCY

SEQ ID NO: 4931 - protein, 10 aa, Artificial Sequence
  Synthetic Peptide
PLTFGWCFKV

SEQ ID NO: 4932 - protein, 9 aa, Artificial Sequence
  Synthetic Peptide
PVTFGWCFK

SEQ ID NO: 4933 - protein, 9 aa, Artificial Sequence
  Synthetic Peptide
LLFGWCFKL

SEQ ID NO: 4934 - protein, 9 aa, Artificial Sequence
  Synthetic Peptide
LTFGWCFKV

SEQ ID NO: 4935 - protein, 10 aa, Artificial Sequence
  Synthetic Peptide
LLFGWCFKLV

SEQ ID NO: 4936 - protein, 8 aa, Artificial Sequence
  Synthetic Peptide
TYGWCFKL

SEQ ID NO: 4937 - protein, 8 aa, Artificial Sequence
  Synthetic Peptide
TFGWCFKF

SEQ ID NO: 4938 - protein, 8 aa, Artificial Sequence
  Synthetic Peptide
LVHPICQH

SEQ ID NO: 4939 - protein, 8 aa, Artificial Sequence
  Synthetic Peptide
LLHPICQK

SEQ ID NO: 4940 - protein, 8 aa, Artificial Sequence
  Synthetic Peptide
LVHPMSQH

SEQ ID NO: 4941 - protein, 8 aa, Artificial Sequence
  Synthetic Peptide
LLHPMSQK

SEQ ID NO: 4942 - protein, 8 aa, Artificial Sequence
  Synthetic Peptide
ATELHPEY

SEQ ID NO: 4943 - protein, 8 aa, Artificial Sequence
  Synthetic Peptide
ARDLHPEY

SEQ ID NO: 4944 - protein, 9 aa, Artificial Sequence
  Synthetic Peptide
ATELHPEYY

SEQ ID NO: 4945 - protein, 9 aa, Artificial Sequence
  Synthetic Peptide
ARDLHPEYY

SEQ ID NO: 4946 - protein, 8 aa, Artificial Sequence
  Synthetic Peptide
EVHPEYYK

SEQ ID NO: 4947 - protein, 8 aa, Artificial Sequence
  Synthetic Peptide
ETLDLWVY

SEQ ID NO: 4948 - protein, 11 aa, Artificial Sequence
  Synthetic Peptide
RPQVPLRPMTI

SEQ ID NO: 4949 - protein, 9 aa, Artificial Sequence
  Synthetic Peptide
QTPLRPMTY

SEQ ID NO: 4950 - protein, 8 aa, Artificial Sequence
  Synthetic Peptide
VPLRPMTI

SEQ ID NO: 4951 - protein, 9 aa, Artificial Sequence
  Synthetic Peptide
RPQVPLRPI

SEQ ID NO: 4952 - protein, 8 aa, Artificial Sequence
  Synthetic Peptide
PVRPQVPV

SEQ ID NO: 4953 - protein, 8 aa, Artificial Sequence
  Synthetic Peptide
PYRPQVPL

SEQ ID NO: 4954 - protein, 9 aa, Artificial Sequence
  Synthetic Peptide
FPVRPQVPI

SEQ ID NO: 4955 - protein, 9 aa, Artificial Sequence
  Synthetic Peptide
FPVRPQVPI

SEQ ID NO: 4956 - protein, 9 aa, Artificial Sequence
  Synthetic Peptide
PTRPQVPLR

SEQ ID NO: 4957 - protein, 9 aa, Artificial Sequence
  Synthetic Peptide
PTRPQVPLR

SEQ ID NO: 4958 - protein, 9 aa, Artificial Sequence
  Synthetic Peptide
PTRPQVPLR

SEQ ID NO: 4959 - protein, 10 aa, Artificial Sequence
  Synthetic Peptide
GFPVRPQVPF

SEQ ID NO: 4960 - protein, 10 aa, Artificial Sequence
  Synthetic Peptide
GYPVRPQVPL

SEQ ID NO: 4961 - protein, 11 aa, Artificial Sequence
  Synthetic Peptide
GTPVRPQVPLR

SEQ ID NO: 4962 - protein, 11 aa, Artificial Sequence
  Synthetic Peptide
GTPVRPQVPLR

SEQ ID NO: 4963 - protein, 8 aa, Artificial Sequence
  Synthetic Peptide
PTRPMTYK

SEQ ID NO: 4964 - protein, 8 aa, Artificial Sequence
  Synthetic Peptide
PTRPMTYK

SEQ ID NO: 4965 - protein, 8 aa, Artificial Sequence
  Synthetic Peptide
PTRPMTYK

SEQ ID NO: 4966 - protein, 8 aa, Artificial Sequence
  Synthetic Peptide
FLKEKGGV

SEQ ID NO: 4967 - protein, 8 aa, Artificial Sequence
  Synthetic Peptide
FYKEKGGL

SEQ ID NO: 4968 - protein, 8 aa, Artificial Sequence
  Synthetic Peptide
PQVPLRPV

SEQ ID NO: 4969 - protein, 9 aa, Artificial Sequence
  Synthetic Peptide
PQVPLRPMV

SEQ ID NO: 4970 - protein, 8 aa, Artificial Sequence
  Synthetic Peptide
QVPLRPMV

SEQ ID NO: 4971 - protein, 8 aa, Artificial Sequence
  Synthetic Peptide
PLRPQVPL

SEQ ID NO: 4972 - protein, 10 aa, Artificial Sequence
  Synthetic Peptide
GYPVRPQVPL

SEQ ID NO: 4973 - protein, 8 aa, Artificial Sequence
  Synthetic Peptide
FVKEKGGL

SEQ ID NO: 4974 - protein, 8 aa, Artificial Sequence
  Synthetic Peptide
PLVPLRPM

SEQ ID NO: 4975 - protein, 9 aa, Artificial Sequence
  Synthetic Peptide
PLVPLRPMT

SEQ ID NO: 4976 - protein, 8 aa, Artificial Sequence
  Synthetic Peptide
QLPLRPMT

SEQ ID NO: 4977 - protein, 8 aa, Artificial Sequence
  Synthetic Peptide
PVVPLRPM

SEQ ID NO: 4978 - protein, 9 aa, Artificial Sequence
  Synthetic Peptide
PVVPLRPMT

SEQ ID NO: 4979 - protein, 8 aa, Artificial Sequence
  Synthetic Peptide
GESDEELL

SEQ ID NO: 4980 - protein, 11 aa, Artificial Sequence
  Synthetic Peptide
ITKILYQSNPY

SEQ ID NO: 4981 - protein, 9 aa, Artificial Sequence
  Synthetic Peptide
KTLYQSNPY

SEQ ID NO: 4982 - protein, 8 aa, Artificial Sequence
  Synthetic Peptide
ITYQSNPY

SEQ ID NO: 4983 - protein, 8 aa, Artificial Sequence
  Synthetic Peptide
EVTRQARR

SEQ ID NO: 4984 - protein, 8 aa, Artificial Sequence
  Synthetic Peptide
EGTRQARK

SEQ ID NO: 4985 - protein, 10 aa, Artificial Sequence
  Synthetic Peptide
EVTRQARRNR

SEQ ID NO: 4986 - protein, 10 aa, Artificial Sequence
  Synthetic Peptide
EGTRQARRNK

SEQ ID NO: 4987 - protein, 11 aa, Artificial Sequence
  Synthetic Peptide
EVTRQARRNRR

SEQ ID NO: 4988 - protein, 11 aa, Artificial Sequence
  Synthetic Peptide
EGTRQARRNRK

SEQ ID NO: 4989 - protein, 9 aa, Artificial Sequence
  Synthetic Peptide
GTRQARRNK

SEQ ID NO: 4990 - protein, 10 aa, Artificial Sequence
  Synthetic Peptide
GTRQARRNRK

SEQ ID NO: 4991 - protein, 11 aa, Artificial Sequence
  Synthetic Peptide
GTRQARRNRRK

SEQ ID NO: 4992 - protein, 9 aa, Artificial Sequence
  Synthetic Peptide
GTRQTRKNK

SEQ ID NO: 4993 - protein, 10 aa, Artificial Sequence
  Synthetic Peptide
GTRQTRKNRK

SEQ ID NO: 4994 - protein, 11 aa, Artificial Sequence
  Synthetic Peptide
GTRQTRKNRRK

SEQ ID NO: 4995 - protein, 11 aa, Artificial Sequence
  Synthetic Peptide
TTRQARRNRRK

SEQ ID NO: 4996 - protein, 8 aa, Artificial Sequence
  Synthetic Peptide
QVRRNRRR

SEQ ID NO: 4997 - protein, 8 aa, Artificial Sequence
  Synthetic Peptide
QARRNRRK

SEQ ID NO: 4998 - protein, 9 aa, Artificial Sequence
  Synthetic Peptide
QVRRNRRRR

SEQ ID NO: 4999 - protein, 9 aa, Artificial Sequence
  Synthetic Peptide
QARRNRRRK

SEQ ID NO: 5000 - protein, 11 aa, Artificial Sequence
  Synthetic Peptide
QVRRNRRRRWR

SEQ ID NO: 5001 - protein, 11 aa, Artificial Sequence
  Synthetic Peptide
QARRNRRRRWK

SEQ ID NO: 5002 - protein, 8 aa, Artificial Sequence
  Synthetic Peptide
QVRKNRRR

SEQ ID NO: 5003 - protein, 8 aa, Artificial Sequence
  Synthetic Peptide
QARKNRRK

SEQ ID NO: 5004 - protein, 9 aa, Artificial Sequence
  Synthetic Peptide
QVRKNRRRR

SEQ ID NO: 5005 - protein, 9 aa, Artificial Sequence
  Synthetic Peptide
QARKNRRRK

SEQ ID NO: 5006 - protein, 11 aa, Artificial Sequence
  Synthetic Peptide
QVRKNRRRRWR

SEQ ID NO: 5007 - protein, 11 aa, Artificial Sequence
  Synthetic Peptide
QARKNRRRRWK

SEQ ID NO: 5008 - protein, 8 aa, Artificial Sequence
  Synthetic Peptide
RVRRRRWR

SEQ ID NO: 5009 - protein, 8 aa, Artificial Sequence
  Synthetic Peptide
RNRRRRWK

SEQ ID NO: 5010 - protein, 10 aa, Artificial Sequence
  Synthetic Peptide
RVRRRRWRAR

SEQ ID NO: 5011 - protein, 10 aa, Artificial Sequence
  Synthetic Peptide
RNRRRRWRAK

SEQ ID NO: 5012 - protein, 8 aa, Artificial Sequence
  Synthetic Peptide
KVRRRRWR

SEQ ID NO: 5013 - protein, 8 aa, Artificial Sequence
  Synthetic Peptide
KNRRRRWK

SEQ ID NO: 5014 - protein, 10 aa, Artificial Sequence
  Synthetic Peptide
KVRRRRWRAR

SEQ ID NO: 5015 - protein, 10 aa, Artificial Sequence
  Synthetic Peptide
KNRRRRWRAK

SEQ ID NO: 5016 - protein, 9 aa, Artificial Sequence
  Synthetic Peptide
RYRARQRQI

SEQ ID NO: 5017 - protein, 9 aa, Artificial Sequence
  Synthetic Peptide
RWRARQRQF

SEQ ID NO: 5018 - protein, 8 aa, Artificial Sequence
  Synthetic Peptide
RPAEPVPI

SEQ ID NO: 5019 - protein, 10 aa, Artificial Sequence
  Synthetic Peptide
RPAEPVPLQI

SEQ ID NO: 5020 - protein, 9 aa, Artificial Sequence
  Synthetic Peptide
PLEPVPLQL

SEQ ID NO: 5021 - protein, 9 aa, Artificial Sequence
  Synthetic Peptide
PAEPVPLQV

SEQ ID NO: 5022 - protein, 9 aa, Artificial Sequence
  Synthetic Peptide
PLPLQLPPL

SEQ ID NO: 5023 - protein, 9 aa, Artificial Sequence
  Synthetic Peptide
PVPLQLPPV

SEQ ID NO: 5024 - protein, 11 aa, Artificial Sequence
  Synthetic Peptide
PVPLQLPPLEK

SEQ ID NO: 5025 - protein, 8 aa, Artificial Sequence
  Synthetic Peptide
VPLQLPPI

SEQ ID NO: 5026 - protein, 10 aa, Artificial Sequence
  Synthetic Peptide
PLQLPPLERV

SEQ ID NO: 5027 - protein, 9 aa, Artificial Sequence
  Synthetic Peptide
PVQLPPLER

SEQ ID NO: 5028 - protein, 9 aa, Artificial Sequence
  Synthetic Peptide
PLQLPPLEK

SEQ ID NO: 5029 - protein, 9 aa, Artificial Sequence
  Synthetic Peptide
LLLPPLERL

SEQ ID NO: 5030 - protein, 9 aa, Artificial Sequence
  Synthetic Peptide
LQLPPLERV

SEQ ID NO: 5031 - protein, 10 aa, Artificial Sequence
  Synthetic Peptide
LLLPPLERLT

SEQ ID NO: 5032 - protein, 10 aa, Artificial Sequence
  Synthetic Peptide
LQLPPLERLV

SEQ ID NO: 5033 - protein, 11 aa, Artificial Sequence
  Synthetic Peptide
LLLPPLERLTL

SEQ ID NO: 5034 - protein, 11 aa, Artificial Sequence
  Synthetic Peptide
LQLPPLERLTV

SEQ ID NO: 5035 - protein, 9 aa, Artificial Sequence
  Synthetic Peptide
QLPPLERLV

SEQ ID NO: 5036 - protein, 8 aa, Artificial Sequence
  Synthetic Peptide
QYPPLERL

SEQ ID NO: 5037 - protein, 8 aa, Artificial Sequence
  Synthetic Peptide
QLPPLERF

SEQ ID NO: 5038 - protein, 10 aa, Artificial Sequence
  Synthetic Peptide
QYPPLERLTL

SEQ ID NO: 5039 - protein, 10 aa, Artificial Sequence
  Synthetic Peptide
QLPPLERLTF

SEQ ID NO: 5040 - protein, 9 aa, Artificial Sequence
  Synthetic Peptide
LPPLERLTI

SEQ ID NO: 5041 - protein, 8 aa, Artificial Sequence
  Synthetic Peptide
PPLERLTI

SEQ ID NO: 5042 - protein, 11 aa, Artificial Sequence
  Synthetic Peptide
EECGTSGTQGV

SEQ ID NO: 5043 - protein, 8 aa, Artificial Sequence
  Synthetic Peptide
GLSGTQGV

SEQ ID NO: 5044 - protein, 10 aa, Artificial Sequence
  Synthetic Peptide
EPVPLQLPPI

SEQ ID NO: 5045 - protein, 11 aa, Artificial Sequence
  Synthetic Peptide
VPLQLPPLERI

SEQ ID NO: 5046 - protein, 8 aa, Artificial Sequence
  Synthetic Peptide
VPLQLPPI

SEQ ID NO: 5047 - protein, 9 aa, Artificial Sequence
  Synthetic Peptide
PTDPNLEPW

SEQ ID NO: 5048 - protein, 9 aa, Artificial Sequence
  Synthetic Peptide
PVDPNLEPY

SEQ ID NO: 5049 - protein, 10 aa, Artificial Sequence
  Synthetic Peptide
VVPNLEPWNH

SEQ ID NO: 5050 - protein, 10 aa, Artificial Sequence
  Synthetic Peptide
VDPNLEPWNK

SEQ ID NO: 5051 - protein, 8 aa, Artificial Sequence
  Synthetic Peptide
VEPNLEPW

SEQ ID NO: 5052 - protein, 8 aa, Artificial Sequence
  Synthetic Peptide
PVLEPWNH

SEQ ID NO: 5053 - protein, 8 aa, Artificial Sequence
  Synthetic Peptide
PNLEPWNK

SEQ ID NO: 5054 - protein, 9 aa, Artificial Sequence
  Synthetic Peptide
HPGSQPKTI

SEQ ID NO: 5055 - protein, 8 aa, Artificial Sequence
  Synthetic Peptide
PVSQPKTA

SEQ ID NO: 5056 - protein, 8 aa, Artificial Sequence
  Synthetic Peptide
PGSQPKTK

SEQ ID NO: 5057 - protein, 9 aa, Artificial Sequence
  Synthetic Peptide
TVCNNCYCK

SEQ ID NO: 5058 - protein, 8 aa, Artificial Sequence
  Synthetic Peptide
AVNNCYCK

SEQ ID NO: 5059 - protein, 11 aa, Artificial Sequence
  Synthetic Peptide
LVISYGRKKRR

SEQ ID NO: 5060 - protein, 11 aa, Artificial Sequence
  Synthetic Peptide
LGISYGRKKRK

SEQ ID NO: 5061 - protein, 11 aa, Artificial Sequence
  Synthetic Peptide
IVYGRKKRRQR

SEQ ID NO: 5062 - protein, 11 aa, Artificial Sequence
  Synthetic Peptide
ISYGRKKRRQK

SEQ ID NO: 5063 - protein, 9 aa, Artificial Sequence
  Synthetic Peptide
YVRKKRRQR

SEQ ID NO: 5064 - protein, 9 aa, Artificial Sequence
  Synthetic Peptide
YGRKKRRQK

SEQ ID NO: 5065 - protein, 10 aa, Artificial Sequence
  Synthetic Peptide
YVRKKRRQRR

SEQ ID NO: 5066 - protein, 10 aa, Artificial Sequence
  Synthetic Peptide
YGRKKRRQRK

SEQ ID NO: 5067 - protein, 11 aa, Artificial Sequence
  Synthetic Peptide
YVRKKRRQRRR

SEQ ID NO: 5068 - protein, 11 aa, Artificial Sequence
  Synthetic Peptide
YGRKKRRQRRK

SEQ ID NO: 5069 - protein, 8 aa, Artificial Sequence
  Synthetic Peptide
RVDPTGPK

SEQ ID NO: 5070 - protein, 8 aa, Artificial Sequence
  Synthetic Peptide
TVPKESKK

SEQ ID NO: 5071 - protein, 10 aa, Artificial Sequence
  Synthetic Peptide
ETGPSGQPCK

SEQ ID NO: 5072 - protein, 10 aa, Artificial Sequence
  Synthetic Peptide
KVGPGGYPRR

SEQ ID NO: 5073 - protein, 10 aa, Artificial Sequence
  Synthetic Peptide
KAGPGGYPRK

SEQ ID NO: 5074 - protein, 11 aa, Artificial Sequence
  Synthetic Peptide
KVGPGGYPRRK

SEQ ID NO: 5075 - protein, 9 aa, Artificial Sequence
  Synthetic Peptide
AVPGGYPRR

SEQ ID NO: 5076 - protein, 9 aa, Artificial Sequence
  Synthetic Peptide
AGPGGYPRK

SEQ ID NO: 5077 - protein, 9 aa, Artificial Sequence
  Synthetic Peptide
TVPSGQPCH

SEQ ID NO: 5078 - protein, 9 aa, Artificial Sequence
  Synthetic Peptide
TGPSGQPCK

SEQ ID NO: 5079 - protein, 10 aa, Artificial Sequence
  Synthetic Peptide
AVPGGYPRRK

SEQ ID NO: 5080 - protein, 8 aa, Artificial Sequence
  Synthetic Peptide
PVGYPRRK

SEQ ID NO: 5081 - protein, 11 aa, Artificial Sequence
  Synthetic Peptide
GVYPRRKGSCH

SEQ ID NO: 5082 - protein, 11 aa, Artificial Sequence
  Synthetic Peptide
GGYPRRKGSCK

SEQ ID NO: 5083 - protein, 9 aa, Artificial Sequence
  Synthetic Peptide
KTLGISYGR

SEQ ID NO: 5084 - protein, 9 aa, Artificial Sequence
  Synthetic Peptide
KTLGISYGR

SEQ ID NO: 5085 - protein, 10 aa, Artificial Sequence
  Synthetic Peptide
KTLGISYGRK

SEQ ID NO: 5086 - protein, 10 aa, Artificial Sequence
  Synthetic Peptide
KTLGISYGRK

SEQ ID NO: 5087 - protein, 11 aa, Artificial Sequence
  Synthetic Peptide
GTGISYGRKKR

SEQ ID NO: 5088 - protein, 11 aa, Artificial Sequence
  Synthetic Peptide
GTGISYGRKKR

SEQ ID NO: 5089 - protein, 11 aa, Artificial Sequence
  Synthetic Peptide
GTGISYGRKKR

SEQ ID NO: 5090 - protein, 11 aa, Artificial Sequence
  Synthetic Peptide
KTLGISYGRKK

SEQ ID NO: 5091 - protein, 11 aa, Artificial Sequence
  Synthetic Peptide
KTLGISYGRKK

SEQ ID NO: 5092 - protein, 8 aa, Artificial Sequence
  Synthetic Peptide
GTGISYGR

SEQ ID NO: 5093 - protein, 8 aa, Artificial Sequence
  Synthetic Peptide
GTGISYGR

SEQ ID NO: 5094 - protein, 8 aa, Artificial Sequence
  Synthetic Peptide
GTGISYGR

SEQ ID NO: 5095 - protein, 9 aa, Artificial Sequence
  Synthetic Peptide
GTGISYGRK

SEQ ID NO: 5096 - protein, 9 aa, Artificial Sequence
  Synthetic Peptide
GTGISYGRK

SEQ ID NO: 5097 - protein, 9 aa, Artificial Sequence
  Synthetic Peptide
GTGISYGRK

SEQ ID NO: 5098 - protein, 10 aa, Artificial Sequence
  Synthetic Peptide
GTGISYGRKK

SEQ ID NO: 5099 - protein, 10 aa, Artificial Sequence
  Synthetic Peptide
GTGISYGRKK

SEQ ID NO: 5100 - protein, 10 aa, Artificial Sequence
  Synthetic Peptide
GTGISYGRKK

SEQ ID NO: 5101 - protein, 9 aa, Artificial Sequence
  Synthetic Peptide
GTSYGRKKR

SEQ ID NO: 5102 - protein, 9 aa, Artificial Sequence
  Synthetic Peptide
GTSYGRKKR

SEQ ID NO: 5103 - protein, 9 aa, Artificial Sequence
  Synthetic Peptide
GTSYGRKKR

SEQ ID NO: 5104 - protein, 10 aa, Artificial Sequence
  Synthetic Peptide
LTISYGRKKR

SEQ ID NO: 5105 - protein, 10 aa, Artificial Sequence
  Synthetic Peptide
LTISYGRKKR

SEQ ID NO: 5106 - protein, 8 aa, Artificial Sequence
  Synthetic Peptide
GTSYGRKK

SEQ ID NO: 5107 - protein, 8 aa, Artificial Sequence
  Synthetic Peptide
GTSYGRKK

SEQ ID NO: 5108 - protein, 8 aa, Artificial Sequence
  Synthetic Peptide
GTSYGRKK

SEQ ID NO: 5109 - protein, 8 aa, Artificial Sequence
  Synthetic Peptide
ITYGRKKR

SEQ ID NO: 5110 - protein, 8 aa, Artificial Sequence
  Synthetic Peptide
ITYGRKKR

SEQ ID NO: 5111 - protein, 8 aa, Artificial Sequence
  Synthetic Peptide
ITYGRKKR

SEQ ID NO: 5112 - protein, 8 aa, Artificial Sequence
  Synthetic Peptide
LTISYGRK

SEQ ID NO: 5113 - protein, 8 aa, Artificial Sequence
  Synthetic Peptide
LTISYGRK

SEQ ID NO: 5114 - protein, 9 aa, Artificial Sequence
  Synthetic Peptide
LTISYGRKK

SEQ ID NO: 5115 - protein, 9 aa, Artificial Sequence
  Synthetic Peptide
LTISYGRKK

SEQ ID NO: 5116 - protein, 8 aa, Artificial Sequence
  Synthetic Peptide
STVKHHMY

SEQ ID NO: 5117 - protein, 8 aa, Artificial Sequence
  Synthetic Peptide
WQVDRMRV

SEQ ID NO: 5118 - protein, 9 aa, Artificial Sequence
  Synthetic Peptide
VYQVDRMRI

SEQ ID NO: 5119 - protein, 9 aa, Artificial Sequence
  Synthetic Peptide
VWQVDRMRF

SEQ ID NO: 5120 - protein, 10 aa, Artificial Sequence
  Synthetic Peptide
KVGSLQYLAV

SEQ ID NO: 5121 - protein, 10 aa, Artificial Sequence
  Synthetic Peptide
KYGSLQYLAL

SEQ ID NO: 5122 - protein, 8 aa, Artificial Sequence
  Synthetic Peptide
KVGSLQYV

SEQ ID NO: 5123 - protein, 8 aa, Artificial Sequence
  Synthetic Peptide
KYGSLQYL

SEQ ID NO: 5124 - protein, 9 aa, Artificial Sequence
  Synthetic Peptide
KVGSLQYLV

SEQ ID NO: 5125 - protein, 9 aa, Artificial Sequence
  Synthetic Peptide
KTGSLQYLA

SEQ ID NO: 5126 - protein, 8 aa, Artificial Sequence
  Synthetic Peptide
VTSLQYLA

SEQ ID NO: 5127 - protein, 8 aa, Artificial Sequence
  Synthetic Peptide
IVWQVDRV

SEQ ID NO: 5128 - protein, 8 aa, Artificial Sequence
  Synthetic Peptide
IYWQVDRM

SEQ ID NO: 5129 - protein, 8 aa, Artificial Sequence
  Synthetic Peptide
WLVDRMRI

SEQ ID NO: 5130 - protein, 9 aa, Artificial Sequence
  Synthetic Peptide
VWQVDRMRF

SEQ ID NO: 5131 - protein, 10 aa, Artificial Sequence
  Synthetic Peptide
KLGSLQYLAL

SEQ ID NO: 5132 - protein, 8 aa, Artificial Sequence
  Synthetic Peptide
KLGSLQYL

SEQ ID NO: 5133 - protein, 9 aa, Artificial Sequence
  Synthetic Peptide
KLGSLQYLA

SEQ ID NO: 5134 - protein, 9 aa, Artificial Sequence
  Synthetic Peptide
KVGSLQYLK

SEQ ID NO: 5135 - protein, 8 aa, Artificial Sequence
  Synthetic Peptide
VGSLQYLK

SEQ ID NO: 5136 - protein, 8 aa, Artificial Sequence
  Synthetic Peptide
ILWQVDRM

SEQ ID NO: 5137 - protein, 8 aa, Artificial Sequence
  Synthetic Peptide
IVWQVDRF

SEQ ID NO: 5138 - protein, 8 aa, Artificial Sequence
  Synthetic Peptide
WVVDRMRI

SEQ ID NO: 5139 - protein, 10 aa, Artificial Sequence
  Synthetic Peptide
GPQREPYNEI

SEQ ID NO: 5140 - protein, 11 aa, Artificial Sequence
  Synthetic Peptide
PTDQGPQREPY

SEQ ID NO: 5141 - protein, 8 aa, Artificial Sequence
  Synthetic Peptide
ETVRHFPR

SEQ ID NO: 5142 - protein, 8 aa, Artificial Sequence
  Synthetic Peptide
ETVRHFPR

SEQ ID NO: 5143 - protein, 8 aa, Artificial Sequence
  Synthetic Peptide
ETVRHFPR

SEQ ID NO: 5144 - protein, 10 aa, Artificial Sequence
  Synthetic Peptide
FSPAFDNLYY

SEQ ID NO: 5145 - protein, 10 aa, Artificial Sequence
  Synthetic Peptide
CMQIAKGMSY

SEQ ID NO: 5146 - protein, 10 aa, Artificial Sequence
  Synthetic Peptide
ESMPNPEGRY

SEQ ID NO: 5147 - protein, 9 aa, Artificial Sequence
  Synthetic Peptide
ASCVTACPY

SEQ ID NO: 5148 - protein, 9 aa, Artificial Sequence
  Synthetic Peptide
FSPAFDNLY

SEQ ID NO: 5149 - protein, 9 aa, Artificial Sequence
  Synthetic Peptide
ASPLDSTFY

SEQ ID NO: 5150 - protein, 10 aa, Artificial Sequence
  Synthetic Peptide
RGTQLFEDNY

SEQ ID NO: 5151 - protein, 10 aa, Artificial Sequence
  Synthetic Peptide
PASPLDSTFY

SEQ ID NO: 5152 - protein, 9 aa, Artificial Sequence
  Synthetic Peptide
LSAFSLHSY

SEQ ID NO: 5153 - protein, 9 aa, Artificial Sequence
  Synthetic Peptide
KSTKVPAAY

SEQ ID NO: 5154 - protein, 9 aa, Artificial Sequence
  Synthetic Peptide
DSSVLCECY

SEQ ID NO: 5155 - protein, 9 aa, Artificial Sequence
  Synthetic Peptide
ETDPIGHLY

SEQ ID NO: 5156 - protein, 9 aa, Artificial Sequence
  Synthetic Peptide
AVDPIGHLY

SEQ ID NO: 5157 - protein, 9 aa, Artificial Sequence
  Synthetic Peptide
EVDPIAHLY

SEQ ID NO: 5158 - protein, 9 aa, Artificial Sequence
  Synthetic Peptide
EVDAIGHLY

SEQ ID NO: 5159 - protein, 9 aa, Artificial Sequence
  Synthetic Peptide
EVDPIGALY

SEQ ID NO: 5160 - protein, 9 aa, Artificial Sequence
  Synthetic Peptide
EVDPIGHAY

SEQ ID NO: 5161 - protein, 9 aa, Artificial Sequence
  Synthetic Peptide
EADPIGHLY

SEQ ID NO: 5162 - protein, 9 aa, Artificial Sequence
  Synthetic Peptide
EVDPTGHLY

SEQ ID NO: 5163 - protein, 9 aa, Artificial Sequence
  Synthetic Peptide
EVDPIGHSY

SEQ ID NO: 5164 - protein, 9 aa, Artificial Sequence
  Synthetic Peptide
EVDPAGHLY

SEQ ID NO: 5165 - protein, 9 aa, Artificial Sequence
  Synthetic Peptide
EVDPIGHLA

SEQ ID NO: 5166 - protein, 9 aa, Artificial Sequence
  Synthetic Peptide
EVAPIGHLY

SEQ ID NO: 5167 - protein, 9 aa, Artificial Sequence
  Synthetic Peptide
EVDPASNTY

SEQ ID NO: 5168 - protein, 10 aa, Artificial Sequence
  Synthetic Peptide
VGSDCTTIHY

SEQ ID NO: 5169 - protein, 10 aa, Artificial Sequence
  Synthetic Peptide
PSQKTYQGSY

SEQ ID NO: 5170 - protein, 9 aa, Artificial Sequence
  Synthetic Peptide
PLSEDQLLY

SEQ ID NO: 5171 - protein, 10 aa, Artificial Sequence
  Synthetic Peptide
IPSYKKLIMY

SEQ ID NO: 5172 - protein, 10 aa, Artificial Sequence
  Synthetic Peptide
YASCHLTELY

SEQ ID NO: 5173 - protein, 10 aa, Artificial Sequence
  Synthetic Peptide
RVLQGLPREY

SEQ ID NO: 5174 - protein, 9 aa, Artificial Sequence
  Synthetic Peptide
QLVTQLMPY

SEQ ID NO: 5175 - protein, 9 aa, Artificial Sequence
  Synthetic Peptide
VMAGVGSPY

SEQ ID NO: 5176 - protein, 9 aa, Artificial Sequence
  Synthetic Peptide
TLWKAGILY

SEQ ID NO: 5177 - protein, 9 aa, Artificial Sequence
  Synthetic Peptide
ILRGTSFVY

SEQ ID NO: 5178 - protein, 9 aa, Artificial Sequence
  Synthetic Peptide
KLNWASQIY

SEQ ID NO: 5179 - protein, 9 aa, Artificial Sequence
  Synthetic Peptide
GLNKIVRMY

SEQ ID NO: 5180 - protein, 9 aa, Artificial Sequence
  Synthetic Peptide
LVGFLLLKY

SEQ ID NO: 5181 - protein, 10 aa, Artificial Sequence
  Synthetic Peptide
GTRVRAMAIY

SEQ ID NO: 5182 - protein, 9 aa, Artificial Sequence
  Synthetic Peptide
KIQNFRVYY

SEQ ID NO: 5183 - protein, 9 aa, Artificial Sequence
  Synthetic Peptide
SLYTKVVHY

SEQ ID NO: 5184 - protein, 10 aa, Artificial Sequence
  Synthetic Peptide
LTCGFADMGY

SEQ ID NO: 5185 - protein, 8 aa, Artificial Sequence
  Synthetic Peptide
ETAYFLLK

SEQ ID NO: 5186 - protein, 9 aa, Artificial Sequence
  Synthetic Peptide
RWGLLLALL

SEQ ID NO: 5187 - protein, 9 aa, Artificial Sequence
  Synthetic Peptide
PYVSRLLGI

SEQ ID NO: 5188 - protein, 9 aa, Artificial Sequence
  Synthetic Peptide
VYMIMVKCW

SEQ ID NO: 5189 - protein, 9 aa, Artificial Sequence
  Synthetic Peptide
AYSLTLQGL

SEQ ID NO: 5190 - protein, 9 aa, Artificial Sequence
  Synthetic Peptide
SYGVTVWEL

SEQ ID NO: 5191 - protein, 10 aa, Artificial Sequence
  Synthetic Peptide
LYISAWPDSL

SEQ ID NO: 5192 - protein, 9 aa, Artificial Sequence
  Synthetic Peptide
VWSYGVTVW

SEQ ID NO: 5193 - protein, 10 aa, Artificial Sequence
  Synthetic Peptide
SYGVTVWELM

SEQ ID NO: 5194 - protein, 9 aa, Artificial Sequence
  Synthetic Peptide
TYLPTNASL

SEQ ID NO: 5195 - protein, 10 aa, Artificial Sequence
  Synthetic Peptide
VYMIMVKCWM

SEQ ID NO: 5196 - protein, 9 aa, Artificial Sequence
  Synthetic Peptide
RFRELVSEF

SEQ ID NO: 5197 - protein, 9 aa, Artificial Sequence
  Synthetic Peptide
CYGLGMEHL

SEQ ID NO: 5198 - protein, 9 aa, Artificial Sequence
  Synthetic Peptide
KWMALESIL

SEQ ID NO: 5199 - protein, 10 aa, Artificial Sequence
  Synthetic Peptide
EYLVPQQGFF

SEQ ID NO: 5200 - protein, 10 aa, Artificial Sequence
  Synthetic Peptide
RYSEDPTVPL

SEQ ID NO: 5201 - protein, 9 aa, Artificial Sequence
  Synthetic Peptide
RFTHQSDVW

SEQ ID NO: 5202 - protein, 10 aa, Artificial Sequence
  Synthetic Peptide
EYLVSFGVWI

SEQ ID NO: 5203 - protein, 9 aa, Artificial Sequence
  Synthetic Peptide
WFHISCLTF

SEQ ID NO: 5204 - protein, 9 aa, Artificial Sequence
  Synthetic Peptide
QYLAGLSTL

SEQ ID NO: 5205 - protein, 9 aa, Artificial Sequence
  Synthetic Peptide
TYSTYGKFL

SEQ ID NO: 5206 - protein, 10 aa, Artificial Sequence
  Synthetic Peptide
QYSPGQRVEF

SEQ ID NO: 5207 - protein, 9 aa, Artificial Sequence
  Synthetic Peptide
KFMLCAGRW

SEQ ID NO: 5208 - protein, 9 aa, Artificial Sequence
  Synthetic Peptide
IVGGWECEK

SEQ ID NO: 5209 - protein, 10 aa, Artificial Sequence
  Synthetic Peptide
LTAAHCIRNK

SEQ ID NO: 5210 - protein, 10 aa, Artificial Sequence
  Synthetic Peptide
VSHSFPHPLY

SEQ ID NO: 5211 - protein, 9 aa, Artificial Sequence
  Synthetic Peptide
PLYDMSLLK

SEQ ID NO: 5212 - protein, 10 aa, Artificial Sequence
  Synthetic Peptide
DVCAQVHPQK

SEQ ID NO: 5213 - protein, 9 aa, Artificial Sequence
  Synthetic Peptide
QVHPQKVTK

SEQ ID NO: 5214 - protein, 10 aa, Artificial Sequence
  Synthetic Peptide
PSLYTKVVHY

SEQ ID NO: 5215 - protein, 9 aa, Artificial Sequence
  Synthetic Peptide
YTKVVHYRK

SEQ ID NO: 5216 - protein, 10 aa, Artificial Sequence
  Synthetic Peptide
KVVHYRKWIK

SEQ ID NO: 5217 - protein, 9 aa, Artificial Sequence
  Synthetic Peptide
VVHYRKWIK

SEQ ID NO: 5218 - protein, 9 aa, Artificial Sequence
  Synthetic Peptide
STNPKPQRK

SEQ ID NO: 5219 - protein, 10 aa, Artificial Sequence
  Synthetic Peptide
NTNRRPQDVK

SEQ ID NO: 5220 - protein, 9 aa, Artificial Sequence
  Synthetic Peptide
RLGVRATRK

SEQ ID NO: 5221 - protein, 9 aa, Artificial Sequence
  Synthetic Peptide
VQDCNCSIY

SEQ ID NO: 5222 - protein, 9 aa, Artificial Sequence
  Synthetic Peptide
WMNSTGFTK

SEQ ID NO: 5223 - protein, 9 aa, Artificial Sequence
  Synthetic Peptide
LTPRCMVDY

SEQ ID NO: 5224 - protein, 9 aa, Artificial Sequence
  Synthetic Peptide
FTIFKIRMY

SEQ ID NO: 5225 - protein, 9 aa, Artificial Sequence
  Synthetic Peptide
AADKAAAAY

SEQ ID NO: 5226 - protein, 9 aa, Artificial Sequence
  Synthetic Peptide
ATAKAAAAY

SEQ ID NO: 5227 - protein, 9 aa, Artificial Sequence
  Synthetic Peptide
ATDKAAAAY

SEQ ID NO: 5228 - protein, 9 aa, Artificial Sequence
  Synthetic Peptide
ALAKAAAAV

SEQ ID NO: 5229 - protein, 9 aa, Artificial Sequence
  Synthetic Peptide
AMAAAAAAK

SEQ ID NO: 5230 - protein, 9 aa, Artificial Sequence
  Synthetic Peptide
ATAAAAAAK

SEQ ID NO: 5231 - protein, 9 aa, Artificial Sequence
  Synthetic Peptide
AYAKAAAAF

SEQ ID NO: 5232 - protein, 10 aa, Artificial Sequence
  Synthetic Peptide
AADKAAAAAY

SEQ ID NO: 5233 - protein, 10 aa, Artificial Sequence
  Synthetic Peptide
ATAKAAAAAY

SEQ ID NO: 5234 - protein, 10 aa, Artificial Sequence
  Synthetic Peptide
ATDKAAAAAY

SEQ ID NO: 5235 - protein, 10 aa, Artificial Sequence
  Synthetic Peptide
ALAKAAAAAV

SEQ ID NO: 5236 - protein, 10 aa, Artificial Sequence
  Synthetic Peptide
AMAAAAAAAK

SEQ ID NO: 5237 - protein, 10 aa, Artificial Sequence
  Synthetic Peptide
ATAAAAAAAK

SEQ ID NO: 5238 - protein, 9 aa, Artificial Sequence
  Synthetic Peptide
ALAAAAAAK

SEQ ID NO: 5239 - protein, 9 aa, Artificial Sequence
  Synthetic Peptide
AMAAAAAAK

SEQ ID NO: 5240 - protein, 9 aa, Artificial Sequence
  Synthetic Peptide
AVAAAAAAK

SEQ ID NO: 5241 - protein, 9 aa, Artificial Sequence
  Synthetic Peptide
ASAAAAAAK

SEQ ID NO: 5242 - protein, 9 aa, Artificial Sequence
  Synthetic Peptide
AIAAAAAAK

SEQ ID NO: 5243 - protein, 9 aa, Artificial Sequence
  Synthetic Peptide
AAAAAAAAK

SEQ ID NO: 5244 - protein, 9 aa, Artificial Sequence
  Synthetic Peptide
ATAAAAAAK

SEQ ID NO: 5245 - protein, 9 aa, Artificial Sequence
  Synthetic Peptide
AFAAAAAAK

SEQ ID NO: 5246 - protein, 9 aa, Artificial Sequence
  Synthetic Peptide
AGAAAAAAK

SEQ ID NO: 5247 - protein, 9 aa, Artificial Sequence
  Synthetic Peptide
ACAAAAAAK

SEQ ID NO: 5248 - protein, 9 aa, Artificial Sequence
  Synthetic Peptide
ADAAAAAAK

SEQ ID NO: 5249 - protein, 9 aa, Artificial Sequence
  Synthetic Peptide
ANAAAAAAK

SEQ ID NO: 5250 - protein, 9 aa, Artificial Sequence
  Synthetic Peptide
AKAAAAAAK

SEQ ID NO: 5251 - protein, 9 aa, Artificial Sequence
  Synthetic Peptide
AYAAAAAAK

SEQ ID NO: 5252 - protein, 9 aa, Artificial Sequence
  Synthetic Peptide
APAAAAAAK

SEQ ID NO: 5253 - protein, 9 aa, Artificial Sequence
  Synthetic Peptide
ALAAAAAAR

SEQ ID NO: 5254 - protein, 9 aa, Artificial Sequence
  Synthetic Peptide
ALAAAAAAY

SEQ ID NO: 5255 - protein, 9 aa, Artificial Sequence
  Synthetic Peptide
ALAAAAAAA

SEQ ID NO: 5256 - protein, 9 aa, Artificial Sequence
  Synthetic Peptide
ALAAAAAAQ

SEQ ID NO: 5257 - protein, 9 aa, Artificial Sequence
  Synthetic Peptide
ALAAAAAAS

SEQ ID NO: 5258 - protein, 9 aa, Artificial Sequence
  Synthetic Peptide
ALAAAAAAT

SEQ ID NO: 5259 - protein, 9 aa, Artificial Sequence
  Synthetic Peptide
ALAAAAAAN

SEQ ID NO: 5260 - protein, 9 aa, Artificial Sequence
  Synthetic Peptide
ALAAAAAAE

SEQ ID NO: 5261 - protein, 9 aa, Artificial Sequence
  Synthetic Peptide
ALAAAAAAK

SEQ ID NO: 5262 - protein, 9 aa, Artificial Sequence
  Synthetic Peptide
AMAAAAAAK

SEQ ID NO: 5263 - protein, 9 aa, Artificial Sequence
  Synthetic Peptide
AAAAAAAAK

SEQ ID NO: 5264 - protein, 9 aa, Artificial Sequence
  Synthetic Peptide
AIAAAAAAK

SEQ ID NO: 5265 - protein, 9 aa, Artificial Sequence
  Synthetic Peptide
ATAAAAAAK

SEQ ID NO: 5266 - protein, 9 aa, Artificial Sequence
  Synthetic Peptide
ASAAAAAAK

SEQ ID NO: 5267 - protein, 9 aa, Artificial Sequence
  Synthetic Peptide
AGAAAAAAK

SEQ ID NO: 5268 - protein, 9 aa, Artificial Sequence
  Synthetic Peptide
AVAAAAAAK

SEQ ID NO: 5269 - protein, 9 aa, Artificial Sequence
  Synthetic Peptide
ANAAAAAAK

SEQ ID NO: 5270 - protein, 9 aa, Artificial Sequence
  Synthetic Peptide
ACAAAAAAK

SEQ ID NO: 5271 - protein, 9 aa, Artificial Sequence
  Synthetic Peptide
AFAAAAAAK

SEQ ID NO: 5272 - protein, 9 aa, Artificial Sequence
  Synthetic Peptide
ADAAAAAAK

SEQ ID NO: 5273 - protein, 9 aa, Artificial Sequence
  Synthetic Peptide
AKAAAAAAK

SEQ ID NO: 5274 - protein, 9 aa, Artificial Sequence
  Synthetic Peptide
AYAAAAAAK

SEQ ID NO: 5275 - protein, 9 aa, Artificial Sequence
  Synthetic Peptide
APAAAAAAK

SEQ ID NO: 5276 - protein, 9 aa, Artificial Sequence
  Synthetic Peptide
ALAAAAAAR

SEQ ID NO: 5277 - protein, 9 aa, Artificial Sequence
  Synthetic Peptide
ALAAAAAAA

SEQ ID NO: 5278 - protein, 9 aa, Artificial Sequence
  Synthetic Peptide
ALAAAAAAN

SEQ ID NO: 5279 - protein, 9 aa, Artificial Sequence
  Synthetic Peptide
ALAAAAAAQ

SEQ ID NO: 5280 - protein, 9 aa, Artificial Sequence
  Synthetic Peptide
ALAAAAAAY

SEQ ID NO: 5281 - protein, 9 aa, Artificial Sequence
  Synthetic Peptide
ALAAAAAAS

SEQ ID NO: 5282 - protein, 9 aa, Artificial Sequence
  Synthetic Peptide
ALAAAAAAT

SEQ ID NO: 5283 - protein, 9 aa, Artificial Sequence
  Synthetic Peptide
ALAAAAAAE

SEQ ID NO: 5284 - protein, 9 aa, Artificial Sequence
  Synthetic Peptide
LQCVSLHLL

SEQ ID NO: 5285 - protein, 8 aa, Artificial Sequence
  Synthetic Peptide
ALGTTCYV

SEQ ID NO: 5286 - protein, 9 aa, Artificial Sequence
  Synthetic Peptide
LLLSIALSV

SEQ ID NO: 5287 - protein, 9 aa, Artificial Sequence
  Synthetic Peptide
LTLSIALSV

SEQ ID NO: 5288 - protein, 9 aa, Artificial Sequence
  Synthetic Peptide
ALSVGCTGV

SEQ ID NO: 5289 - protein, 9 aa, Artificial Sequence
  Synthetic Peptide
AVPLIQSRV

SEQ ID NO: 5290 - protein, 9 aa, Artificial Sequence
  Synthetic Peptide
QVWLGRHNV

SEQ ID NO: 5291 - protein, 9 aa, Artificial Sequence
  Synthetic Peptide
MLLRLSEPV

SEQ ID NO: 5292 - protein, 9 aa, Artificial Sequence
  Synthetic Peptide
SLQCVSLHV

SEQ ID NO: 5293 - protein, 9 aa, Artificial Sequence
  Synthetic Peptide
HLLSNDMCV

SEQ ID NO: 5294 - protein, 9 aa, Artificial Sequence
  Synthetic Peptide
KVTEFMLCV

SEQ ID NO: 5295 - protein, 9 aa, Artificial Sequence
  Synthetic Peptide
FMLCAGLWV

SEQ ID NO: 5296 - protein, 10 aa, Artificial Sequence
  Synthetic Peptide
LTFFWLDRSV

SEQ ID NO: 5297 - protein, 9 aa, Artificial Sequence
  Synthetic Peptide
VTAKELKFV

SEQ ID NO: 5298 - protein, 9 aa, Artificial Sequence
  Synthetic Peptide
ITLWQPIPV

SEQ ID NO: 5299 - protein, 10 aa, Artificial Sequence
  Synthetic Peptide
ITYSAHDTTV

SEQ ID NO: 5300 - protein, 10 aa, Artificial Sequence
  Synthetic Peptide
FTTPKKLQCV

SEQ ID NO: 5301 - protein, 10 aa, Artificial Sequence
  Synthetic Peptide
GTPEGDLVYV

SEQ ID NO: 5302 - protein, 9 aa, Artificial Sequence
  Synthetic Peptide
ATFDIESKV

SEQ ID NO: 5303 - protein, 10 aa, Artificial Sequence
  Synthetic Peptide
DTVLSIALSV

SEQ ID NO: 5304 - protein, 10 aa, Artificial Sequence
  Synthetic Peptide
SVGCTGAVPV

SEQ ID NO: 5305 - protein, 10 aa, Artificial Sequence
  Synthetic Peptide
QVAVYSHGWV

SEQ ID NO: 5306 - protein, 10 aa, Artificial Sequence
  Synthetic Peptide
LVHPQWVLTV

SEQ ID NO: 5307 - protein, 10 aa, Artificial Sequence
  Synthetic Peptide
LMLLRLSEPV

SEQ ID NO: 5308 - protein, 10 aa, Artificial Sequence
  Synthetic Peptide
FVRPRSLQCV

SEQ ID NO: 5309 - protein, 10 aa, Artificial Sequence
  Synthetic Peptide
SLQCVSLHLV

SEQ ID NO: 5310 - protein, 10 aa, Artificial Sequence
  Synthetic Peptide
LLSNDMCARV

SEQ ID NO: 5311 - protein, 10 aa, Artificial Sequence
  Synthetic Peptide
VTEFMLCAGV

SEQ ID NO: 5312 - protein, 10 aa, Artificial Sequence
  Synthetic Peptide
LVCNGVLQGV

SEQ ID NO: 5313 - protein, 11 aa, Artificial Sequence
  Synthetic Peptide
ILLSVGCTGAV

SEQ ID NO: 5314 - protein, 11 aa, Artificial Sequence
  Synthetic Peptide
ITLSVGCTGAV

SEQ ID NO: 5315 - protein, 11 aa, Artificial Sequence
  Synthetic Peptide
LVHPQWVLTAV

SEQ ID NO: 5316 - protein, 11 aa, Artificial Sequence
  Synthetic Peptide
SLHLLSNDMCV

SEQ ID NO: 5317 - protein, 11 aa, Artificial Sequence
  Synthetic Peptide
HLLSNDMCARV

SEQ ID NO: 5318 - protein, 11 aa, Artificial Sequence
  Synthetic Peptide
DVCARAYSEKV

SEQ ID NO: 5319 - protein, 11 aa, Artificial Sequence
  Synthetic Peptide
KVTEFMLCAGV

SEQ ID NO: 5320 - protein, 8 aa, Artificial Sequence
  Synthetic Peptide
ALGTTCYA

SEQ ID NO: 5321 - protein, 9 aa, Artificial Sequence
  Synthetic Peptide
MLLRLSEPA

SEQ ID NO: 5322 - protein, 10 aa, Artificial Sequence
  Synthetic Peptide
ALSVGCTGAV

SEQ ID NO: 5323 - protein, 10 aa, Artificial Sequence
  Synthetic Peptide
FLRPRSLQCF

SEQ ID NO: 5324 - protein, 11 aa, Artificial Sequence
  Synthetic Peptide
VLVHPQWVLTA

SEQ ID NO: 5325 - protein, 11 aa, Artificial Sequence
  Synthetic Peptide
VLVHPQWVLTV

SEQ ID NO: 5326 - protein, 11 aa, Artificial Sequence
  Synthetic Peptide
SLHLLSNDMCA

SEQ ID NO: 5327 - protein, 11 aa, Artificial Sequence
  Synthetic Peptide
HLLSNDMCARA

SEQ ID NO: 5328 - protein, 11 aa, Artificial Sequence
  Synthetic Peptide
PLVCNGVLQGI

SEQ ID NO: 5329 - protein, 11 aa, Artificial Sequence
  Synthetic Peptide
PLVCNGVLQGV

SEQ ID NO: 5330 - protein, 11 aa, Artificial Sequence
  Synthetic Peptide
PLVBNGVLQGV

SEQ ID NO: 5331 - protein, 10 aa, Artificial Sequence
  Synthetic Peptide
FLRPRSLQBV

SEQ ID NO: 5332 - protein, 11 aa, Artificial Sequence
  Synthetic Peptide
SLHLLSNDMBA

SEQ ID NO: 5333 - protein, 9 aa, Artificial Sequence
  Synthetic Peptide
LLLARAASL

SEQ ID NO: 5334 - protein, 10 aa, Artificial Sequence
  Synthetic Peptide
SLSLGFLFLL

SEQ ID NO: 5335 - protein, 10 aa, Artificial Sequence
  Synthetic Peptide
LLARAASLSL

SEQ ID NO: 5336 - protein, 10 aa, Artificial Sequence
  Synthetic Peptide
SVLAKELKFV

SEQ ID NO: 5337 - protein, 10 aa, Artificial Sequence
  Synthetic Peptide
LAALFPPEGV

SEQ ID NO: 5338 - protein, 10 aa, Artificial Sequence
  Synthetic Peptide
TLMSAMTNLA

SEQ ID NO: 5339 - protein, 10 aa, Artificial Sequence
  Synthetic Peptide
GLHGQDLFGI

SEQ ID NO: 5340 - protein, 11 aa, Artificial Sequence
  Synthetic Peptide
VVFLTLSVTWI

SEQ ID NO: 5341 - protein, 8 aa, Artificial Sequence
  Synthetic Peptide
ALGTTBYA

SEQ ID NO: 5342 - protein, 8 aa, Artificial Sequence
  Synthetic Peptide
ALGTTBYV

SEQ ID NO: 5343 - protein, 10 aa, Artificial Sequence
  Synthetic Peptide
FLTPKKLQBV

SEQ ID NO: 5344 - protein, 9 aa, Artificial Sequence
  Synthetic Peptide
KLQBVDLHV

SEQ ID NO: 5345 - protein, 10 aa, Artificial Sequence
  Synthetic Peptide
KLQBVDLHVI

SEQ ID NO: 5346 - protein, 10 aa, Artificial Sequence
  Synthetic Peptide
KLQBVDLHVV

SEQ ID NO: 5347 - protein, 9 aa, Artificial Sequence
  Synthetic Peptide
KVTKFMLBA

SEQ ID NO: 5348 - protein, 9 aa, Artificial Sequence
  Synthetic Peptide
KVTKFMLBV

SEQ ID NO: 5349 - protein, 11 aa, Artificial Sequence
  Synthetic Peptide
HLLSNDMBARA

SEQ ID NO: 5350 - protein, 10 aa, Artificial Sequence
  Synthetic Peptide
LVBNGVLQGI

SEQ ID NO: 5351 - protein, 11 aa, Artificial Sequence
  Synthetic Peptide
LLLARAASLSL

SEQ ID NO: 5352 - protein, 10 aa, Artificial Sequence
  Synthetic Peptide
LLARAASLSL

SEQ ID NO: 5353 - protein, 9 aa, Artificial Sequence
  Synthetic Peptide
SLSLGFLFV

SEQ ID NO: 5354 - protein, 10 aa, Artificial Sequence
  Synthetic Peptide
SLSLGFLFLL

SEQ ID NO: 5355 - protein, 10 aa, Artificial Sequence
  Synthetic Peptide
SLSLGFLFLV

SEQ ID NO: 5356 - protein, 9 aa, Artificial Sequence
  Synthetic Peptide
VTAKELKFV

SEQ ID NO: 5357 - protein, 9 aa, Artificial Sequence
  Synthetic Peptide
VVAKELKFV

SEQ ID NO: 5358 - protein, 11 aa, Artificial Sequence
  Synthetic Peptide
FLNESYKHEQV

SEQ ID NO: 5359 - protein, 9 aa, Artificial Sequence
  Synthetic Peptide
TLMSAMTNV

SEQ ID NO: 5360 - protein, 10 aa, Artificial Sequence
  Synthetic Peptide
LAALFPPEGV

SEQ ID NO: 5361 - protein, 10 aa, Artificial Sequence
  Synthetic Peptide
LLALFPPEGV

SEQ ID NO: 5362 - protein, 10 aa, Artificial Sequence
  Synthetic Peptide
LVALFPPEGV

SEQ ID NO: 5363 - protein, 10 aa, Artificial Sequence
  Synthetic Peptide
ALFPPEGVSI

SEQ ID NO: 5364 - protein, 10 aa, Artificial Sequence
  Synthetic Peptide
ALFPPEGVSV

SEQ ID NO: 5365 - protein, 10 aa, Artificial Sequence
  Synthetic Peptide
GLHGQDLFGV

SEQ ID NO: 5366 - protein, 10 aa, Artificial Sequence
  Synthetic Peptide
LLPPYASCHL

SEQ ID NO: 5367 - protein, 10 aa, Artificial Sequence
  Synthetic Peptide
LLPPYASCHV

SEQ ID NO: 5368 - protein, 10 aa, Artificial Sequence
  Synthetic Peptide
SLQCVSLHLL

SEQ ID NO: 5369 - protein, 10 aa, Artificial Sequence
  Synthetic Peptide
LLWQPIPVHT

SEQ ID NO: 5370 - protein, 10 aa, Artificial Sequence
  Synthetic Peptide
LLWQPIPVHV

SEQ ID NO: 5371 - protein, 10 aa, Artificial Sequence
  Synthetic Peptide
FLRPRSLQSV

SEQ ID NO: 5372 - protein, 10 aa, Artificial Sequence
  Synthetic Peptide
FLRPRSLQPV

SEQ ID NO: 5373 - protein, 11 aa, Artificial Sequence
  Synthetic Peptide
KVTEFMLAAGV

SEQ ID NO: 5374 - protein, 11 aa, Artificial Sequence
  Synthetic Peptide
KVTEFMLSAGV

SEQ ID NO: 5375 - protein, 11 aa, Artificial Sequence
  Synthetic Peptide
KVTEFMLPAGV

SEQ ID NO: 5376 - protein, 8 aa, Artificial Sequence
  Synthetic Peptide
ALGTTAYV

SEQ ID NO: 5377 - protein, 8 aa, Artificial Sequence
  Synthetic Peptide
ALGTTSYV

SEQ ID NO: 5378 - protein, 8 aa, Artificial Sequence
  Synthetic Peptide
ALGTTTYV

SEQ ID NO: 5379 - protein, 8 aa, Artificial Sequence
  Synthetic Peptide
ALGTTVYV

SEQ ID NO: 5380 - protein, 9 aa, Artificial Sequence
  Synthetic Peptide
ALSVGATGV

SEQ ID NO: 5381 - protein, 9 aa, Artificial Sequence
  Synthetic Peptide
ALSVGPTGV

SEQ ID NO: 5382 - protein, 9 aa, Artificial Sequence
  Synthetic Peptide
ALSVGSTGV

SEQ ID NO: 5383 - protein, 9 aa, Artificial Sequence
  Synthetic Peptide
FLLAAGLWT

SEQ ID NO: 5384 - protein, 9 aa, Artificial Sequence
  Synthetic Peptide
FLLPAGLWT

SEQ ID NO: 5385 - protein, 9 aa, Artificial Sequence
  Synthetic Peptide
FLLSAGLWT

SEQ ID NO: 5386 - protein, 9 aa, Artificial Sequence
  Synthetic Peptide
FLLTAGLWT

SEQ ID NO: 5387 - protein, 9 aa, Artificial Sequence
  Synthetic Peptide
ALSVGTTGV

SEQ ID NO: 5388 - protein, 9 aa, Artificial Sequence
  Synthetic Peptide
ALSVGVTGV

SEQ ID NO: 5389 - protein, 9 aa, Artificial Sequence
  Synthetic Peptide
FMLAAGLWV

SEQ ID NO: 5390 - protein, 9 aa, Artificial Sequence
  Synthetic Peptide
FMLPAGLWV

SEQ ID NO: 5391 - protein, 9 aa, Artificial Sequence
  Synthetic Peptide
FMLSAGLWV

SEQ ID NO: 5392 - protein, 9 aa, Artificial Sequence
  Synthetic Peptide
FMLTAGLWV

SEQ ID NO: 5393 - protein, 9 aa, Artificial Sequence
  Synthetic Peptide
FMLVAGLWV

SEQ ID NO: 5394 - protein, 9 aa, Artificial Sequence
  Synthetic Peptide
KLQAVDLHV

SEQ ID NO: 5395 - protein, 9 aa, Artificial Sequence
  Synthetic Peptide
KVTKFMLAV

SEQ ID NO: 5396 - protein, 9 aa, Artificial Sequence
  Synthetic Peptide
KVTKFMLPV

SEQ ID NO: 5397 - protein, 9 aa, Artificial Sequence
  Synthetic Peptide
KVTKFMLSV

SEQ ID NO: 5398 - protein, 9 aa, Artificial Sequence
  Synthetic Peptide
KVTKFMLTV

SEQ ID NO: 5399 - protein, 9 aa, Artificial Sequence
  Synthetic Peptide
KVTKFMLVV

SEQ ID NO: 5400 - protein, 10 aa, Artificial Sequence
  Synthetic Peptide
FLTPKKLQAV

SEQ ID NO: 5401 - protein, 10 aa, Artificial Sequence
  Synthetic Peptide
FLTPKKLQPV

SEQ ID NO: 5402 - protein, 10 aa, Artificial Sequence
  Synthetic Peptide
FLTPKKLQSV

SEQ ID NO: 5403 - protein, 10 aa, Artificial Sequence
  Synthetic Peptide
FLTPKKLQTV

SEQ ID NO: 5404 - protein, 10 aa, Artificial Sequence
  Synthetic Peptide
FLTPKKLQVV

SEQ ID NO: 5405 - protein, 10 aa, Artificial Sequence
  Synthetic Peptide
KLQAVDLHVV

SEQ ID NO: 5406 - protein, 10 aa, Artificial Sequence
  Synthetic Peptide
KLQPVDLHVV

SEQ ID NO: 5407 - protein, 10 aa, Artificial Sequence
  Synthetic Peptide
KLQSVDLHVV

SEQ ID NO: 5408 - protein, 10 aa, Artificial Sequence
  Synthetic Peptide
KLQTVDLHVV

SEQ ID NO: 5409 - protein, 10 aa, Artificial Sequence
  Synthetic Peptide
KLQVVDLHVV

SEQ ID NO: 5410 - protein, 10 aa, Artificial Sequence
  Synthetic Peptide
LVANGVLQGV

SEQ ID NO: 5411 - protein, 10 aa, Artificial Sequence
  Synthetic Peptide
LVPNGVLQGV

SEQ ID NO: 5412 - protein, 10 aa, Artificial Sequence
  Synthetic Peptide
LVSNGVLQGV

SEQ ID NO: 5413 - protein, 10 aa, Artificial Sequence
  Synthetic Peptide
LVTNGVLQGV

SEQ ID NO: 5414 - protein, 10 aa, Artificial Sequence
  Synthetic Peptide
LVVNGVLQGV

SEQ ID NO: 5415 - protein, 10 aa, Artificial Sequence
  Synthetic Peptide
SLQAVSLHLV

SEQ ID NO: 5416 - protein, 10 aa, Artificial Sequence
  Synthetic Peptide
SLQPVSLHLV

SEQ ID NO: 5417 - protein, 10 aa, Artificial Sequence
  Synthetic Peptide
SLQSVSLHLV

SEQ ID NO: 5418 - protein, 10 aa, Artificial Sequence
  Synthetic Peptide
SLQTVSLHLV

SEQ ID NO: 5419 - protein, 10 aa, Artificial Sequence
  Synthetic Peptide
SLQVVSLHLV

SEQ ID NO: 5420 - protein, 10 aa, Artificial Sequence
  Synthetic Peptide
FLRPRSLQVV

SEQ ID NO: 5421 - protein, 10 aa, Artificial Sequence
  Synthetic Peptide
FLRPRSLQTV

SEQ ID NO: 5422 - protein, 10 aa, Artificial Sequence
  Synthetic Peptide
FLRPRSLQAV

SEQ ID NO: 5423 - protein, 11 aa, Artificial Sequence
  Synthetic Peptide
ILLSVGPTGAV

SEQ ID NO: 5424 - protein, 11 aa, Artificial Sequence
  Synthetic Peptide
ILLSVGVTGAV

SEQ ID NO: 5425 - protein, 11 aa, Artificial Sequence
  Synthetic Peptide
PLVANGVLQGV

SEQ ID NO: 5426 - protein, 11 aa, Artificial Sequence
  Synthetic Peptide
PLVPNGVLQGV

SEQ ID NO: 5427 - protein, 11 aa, Artificial Sequence
  Synthetic Peptide
PLVSNGVLQGV

SEQ ID NO: 5428 - protein, 11 aa, Artificial Sequence
  Synthetic Peptide
PLVTNGVLQGV

SEQ ID NO: 5429 - protein, 11 aa, Artificial Sequence
  Synthetic Peptide
SLHLLSNDMAA

SEQ ID NO: 5430 - protein, 11 aa, Artificial Sequence
  Synthetic Peptide
SLHLLSNDMSA

SEQ ID NO: 5431 - protein, 11 aa, Artificial Sequence
  Synthetic Peptide
SLHLLSNDMTA

SEQ ID NO: 5432 - protein, 11 aa, Artificial Sequence
  Synthetic Peptide
SLHLLSNDMVA

SEQ ID NO: 5433 - protein, 8 aa, Artificial Sequence
  Synthetic Peptide
ALGTTCYA

SEQ ID NO: 5434 - protein, 9 aa, Artificial Sequence
  Synthetic Peptide
MLLRLSEPA

SEQ ID NO: 5435 - protein, 9 aa, Artificial Sequence
  Synthetic Peptide
SLQCVSLHL

SEQ ID NO: 5436 - protein, 11 aa, Artificial Sequence
  Synthetic Peptide
KVTEFMLCAGV

SEQ ID NO: 5437 - protein, 9 aa, Artificial Sequence
  Synthetic Peptide
LLLARAASV

SEQ ID NO: 5438 - protein, 9 aa, Artificial Sequence
  Synthetic Peptide
SLSLGFLFV

SEQ ID NO: 5439 - protein, 9 aa, Artificial Sequence
  Synthetic Peptide
FLFLLFFWV

SEQ ID NO: 5440 - protein, 9 aa, Artificial Sequence
  Synthetic Peptide
GVSIWNPIV

SEQ ID NO: 5441 - protein, 9 aa, Artificial Sequence
  Synthetic Peptide
TVSGLQMAV

SEQ ID NO: 5442 - protein, 9 aa, Artificial Sequence
  Synthetic Peptide
FLTLSVTWV

SEQ ID NO: 5443 - protein, 9 aa, Artificial Sequence
  Synthetic Peptide
TLSVTWIGV

SEQ ID NO: 5444 - protein, 9 aa, Artificial Sequence
  Synthetic Peptide
KVTKFMLCV

SEQ ID NO: 5445 - protein, 10 aa, Artificial Sequence
  Synthetic Peptide
ALSVGCTGAV

SEQ ID NO: 5446 - protein, 10 aa, Artificial Sequence
  Synthetic Peptide
QVAVYSHGWA

SEQ ID NO: 5447 - protein, 10 aa, Artificial Sequence
  Synthetic Peptide
LMLLRLSEPA

SEQ ID NO: 5448 - protein, 10 aa, Artificial Sequence
  Synthetic Peptide
FLRPRSLQCV

SEQ ID NO: 5449 - protein, 10 aa, Artificial Sequence
  Synthetic Peptide
LVCNGVLQGI

SEQ ID NO: 5450 - protein, 10 aa, Artificial Sequence
  Synthetic Peptide
RAAPLLLARA

SEQ ID NO: 5451 - protein, 10 aa, Artificial Sequence
  Synthetic Peptide
LLARAASLSV

SEQ ID NO: 5452 - protein, 10 aa, Artificial Sequence
  Synthetic Peptide
SLSLGFLFLV

SEQ ID NO: 5453 - protein, 10 aa, Artificial Sequence
  Synthetic Peptide
SLLAKELKFV

SEQ ID NO: 5454 - protein, 10 aa, Artificial Sequence
  Synthetic Peptide
VLAKELKFVV

SEQ ID NO: 5455 - protein, 10 aa, Artificial Sequence
  Synthetic Peptide
TLMSAMTNLV

SEQ ID NO: 5456 - protein, 10 aa, Artificial Sequence
  Synthetic Peptide
LLALFPPEGV

SEQ ID NO: 5457 - protein, 10 aa, Artificial Sequence
  Synthetic Peptide
LVALFPPEGV

SEQ ID NO: 5458 - protein, 10 aa, Artificial Sequence
  Synthetic Peptide
ALFPPEGVSV

SEQ ID NO: 5459 - protein, 10 aa, Artificial Sequence
  Synthetic Peptide
GVSIWNPILV

SEQ ID NO: 5460 - protein, 10 aa, Artificial Sequence
  Synthetic Peptide
PLLLWQPIPV

SEQ ID NO: 5461 - protein, 10 aa, Artificial Sequence
  Synthetic Peptide
LLWQPIPVHV

SEQ ID NO: 5462 - protein, 10 aa, Artificial Sequence
  Synthetic Peptide
GLHGQDLFGV

SEQ ID NO: 5463 - protein, 10 aa, Artificial Sequence
  Synthetic Peptide
KLRELSELSV

SEQ ID NO: 5464 - protein, 10 aa, Artificial Sequence
  Synthetic Peptide
EILNHMKRAT

SEQ ID NO: 5465 - protein, 10 aa, Artificial Sequence
  Synthetic Peptide
DTTVSGLQMA

SEQ ID NO: 5466 - protein, 10 aa, Artificial Sequence
  Synthetic Peptide
LLPPYASCHV

SEQ ID NO: 5467 - protein, 10 aa, Artificial Sequence
  Synthetic Peptide
LTLSVTWIGA

SEQ ID NO: 5468 - protein, 10 aa, Artificial Sequence
  Synthetic Peptide
KLQCVDLHVV

SEQ ID NO: 5469 - protein, 11 aa, Artificial Sequence
  Synthetic Peptide
VLVHPQWVLTA

SEQ ID NO: 5470 - protein, 11 aa, Artificial Sequence
  Synthetic Peptide
VLVHPQWVLTV

SEQ ID NO: 5471 - protein, 11 aa, Artificial Sequence
  Synthetic Peptide
LVHPQWVLTAA

SEQ ID NO: 5472 - protein, 11 aa, Artificial Sequence
  Synthetic Peptide
DLMLLRLSEPV

SEQ ID NO: 5473 - protein, 11 aa, Artificial Sequence
  Synthetic Peptide
SLHLLSNDMCA

SEQ ID NO: 5474 - protein, 11 aa, Artificial Sequence
  Synthetic Peptide
HLLSNDMCARA

SEQ ID NO: 5475 - protein, 11 aa, Artificial Sequence
  Synthetic Peptide
KVTEFMLCAGL

SEQ ID NO: 5476 - protein, 11 aa, Artificial Sequence
  Synthetic Peptide
PLVCNGVLQGV

SEQ ID NO: 5477 - protein, 11 aa, Artificial Sequence
  Synthetic Peptide
RAAPLLLARAA

SEQ ID NO: 5478 - protein, 11 aa, Artificial Sequence
  Synthetic Peptide
LLLARAASLSL

SEQ ID NO: 5479 - protein, 11 aa, Artificial Sequence
  Synthetic Peptide
AASLSLGFLFL

SEQ ID NO: 5480 - protein, 11 aa, Artificial Sequence
  Synthetic Peptide
FLLFFWLDRSV

SEQ ID NO: 5481 - protein, 11 aa, Artificial Sequence
  Synthetic Peptide
LLFFWLDRSVL

SEQ ID NO: 5482 - protein, 11 aa, Artificial Sequence
  Synthetic Peptide
VLAKELKFVTL

SEQ ID NO: 5483 - protein, 11 aa, Artificial Sequence
  Synthetic Peptide
FLNESYKHEQV

SEQ ID NO: 5484 - protein, 11 aa, Artificial Sequence
  Synthetic Peptide
VVFLTLSVTWV

SEQ ID NO: 5485 - protein, 11 aa, Artificial Sequence
  Synthetic Peptide
FLTLSVTWIGV

SEQ ID NO: 5486 - protein, 11 aa, Artificial Sequence
  Synthetic Peptide
VLVHPQWVLTV

SEQ ID NO: 5487 - protein, 11 aa, Artificial Sequence
  Synthetic Peptide
SVFHPEDTGQV

SEQ ID NO: 5488 - protein, 11 aa, Artificial Sequence
  Synthetic Peptide
DLMLLRLSEPV

SEQ ID NO: 5489 - protein, 11 aa, Artificial Sequence
  Synthetic Peptide
HLISNDVCAQV

SEQ ID NO: 5490 - protein, 11 aa, Artificial Sequence
  Synthetic Peptide
PLVCNGVLQGV

SEQ ID NO: 5491 - protein, 8 aa, Artificial Sequence
  Synthetic Peptide
RAAPLLLA

SEQ ID NO: 5492 - protein, 8 aa, Artificial Sequence
  Synthetic Peptide
PLLLARAA

SEQ ID NO: 5493 - protein, 8 aa, Artificial Sequence
  Synthetic Peptide
LLARAASL

SEQ ID NO: 5494 - protein, 8 aa, Artificial Sequence
  Synthetic Peptide
SLGFLFLL

SEQ ID NO: 5495 - protein, 8 aa, Artificial Sequence
  Synthetic Peptide
WLDRSVLA

SEQ ID NO: 5496 - protein, 8 aa, Artificial Sequence
  Synthetic Peptide
LAKELKFV

SEQ ID NO: 5497 - protein, 8 aa, Artificial Sequence
  Synthetic Peptide
ELKFVTLV

SEQ ID NO: 5498 - protein, 8 aa, Artificial Sequence
  Synthetic Peptide
DTFPTDPI

SEQ ID NO: 5499 - protein, 8 aa, Artificial Sequence
  Synthetic Peptide
GMEQHYEL

SEQ ID NO: 5500 - protein, 8 aa, Artificial Sequence
  Synthetic Peptide
STDVDRTL

SEQ ID NO: 5501 - protein, 8 aa, Artificial Sequence
  Synthetic Peptide
RLTMSAMT

SEQ ID NO: 5502 - protein, 8 aa, Artificial Sequence
  Synthetic Peptide
LMSAMTNL

SEQ ID NO: 5503 - protein, 8 aa, Artificial Sequence
  Synthetic Peptide
SAMTNLAA

SEQ ID NO: 5504 - protein, 8 aa, Artificial Sequence
  Synthetic Peptide
AMTNLAAL

SEQ ID NO: 5505 - protein, 8 aa, Artificial Sequence
  Synthetic Peptide
ALFPPEGV

SEQ ID NO: 5506 - protein, 8 aa, Artificial Sequence
  Synthetic Peptide
GVSIWNPI

SEQ ID NO: 5507 - protein, 8 aa, Artificial Sequence
  Synthetic Peptide
SIWNPILL

SEQ ID NO: 5508 - protein, 8 aa, Artificial Sequence
  Synthetic Peptide
PILLWQPI

SEQ ID NO: 5509 - protein, 8 aa, Artificial Sequence
  Synthetic Peptide
LLWQPIPV

SEQ ID NO: 5510 - protein, 8 aa, Artificial Sequence
  Synthetic Peptide
PLSEDQLL

SEQ ID NO: 5511 - protein, 8 aa, Artificial Sequence
  Synthetic Peptide
FIATLGKL

SEQ ID NO: 5512 - protein, 8 aa, Artificial Sequence
  Synthetic Peptide
TLGKLSGL

SEQ ID NO: 5513 - protein, 8 aa, Artificial Sequence
  Synthetic Peptide
FTLPSWAT

SEQ ID NO: 5514 - protein, 8 aa, Artificial Sequence
  Synthetic Peptide
WATEDTMT

SEQ ID NO: 5515 - protein, 8 aa, Artificial Sequence
  Synthetic Peptide
TMTKLREL

SEQ ID NO: 5516 - protein, 10 aa, Artificial Sequence
  Synthetic Peptide
KLRELSELSV

SEQ ID NO: 5517 - protein, 8 aa, Artificial Sequence
  Synthetic Peptide
ELSELSLL

SEQ ID NO: 5518 - protein, 8 aa, Artificial Sequence
  Synthetic Peptide
SLLSLYGI

SEQ ID NO: 5519 - protein, 8 aa, Artificial Sequence
  Synthetic Peptide
RLQGGVLV

SEQ ID NO: 5520 - protein, 8 aa, Artificial Sequence
  Synthetic Peptide
GVLVNEIL

SEQ ID NO: 5521 - protein, 8 aa, Artificial Sequence
  Synthetic Peptide
ILNHMKRA

SEQ ID NO: 5522 - protein, 8 aa, Artificial Sequence
  Synthetic Peptide
HMKRATQI

SEQ ID NO: 5523 - protein, 8 aa, Artificial Sequence
  Synthetic Peptide
QIPSYKKL

SEQ ID NO: 5524 - protein, 8 aa, Artificial Sequence
  Synthetic Peptide
IMYSAHDT

SEQ ID NO: 5525 - protein, 8 aa, Artificial Sequence
  Synthetic Peptide
TTVSGLQM

SEQ ID NO: 5526 - protein, 9 aa, Artificial Sequence
  Synthetic Peptide
TVSGLQMAV

SEQ ID NO: 5527 - protein, 8 aa, Artificial Sequence
  Synthetic Peptide
GLQMALDV

SEQ ID NO: 5528 - protein, 8 aa, Artificial Sequence
  Synthetic Peptide
ALDVYNGL

SEQ ID NO: 5529 - protein, 8 aa, Artificial Sequence
  Synthetic Peptide
EMYYRNET

SEQ ID NO: 5530 - protein, 8 aa, Artificial Sequence
  Synthetic Peptide
PLERFAEL

SEQ ID NO: 5531 - protein, 8 aa, Artificial Sequence
  Synthetic Peptide
FAELVGPV

SEQ ID NO: 5532 - protein, 8 aa, Artificial Sequence
  Synthetic Peptide
VIPQDWST

SEQ ID NO: 5533 - protein, 8 aa, Artificial Sequence
  Synthetic Peptide
TTNSHQGT

SEQ ID NO: 5534 - protein, 8 aa, Artificial Sequence
  Synthetic Peptide
LLHETDSA

SEQ ID NO: 5535 - protein, 8 aa, Artificial Sequence
  Synthetic Peptide
ETDSAVAT

SEQ ID NO: 5536 - protein, 8 aa, Artificial Sequence
  Synthetic Peptide
TARRPRWL

SEQ ID NO: 5537 - protein, 8 aa, Artificial Sequence
  Synthetic Peptide
WLCAGALV

SEQ ID NO: 5538 - protein, 8 aa, Artificial Sequence
  Synthetic Peptide
CAGALVLA

SEQ ID NO: 5539 - protein, 8 aa, Artificial Sequence
  Synthetic Peptide
VLAGGFFL

SEQ ID NO: 5540 - protein, 8 aa, Artificial Sequence
  Synthetic Peptide
LAGGFFLL

SEQ ID NO: 5541 - protein, 8 aa, Artificial Sequence
  Synthetic Peptide
FIKSSNEA

SEQ ID NO: 5542 - protein, 8 aa, Artificial Sequence
  Synthetic Peptide
NITPKHNM

SEQ ID NO: 5543 - protein, 8 aa, Artificial Sequence
  Synthetic Peptide
FLYNFTQI

SEQ ID NO: 5544 - protein, 8 aa, Artificial Sequence
  Synthetic Peptide
FTQIPHLA

SEQ ID NO: 5545 - protein, 8 aa, Artificial Sequence
  Synthetic Peptide
QIPHLAGT

SEQ ID NO: 5546 - protein, 8 aa, Artificial Sequence
  Synthetic Peptide
GTEQNFQL

SEQ ID NO: 5547 - protein, 8 aa, Artificial Sequence
  Synthetic Peptide
GLDSVELA

SEQ ID NO: 5548 - protein, 8 aa, Artificial Sequence
  Synthetic Peptide
ELAHYDVL

SEQ ID NO: 5549 - protein, 8 aa, Artificial Sequence
  Synthetic Peptide
LAHYDVLL

SEQ ID NO: 5550 - protein, 8 aa, Artificial Sequence
  Synthetic Peptide
LLSYPNKT

SEQ ID NO: 5551 - protein, 8 aa, Artificial Sequence
  Synthetic Peptide
DIVPPFSA

SEQ ID NO: 5552 - protein, 8 aa, Artificial Sequence
  Synthetic Peptide
SAFSPQGM

SEQ ID NO: 5553 - protein, 8 aa, Artificial Sequence
  Synthetic Peptide
GMPEGDLV

SEQ ID NO: 5554 - protein, 8 aa, Artificial Sequence
  Synthetic Peptide
DLVYVNYA

SEQ ID NO: 5555 - protein, 8 aa, Artificial Sequence
  Synthetic Peptide
RTEDFFKL

SEQ ID NO: 5556 - protein, 8 aa, Artificial Sequence
  Synthetic Peptide
KLERDMKI

SEQ ID NO: 5557 - protein, 8 aa, Artificial Sequence
  Synthetic Peptide
KINCSGKI

SEQ ID NO: 5558 - protein, 8 aa, Artificial Sequence
  Synthetic Peptide
VIARYGKV

SEQ ID NO: 5559 - protein, 8 aa, Artificial Sequence
  Synthetic Peptide
KVFRGNKV

SEQ ID NO: 5560 - protein, 8 aa, Artificial Sequence
  Synthetic Peptide
KVKNAQLA

SEQ ID NO: 5561 - protein, 8 aa, Artificial Sequence
  Synthetic Peptide
QLAGAKGV

SEQ ID NO: 5562 - protein, 8 aa, Artificial Sequence
  Synthetic Peptide
LAGAKGVI

SEQ ID NO: 5563 - protein, 8 aa, Artificial Sequence
  Synthetic Peptide
VILYSDPA

SEQ ID NO: 5564 - protein, 8 aa, Artificial Sequence
  Synthetic Peptide
GVQRGNIL

SEQ ID NO: 5565 - protein, 8 aa, Artificial Sequence
  Synthetic Peptide
NILNLNGA

SEQ ID NO: 5566 - protein, 8 aa, Artificial Sequence
  Synthetic Peptide
PLTPGYPA

SEQ ID NO: 5567 - protein, 8 aa, Artificial Sequence
  Synthetic Peptide
YAYRRGIA

SEQ ID NO: 5568 - protein, 8 aa, Artificial Sequence
  Synthetic Peptide
GIAEAVGL

SEQ ID NO: 5569 - protein, 8 aa, Artificial Sequence
  Synthetic Peptide
EAVGLPSI

SEQ ID NO: 5570 - protein, 8 aa, Artificial Sequence
  Synthetic Peptide
SLKVPYNV

SEQ ID NO: 5571 - protein, 8 aa, Artificial Sequence
  Synthetic Peptide
HIHSTNEV

SEQ ID NO: 5572 - protein, 8 aa, Artificial Sequence
  Synthetic Peptide
STNEVTRI

SEQ ID NO: 5573 - protein, 8 aa, Artificial Sequence
  Synthetic Peptide
EVTRIYNV

SEQ ID NO: 5574 - protein, 8 aa, Artificial Sequence
  Synthetic Peptide
VTRIYNVI

SEQ ID NO: 5575 - protein, 8 aa, Artificial Sequence
  Synthetic Peptide
RIYNVIGT

SEQ ID NO: 5576 - protein, 8 aa, Artificial Sequence
  Synthetic Peptide
VIGTLRGA

SEQ ID NO: 5577 - protein, 8 aa, Artificial Sequence
  Synthetic Peptide
AVEPDRYV

SEQ ID NO: 5578 - protein, 8 aa, Artificial Sequence
  Synthetic Peptide
GIDPQSGA

SEQ ID NO: 5579 - protein, 8 aa, Artificial Sequence
  Synthetic Peptide
GAAVVHEI

SEQ ID NO: 5580 - protein, 8 aa, Artificial Sequence
  Synthetic Peptide
AAVVHEIV

SEQ ID NO: 5581 - protein, 8 aa, Artificial Sequence
  Synthetic Peptide
EIVRSFGT

SEQ ID NO: 5582 - protein, 8 aa, Artificial Sequence
  Synthetic Peptide
IVRSFGTL

SEQ ID NO: 5583 - protein, 8 aa, Artificial Sequence
  Synthetic Peptide
ILFASWDA

SEQ ID NO: 5584 - protein, 8 aa, Artificial Sequence
  Synthetic Peptide
DAEEFGLL

SEQ ID NO: 5585 - protein, 8 aa, Artificial Sequence
  Synthetic Peptide
LLGSTEWA

SEQ ID NO: 5586 - protein, 8 aa, Artificial Sequence
  Synthetic Peptide
WAEENSRL

SEQ ID NO: 5587 - protein, 8 aa, Artificial Sequence
  Synthetic Peptide
RLLQERGV

SEQ ID NO: 5588 - protein, 8 aa, Artificial Sequence
  Synthetic Peptide
LLQERGVA

SEQ ID NO: 5589 - protein, 8 aa, Artificial Sequence
  Synthetic Peptide
YINADSSI

SEQ ID NO: 5590 - protein, 8 aa, Artificial Sequence
  Synthetic Peptide
SIEGNYTL

SEQ ID NO: 5591 - protein, 8 aa, Artificial Sequence
  Synthetic Peptide
YTLRVDCT

SEQ ID NO: 5592 - protein, 8 aa, Artificial Sequence
  Synthetic Peptide
RVDCTPLM

SEQ ID NO: 5593 - protein, 8 aa, Artificial Sequence
  Synthetic Peptide
CTPLMYSL

SEQ ID NO: 5594 - protein, 8 aa, Artificial Sequence
  Synthetic Peptide
GMPRISKL

SEQ ID NO: 5595 - protein, 8 aa, Artificial Sequence
  Synthetic Peptide
SVYETYEL

SEQ ID NO: 5596 - protein, 8 aa, Artificial Sequence
  Synthetic Peptide
PMFKYHLT

SEQ ID NO: 5597 - protein, 8 aa, Artificial Sequence
  Synthetic Peptide
VAQVRGGM

SEQ ID NO: 5598 - protein, 8 aa, Artificial Sequence
  Synthetic Peptide
ELANSIVL

SEQ ID NO: 5599 - protein, 8 aa, Artificial Sequence
  Synthetic Peptide
AVVLRKYA

SEQ ID NO: 5600 - protein, 8 aa, Artificial Sequence
  Synthetic Peptide
YADKIYSI

SEQ ID NO: 5601 - protein, 8 aa, Artificial Sequence
  Synthetic Peptide
SMKHPQEM

SEQ ID NO: 5602 - protein, 8 aa, Artificial Sequence
  Synthetic Peptide
AVKNFTEI

SEQ ID NO: 5603 - protein, 8 aa, Artificial Sequence
  Synthetic Peptide
RMMNDQLM

SEQ ID NO: 5604 - protein, 8 aa, Artificial Sequence
  Synthetic Peptide
QLMFLERA

SEQ ID NO: 5605 - protein, 8 aa, Artificial Sequence
  Synthetic Peptide
EVKRQIYV

SEQ ID NO: 5606 - protein, 8 aa, Artificial Sequence
  Synthetic Peptide
QIYVAAFT

SEQ ID NO: 5607 - protein, 8 aa, Artificial Sequence
  Synthetic Peptide
VAAFTVQA

SEQ ID NO: 5608 - protein, 8 aa, Artificial Sequence
  Synthetic Peptide
AAFTVQAA

SEQ ID NO: 5609 - protein, 8 aa, Artificial Sequence
  Synthetic Peptide
TVQAAAET

SEQ ID NO: 5610 - protein, 8 aa, Artificial Sequence
  Synthetic Peptide
AAETLSEV

SEQ ID NO: 5611 - protein, 9 aa, Artificial Sequence
  Synthetic Peptide
LVHETDSAV

SEQ ID NO: 5612 - protein, 9 aa, Artificial Sequence
  Synthetic Peptide
ETDSAVATA

SEQ ID NO: 5613 - protein, 9 aa, Artificial Sequence
  Synthetic Peptide
WLCAGALVV

SEQ ID NO: 5614 - protein, 9 aa, Artificial Sequence
  Synthetic Peptide
LVLAGGFFV

SEQ ID NO: 5615 - protein, 9 aa, Artificial Sequence
  Synthetic Peptide
FIKSSNEAT

SEQ ID NO: 5616 - protein, 9 aa, Artificial Sequence
  Synthetic Peptide
ITPKHNMKA

SEQ ID NO: 5617 - protein, 9 aa, Artificial Sequence
  Synthetic Peptide
KAFLDELKA

SEQ ID NO: 5618 - protein, 9 aa, Artificial Sequence
  Synthetic Peptide
GTEQNFQLA

SEQ ID NO: 5619 - protein, 9 aa, Artificial Sequence
  Synthetic Peptide
ELAHYDVLV

SEQ ID NO: 5620 - protein, 9 aa, Artificial Sequence
  Synthetic Peptide
LYYVNYART

SEQ ID NO: 5621 - protein, 9 aa, Artificial Sequence
  Synthetic Peptide
GVILYSDPA

SEQ ID NO: 5622 - protein, 9 aa, Artificial Sequence
  Synthetic Peptide
ALGLPSIPV

SEQ ID NO: 5623 - protein, 9 aa, Artificial Sequence
  Synthetic Peptide
DAQKLLEKM

SEQ ID NO: 5624 - protein, 9 aa, Artificial Sequence
  Synthetic Peptide
KVKMHIHST

SEQ ID NO: 5625 - protein, 9 aa, Artificial Sequence
  Synthetic Peptide
HIHSTNEVT

SEQ ID NO: 5626 - protein, 9 aa, Artificial Sequence
  Synthetic Peptide
NVIGTLRGA

SEQ ID NO: 5627 - protein, 9 aa, Artificial Sequence
  Synthetic Peptide
GIDPQSGAA

SEQ ID NO: 5628 - protein, 9 aa, Artificial Sequence
  Synthetic Peptide
TILFASWDA

SEQ ID NO: 5629 - protein, 9 aa, Artificial Sequence
  Synthetic Peptide
GLLGSTEWV

SEQ ID NO: 5630 - protein, 9 aa, Artificial Sequence
  Synthetic Peptide
TLRVDCTPV

SEQ ID NO: 5631 - protein, 9 aa, Artificial Sequence
  Synthetic Peptide
IASGRARYT

SEQ ID NO: 5632 - protein, 9 aa, Artificial Sequence
  Synthetic Peptide
SLYETYELV

SEQ ID NO: 5633 - protein, 9 aa, Artificial Sequence
  Synthetic Peptide
LVEKFYDPM

SEQ ID NO: 5634 - protein, 9 aa, Artificial Sequence
  Synthetic Peptide
PLFKYHLTV

SEQ ID NO: 5635 - protein, 9 aa, Artificial Sequence
  Synthetic Peptide
PVFKYHLTF

SEQ ID NO: 5636 - protein, 9 aa, Artificial Sequence
  Synthetic Peptide
TVAQVRGGM

SEQ ID NO: 5637 - protein, 9 aa, Artificial Sequence
  Synthetic Peptide
MVFELANSV

SEQ ID NO: 5638 - protein, 9 aa, Artificial Sequence
  Synthetic Peptide
YAVVLRKYA

SEQ ID NO: 5639 - protein, 9 aa, Artificial Sequence
  Synthetic Peptide
AVKNFTEIA

SEQ ID NO: 5640 - protein, 9 aa, Artificial Sequence
  Synthetic Peptide
EVKRQIYVA

SEQ ID NO: 5641 - protein, 9 aa, Artificial Sequence
  Synthetic Peptide
QLYVAAFTV

SEQ ID NO: 5642 - protein, 9 aa, Artificial Sequence
  Synthetic Peptide
QVYVAAFTV

SEQ ID NO: 5643 - protein, 9 aa, Artificial Sequence
  Synthetic Peptide
YVAAFTVQA

SEQ ID NO: 5644 - protein, 9 aa, Artificial Sequence
  Synthetic Peptide
VAAFTVQAA

SEQ ID NO: 5645 - protein, 9 aa, Artificial Sequence
  Synthetic Peptide
AAFTVQAAA

SEQ ID NO: 5646 - protein, 9 aa, Artificial Sequence
  Synthetic Peptide
FTVQAAAET

SEQ ID NO: 5647 - protein, 9 aa, Artificial Sequence
  Synthetic Peptide
AAETLSEVA

SEQ ID NO: 5648 - protein, 10 aa, Artificial Sequence
  Synthetic Peptide
NVLHETDSAV

SEQ ID NO: 5649 - protein, 10 aa, Artificial Sequence
  Synthetic Peptide
TARRPRWLCA

SEQ ID NO: 5650 - protein, 10 aa, Artificial Sequence
  Synthetic Peptide
WLCAGALVLV

SEQ ID NO: 5651 - protein, 10 aa, Artificial Sequence
  Synthetic Peptide
ALVLAGGFFV

SEQ ID NO: 5652 - protein, 10 aa, Artificial Sequence
  Synthetic Peptide
LVLAGGFFLV

SEQ ID NO: 5653 - protein, 9 aa, Artificial Sequence
  Synthetic Peptide
LLGFLGWFV

SEQ ID NO: 5654 - protein, 10 aa, Artificial Sequence
  Synthetic Peptide
ATNITPKHNM

SEQ ID NO: 5655 - protein, 10 aa, Artificial Sequence
  Synthetic Peptide
NITPKHNMKA

SEQ ID NO: 5656 - protein, 10 aa, Artificial Sequence
  Synthetic Peptide
FLDELKAENV

SEQ ID NO: 5657 - protein, 10 aa, Artificial Sequence
  Synthetic Peptide
NIKKFLYNFT

SEQ ID NO: 5658 - protein, 10 aa, Artificial Sequence
  Synthetic Peptide
FTQIPHLAGT

SEQ ID NO: 5659 - protein, 10 aa, Artificial Sequence
  Synthetic Peptide
DVLLSYPNKT

SEQ ID NO: 5660 - protein, 10 aa, Artificial Sequence
  Synthetic Peptide
KVKNAQLAGA

SEQ ID NO: 5661 - protein, 10 aa, Artificial Sequence
  Synthetic Peptide
YAYRRGIAEA

SEQ ID NO: 5662 - protein, 10 aa, Artificial Sequence
  Synthetic Peptide
PVHPIGYYDA

SEQ ID NO: 5663 - protein, 10 aa, Artificial Sequence
  Synthetic Peptide
KLHIHSTNEV

SEQ ID NO: 5664 - protein, 10 aa, Artificial Sequence
  Synthetic Peptide
KVHIHSTNEV

SEQ ID NO: 5665 - protein, 11 aa, Artificial Sequence
  Synthetic Peptide
VTRIYNVIGTL

SEQ ID NO: 5666 - protein, 10 aa, Artificial Sequence
  Synthetic Peptide
RTILFASWDA

SEQ ID NO: 5667 - protein, 10 aa, Artificial Sequence
  Synthetic Peptide
LLQERGVAYV

SEQ ID NO: 5668 - protein, 10 aa, Artificial Sequence
  Synthetic Peptide
KVGSGNDFEV

SEQ ID NO: 5669 - protein, 10 aa, Artificial Sequence
  Synthetic Peptide
EVFFQRLGIA

SEQ ID NO: 5670 - protein, 10 aa, Artificial Sequence
  Synthetic Peptide
GIASGRARYT

SEQ ID NO: 5671 - protein, 10 aa, Artificial Sequence
  Synthetic Peptide
RARYTKNWET

SEQ ID NO: 5672 - protein, 11 aa, Artificial Sequence
  Synthetic Peptide
LTVAQVRGGMV

SEQ ID NO: 5673 - protein, 10 aa, Artificial Sequence
  Synthetic Peptide
MLFELANSIV

SEQ ID NO: 5674 - protein, 10 aa, Artificial Sequence
  Synthetic Peptide
VLPFDCRDYV

SEQ ID NO: 5675 - protein, 10 aa, Artificial Sequence
  Synthetic Peptide
YADKIYSISM

SEQ ID NO: 5676 - protein, 10 aa, Artificial Sequence
  Synthetic Peptide
SISMKHPQEM

SEQ ID NO: 5677 - protein, 11 aa, Artificial Sequence
  Synthetic Peptide
SVSFDSLFSAV

SEQ ID NO: 5678 - protein, 10 aa, Artificial Sequence
  Synthetic Peptide
SLFSAVKNFV

SEQ ID NO: 5679 - protein, 10 aa, Artificial Sequence
  Synthetic Peptide
SAVKNFTEIA

SEQ ID NO: 5680 - protein, 10 aa, Artificial Sequence
  Synthetic Peptide
FLERAFIDPV

SEQ ID NO: 5681 - protein, 10 aa, Artificial Sequence
  Synthetic Peptide
YAPSSHNKYA

SEQ ID NO: 5682 - protein, 10 aa, Artificial Sequence
  Synthetic Peptide
EVKRQIYVAA

SEQ ID NO: 5683 - protein, 10 aa, Artificial Sequence
  Synthetic Peptide
YVAAFTVQAA

SEQ ID NO: 5684 - protein, 10 aa, Artificial Sequence
  Synthetic Peptide
VAAFTVQAAA

SEQ ID NO: 5685 - protein, 10 aa, Artificial Sequence
  Synthetic Peptide
AAAETLSEVA

SEQ ID NO: 5686 - protein, 11 aa, Artificial Sequence
  Synthetic Peptide
DVDRTLMSAMT

SEQ ID NO: 5687 - protein, 11 aa, Artificial Sequence
  Synthetic Peptide
RTLMSAMTNLA

SEQ ID NO: 5688 - protein, 11 aa, Artificial Sequence
  Synthetic Peptide
TLMSAMTNLAA

SEQ ID NO: 5689 - protein, 11 aa, Artificial Sequence
  Synthetic Peptide
LMSAMTNLAAL

SEQ ID NO: 5690 - protein, 11 aa, Artificial Sequence
  Synthetic Peptide
NLAALFPPEGV

SEQ ID NO: 5691 - protein, 11 aa, Artificial Sequence
  Synthetic Peptide
AALFPPEGVSI

SEQ ID NO: 5692 - protein, 11 aa, Artificial Sequence
  Synthetic Peptide
ILLWQPIPVHT

SEQ ID NO: 5693 - protein, 11 aa, Artificial Sequence
  Synthetic Peptide
LLWQPIPVHTV

SEQ ID NO: 5694 - protein, 11 aa, Artificial Sequence
  Synthetic Peptide
HTVPLSEDQLL

SEQ ID NO: 5695 - protein, 11 aa, Artificial Sequence
  Synthetic Peptide
TLKSEEFQKRL

SEQ ID NO: 5696 - protein, 11 aa, Artificial Sequence
  Synthetic Peptide
RLHPYKDFIAT

SEQ ID NO: 5697 - protein, 11 aa, Artificial Sequence
  Synthetic Peptide
FIATLGKLSGL

SEQ ID NO: 5698 - protein, 11 aa, Artificial Sequence
  Synthetic Peptide
KVYDPLYCESV

SEQ ID NO: 5699 - protein, 11 aa, Artificial Sequence
  Synthetic Peptide
PLYCESVHNFT

SEQ ID NO: 5700 - protein, 11 aa, Artificial Sequence
  Synthetic Peptide
SVHNFTLPSWA

SEQ ID NO: 5701 - protein, 11 aa, Artificial Sequence
  Synthetic Peptide
FTLPSWATEDT

SEQ ID NO: 5702 - protein, 11 aa, Artificial Sequence
  Synthetic Peptide
TLPSWATEDTM

SEQ ID NO: 5703 - protein, 11 aa, Artificial Sequence
  Synthetic Peptide
TMTKLRELSEL

SEQ ID NO: 5704 - protein, 11 aa, Artificial Sequence
  Synthetic Peptide
KLRELSELSLL

SEQ ID NO: 5705 - protein, 11 aa, Artificial Sequence
  Synthetic Peptide
GIHKQKEKSRL

SEQ ID NO: 5706 - protein, 11 aa, Artificial Sequence
  Synthetic Peptide
RLQGGVLVNEI

SEQ ID NO: 5707 - protein, 11 aa, Artificial Sequence
  Synthetic Peptide
GVLVNEILNHM

SEQ ID NO: 5708 - protein, 11 aa, Artificial Sequence
  Synthetic Peptide
ILNHMKRATQI

SEQ ID NO: 5709 - protein, 11 aa, Artificial Sequence
  Synthetic Peptide
RATQIPSYKKL

SEQ ID NO: 5710 - protein, 11 aa, Artificial Sequence
  Synthetic Peptide
ATQIPSYKKLI

SEQ ID NO: 5711 - protein, 11 aa, Artificial Sequence
  Synthetic Peptide
KLIMYSAHDTT

SEQ ID NO: 5712 - protein, 11 aa, Artificial Sequence
  Synthetic Peptide
LIMYSAHDTTV

SEQ ID NO: 5713 - protein, 11 aa, Artificial Sequence
  Synthetic Peptide
DTTVSGLQMAL

SEQ ID NO: 5714 - protein, 11 aa, Artificial Sequence
  Synthetic Peptide
TVSGLQMALDV

SEQ ID NO: 5715 - protein, 11 aa, Artificial Sequence
  Synthetic Peptide
QMALDVYNGLL

SEQ ID NO: 5716 - protein, 11 aa, Artificial Sequence
  Synthetic Peptide
DVYNGLLPPYA

SEQ ID NO: 5717 - protein, 11 aa, Artificial Sequence
  Synthetic Peptide
GLLPPYASCHL

SEQ ID NO: 5718 - protein, 11 aa, Artificial Sequence
  Synthetic Peptide
LLPPYASCHLT

SEQ ID NO: 5719 - protein, 11 aa, Artificial Sequence
  Synthetic Peptide
ELYFEKGEYFV

SEQ ID NO: 5720 - protein, 11 aa, Artificial Sequence
  Synthetic Peptide
ETQHEPYPLML

SEQ ID NO: 5721 - protein, 11 aa, Artificial Sequence
  Synthetic Peptide
MLPGCSPSCPL

SEQ ID NO: 5722 - protein, 11 aa, Artificial Sequence
  Synthetic Peptide
VIPQDWSTECM

SEQ ID NO: 5723 - protein, 11 aa, Artificial Sequence
  Synthetic Peptide
NLLHETDSAVA

SEQ ID NO: 5724 - protein, 11 aa, Artificial Sequence
  Synthetic Peptide
LLHETDSAVAT

SEQ ID NO: 5725 - protein, 11 aa, Artificial Sequence
  Synthetic Peptide
AVATARRPRWL

SEQ ID NO: 5726 - protein, 11 aa, Artificial Sequence
  Synthetic Peptide
ATARRPRWLCA

SEQ ID NO: 5727 - protein, 11 aa, Artificial Sequence
  Synthetic Peptide
GALVLAGGFFL

SEQ ID NO: 5728 - protein, 11 aa, Artificial Sequence
  Synthetic Peptide
ALVLAGGFFLL

SEQ ID NO: 5729 - protein, 11 aa, Artificial Sequence
  Synthetic Peptide
LAGGFFLLGFL

SEQ ID NO: 5730 - protein, 11 aa, Artificial Sequence
  Synthetic Peptide
FLLGFLFGWFI

SEQ ID NO: 5731 - protein, 11 aa, Artificial Sequence
  Synthetic Peptide
FIKSSNEATNI

SEQ ID NO: 5732 - protein, 11 aa, Artificial Sequence
  Synthetic Peptide
EATNITPKHNM

SEQ ID NO: 5733 - protein, 11 aa, Artificial Sequence
  Synthetic Peptide
ITPKHNMKAFL

SEQ ID NO: 5734 - protein, 11 aa, Artificial Sequence
  Synthetic Peptide
NMKAFLDELKA

SEQ ID NO: 5735 - protein, 11 aa, Artificial Sequence
  Synthetic Peptide
ELKAENIKKFL

SEQ ID NO: 5736 - protein, 11 aa, Artificial Sequence
  Synthetic Peptide
FLYNFTQIPHL

SEQ ID NO: 5737 - protein, 11 aa, Artificial Sequence
  Synthetic Peptide
HLAGTEQNFQL

SEQ ID NO: 5738 - protein, 11 aa, Artificial Sequence
  Synthetic Peptide
LAGTEQNFQLA

SEQ ID NO: 5739 - protein, 11 aa, Artificial Sequence
  Synthetic Peptide
QIQSQWKEFGL

SEQ ID NO: 5740 - protein, 11 aa, Artificial Sequence
  Synthetic Peptide
SVELAHYDVLL

SEQ ID NO: 5741 - protein, 11 aa, Artificial Sequence
  Synthetic Peptide
NVSDIVPPFSA

SEQ ID NO: 5742 - protein, 11 aa, Artificial Sequence
  Synthetic Peptide
DMKINCSGKIV

SEQ ID NO: 5743 - protein, 11 aa, Artificial Sequence
  Synthetic Peptide
KINCSGKIVIA

SEQ ID NO: 5744 - protein, 11 aa, Artificial Sequence
  Synthetic Peptide
KVFRGNKVKNA

SEQ ID NO: 5745 - protein, 12 aa, Artificial Sequence
  Synthetic Peptide
NAQLAAGAKGVI

SEQ ID NO: 5746 - protein, 11 aa, Artificial Sequence
  Synthetic Peptide
ILYSDPADYFA

SEQ ID NO: 5747 - protein, 11 aa, Artificial Sequence
  Synthetic Peptide
GVKSYPDGWNL

SEQ ID NO: 5748 - protein, 11 aa, Artificial Sequence
  Synthetic Peptide
ILNLNGAGDPL

SEQ ID NO: 5749 - protein, 11 aa, Artificial Sequence
  Synthetic Peptide
LTPGYPANEYA

SEQ ID NO: 5750 - protein, 11 aa, Artificial Sequence
  Synthetic Peptide
PANEYAYRRGI

SEQ ID NO: 5751 - protein, 11 aa, Artificial Sequence
  Synthetic Peptide
YAYRRGIAEAV

SEQ ID NO: 5752 - protein, 11 aa, Artificial Sequence
  Synthetic Peptide
GIAEAVGLPSI

SEQ ID NO: 5753 - protein, 11 aa, Artificial Sequence
  Synthetic Peptide
PIGYYDAQKLL

SEQ ID NO: 5754 - protein, 11 aa, Artificial Sequence
  Synthetic Peptide
KVPYNVGPGFT

SEQ ID NO: 5755 - protein, 11 aa, Artificial Sequence
  Synthetic Peptide
KMHIHSTNEVT

SEQ ID NO: 5756 - protein, 11 aa, Artificial Sequence
  Synthetic Peptide
HIHSTNEVTRI

SEQ ID NO: 5757 - protein, 11 aa, Artificial Sequence
  Synthetic Peptide
STNEVTRIYNV

SEQ ID NO: 5758 - protein, 11 aa, Artificial Sequence
  Synthetic Peptide
EVTRIYNVIGT

SEQ ID NO: 5759 - protein, 11 aa, Artificial Sequence
  Synthetic Peptide
VTRIYNVIGTL

SEQ ID NO: 5760 - protein, 11 aa, Artificial Sequence
  Synthetic Peptide
GAVEPDRYVIL

SEQ ID NO: 5761 - protein, 11 aa, Artificial Sequence
  Synthetic Peptide
VILGGHRDSWV

SEQ ID NO: 5762 - protein, 11 aa, Artificial Sequence
  Synthetic Peptide
GIDPQSGAAVV

SEQ ID NO: 5763 - protein, 11 aa, Artificial Sequence
  Synthetic Peptide
VVHEIVRSFGT

SEQ ID NO: 5764 - protein, 11 aa, Artificial Sequence
  Synthetic Peptide
FASWDAEEFGL

SEQ ID NO: 5765 - protein, 11 aa, Artificial Sequence
  Synthetic Peptide
DAEEFGLLGST

SEQ ID NO: 5766 - protein, 11 aa, Artificial Sequence
  Synthetic Peptide
STEWAEENSRL

SEQ ID NO: 5767 - protein, 11 aa, Artificial Sequence
  Synthetic Peptide
RLLQERGVAYI

SEQ ID NO: 5768 - protein, 11 aa, Artificial Sequence
  Synthetic Peptide
GVAYINADSSI

SEQ ID NO: 5769 - protein, 11 aa, Artificial Sequence
  Synthetic Peptide
NADSSIEGNYT

SEQ ID NO: 5770 - protein, 11 aa, Artificial Sequence
  Synthetic Peptide
YTLRVDCTPLM

SEQ ID NO: 5771 - protein, 11 aa, Artificial Sequence
  Synthetic Peptide
RVDCTPLMYSL

SEQ ID NO: 5772 - protein, 11 aa, Artificial Sequence
  Synthetic Peptide
PLMYSLVHNLT

SEQ ID NO: 5773 - protein, 11 aa, Artificial Sequence
  Synthetic Peptide
HLTVAQVRGGM

SEQ ID NO: 5774 - protein, 11 aa, Artificial Sequence
  Synthetic Peptide
LTVAQVRGGMV

SEQ ID NO: 5775 - protein, 11 aa, Artificial Sequence
  Synthetic Peptide
QVRGGMVFELA

SEQ ID NO: 5776 - protein, 11 aa, Artificial Sequence
  Synthetic Peptide
GMVFELANSIV

SEQ ID NO: 5777 - protein, 11 aa, Artificial Sequence
  Synthetic Peptide
MVFELANSIVL

SEQ ID NO: 5778 - protein, 11 aa, Artificial Sequence
  Synthetic Peptide
IVLPFDCRDYA

SEQ ID NO: 5779 - protein, 11 aa, Artificial Sequence
  Synthetic Peptide
VLPFDCRDYAV

SEQ ID NO: 5780 - protein, 11 aa, Artificial Sequence
  Synthetic Peptide
AVVLRKYADKI

SEQ ID NO: 5781 - protein, 11 aa, Artificial Sequence
  Synthetic Peptide
SVSFDSLFSAV

SEQ ID NO: 5782 - protein, 11 aa, Artificial Sequence
  Synthetic Peptide
RLQDFDKSNPI

SEQ ID NO: 5783 - protein, 11 aa, Artificial Sequence
  Synthetic Peptide
PIVLRMMNDQL

SEQ ID NO: 5784 - protein, 11 aa, Artificial Sequence
  Synthetic Peptide
IVLRMMNDQLM

SEQ ID NO: 5785 - protein, 11 aa, Artificial Sequence
  Synthetic Peptide
GLPDRPFYRHV

SEQ ID NO: 5786 - protein, 11 aa, Artificial Sequence
  Synthetic Peptide
DIESKVDPSKA

SEQ ID NO: 5787 - protein, 11 aa, Artificial Sequence
  Synthetic Peptide
KVDPSKAWGEV

SEQ ID NO: 5788 - protein, 11 aa, Artificial Sequence
  Synthetic Peptide
QIYVAAFTVQA

SEQ ID NO: 5789 - protein, 11 aa, Artificial Sequence
  Synthetic Peptide
YVAAFTVQAAA

SEQ ID NO: 5790 - protein, 11 aa, Artificial Sequence
  Synthetic Peptide
AAFTVQAAAET

SEQ ID NO: 5791 - protein, 11 aa, Artificial Sequence
  Synthetic Peptide
QAAAETLSEVA

SEQ ID NO: 5792 - protein, 8 aa, Artificial Sequence
  Synthetic Peptide
PQGFGQLT

SEQ ID NO: 5793 - protein, 8 aa, Artificial Sequence
  Synthetic Peptide
GQLTQLGM

SEQ ID NO: 5794 - protein, 8 aa, Artificial Sequence
  Synthetic Peptide
EQVYIRST

SEQ ID NO: 5795 - protein, 8 aa, Artificial Sequence
  Synthetic Peptide
WQPIPVHT

SEQ ID NO: 5796 - protein, 8 aa, Artificial Sequence
  Synthetic Peptide
FQELESET

SEQ ID NO: 5797 - protein, 8 aa, Artificial Sequence
  Synthetic Peptide
KQKEKSRL

SEQ ID NO: 5798 - protein, 8 aa, Artificial Sequence
  Synthetic Peptide
TQHEPYPL

SEQ ID NO: 5799 - protein, 8 aa, Artificial Sequence
  Synthetic Peptide
HQGTEDST

SEQ ID NO: 5800 - protein, 8 aa, Artificial Sequence
  Synthetic Peptide
SQPWQVLV

SEQ ID NO: 5801 - protein, 8 aa, Artificial Sequence
  Synthetic Peptide
LQCVDLHV

SEQ ID NO: 5802 - protein, 8 aa, Artificial Sequence
  Synthetic Peptide
AQVHPQKV

SEQ ID NO: 5803 - protein, 8 aa, Artificial Sequence
  Synthetic Peptide
PQKVTKFM

SEQ ID NO: 5804 - protein, 8 aa, Artificial Sequence
  Synthetic Peptide
SQWKEFGL

SEQ ID NO: 5805 - protein, 8 aa, Artificial Sequence
  Synthetic Peptide
AQKLLEKM

SEQ ID NO: 5806 - protein, 8 aa, Artificial Sequence
  Synthetic Peptide
TQKVKMHI

SEQ ID NO: 5807 - protein, 8 aa, Artificial Sequence
  Synthetic Peptide
PQSGAAVV

SEQ ID NO: 5808 - protein, 8 aa, Artificial Sequence
  Synthetic Peptide
AQVRGGMV

SEQ ID NO: 5809 - protein, 8 aa, Artificial Sequence
  Synthetic Peptide
VQAAAETL

SEQ ID NO: 5810 - protein, 9 aa, Artificial Sequence
  Synthetic Peptide
WQPIPVHTV

SEQ ID NO: 5811 - protein, 9 aa, Artificial Sequence
  Synthetic Peptide
FQELESETL

SEQ ID NO: 5812 - protein, 9 aa, Artificial Sequence
  Synthetic Peptide
TQIPSYKKL

SEQ ID NO: 5813 - protein, 9 aa, Artificial Sequence
  Synthetic Peptide
TQHEPYPLM

SEQ ID NO: 5814 - protein, 9 aa, Artificial Sequence
  Synthetic Peptide
PQDWSTECM

SEQ ID NO: 5815 - protein, 9 aa, Artificial Sequence
  Synthetic Peptide
SQPWQVLVA

SEQ ID NO: 5816 - protein, 9 aa, Artificial Sequence
  Synthetic Peptide
LQCVDLHVI

SEQ ID NO: 5817 - protein, 9 aa, Artificial Sequence
  Synthetic Peptide
AQVHPQKVT

SEQ ID NO: 5818 - protein, 9 aa, Artificial Sequence
  Synthetic Peptide
PQKVTKFML

SEQ ID NO: 5819 - protein, 9 aa, Artificial Sequence
  Synthetic Peptide
TQIPHLAGT

SEQ ID NO: 5820 - protein, 9 aa, Artificial Sequence
  Synthetic Peptide
PQGMPEGDL

SEQ ID NO: 5821 - protein, 9 aa, Artificial Sequence
  Synthetic Peptide
AQLAGAKGV

SEQ ID NO: 5822 - protein, 9 aa, Artificial Sequence
  Synthetic Peptide
VQRGNILNL

SEQ ID NO: 5823 - protein, 9 aa, Artificial Sequence
  Synthetic Peptide
LQERGVAYI

SEQ ID NO: 5824 - protein, 9 aa, Artificial Sequence
  Synthetic Peptide
PQEMKTYSV

SEQ ID NO: 5825 - protein, 9 aa, Artificial Sequence
  Synthetic Peptide
DQLMFLERA

SEQ ID NO: 5826 - protein, 9 aa, Artificial Sequence
  Synthetic Peptide
RQIYVAAFT

SEQ ID NO: 5827 - protein, 9 aa, Artificial Sequence
  Synthetic Peptide
KLTDVVKVL

SEQ ID NO: 5828 - protein, 9 aa, Artificial Sequence
  Synthetic Peptide
KVTDVVKVL

SEQ ID NO: 5829 - protein, 9 aa, Artificial Sequence
  Synthetic Peptide
KTTDVVKVL

SEQ ID NO: 5830 - protein, 9 aa, Artificial Sequence
  Synthetic Peptide
KITDVVKVV

SEQ ID NO: 5831 - protein, 9 aa, Artificial Sequence
  Synthetic Peptide
PLLGTTCYA

SEQ ID NO: 5832 - protein, 9 aa, Artificial Sequence
  Synthetic Peptide
PVLGTTCYA

SEQ ID NO: 5833 - protein, 9 aa, Artificial Sequence
  Synthetic Peptide
PTLGTTCYA

SEQ ID NO: 5834 - protein, 9 aa, Artificial Sequence
  Synthetic Peptide
PALGTTCYV

SEQ ID NO: 5835 - protein, 10 aa, Artificial Sequence
  Synthetic Peptide
PQGFGQLTQL

SEQ ID NO: 5836 - protein, 10 aa, Artificial Sequence
  Synthetic Peptide
EQHYELGEYI

SEQ ID NO: 5837 - protein, 10 aa, Artificial Sequence
  Synthetic Peptide
EQVYIRSTDV

SEQ ID NO: 5838 - protein, 10 aa, Artificial Sequence
  Synthetic Peptide
LQGGVLVNEI

SEQ ID NO: 5839 - protein, 10 aa, Artificial Sequence
  Synthetic Peptide
TQIPSYKKLI

SEQ ID NO: 5840 - protein, 10 aa, Artificial Sequence
  Synthetic Peptide
TQHEPYPLML

SEQ ID NO: 5841 - protein, 10 aa, Artificial Sequence
  Synthetic Peptide
PQDWSTECMT

SEQ ID NO: 5842 - protein, 10 aa, Artificial Sequence
  Synthetic Peptide
EQNFQLAKQI

SEQ ID NO: 5843 - protein, 10 aa, Artificial Sequence
  Synthetic Peptide
IQSQWKEFGL

SEQ ID NO: 5844 - protein, 10 aa, Artificial Sequence
  Synthetic Peptide
PQGMPEGDLV

SEQ ID NO: 5845 - protein, 10 aa, Artificial Sequence
  Synthetic Peptide
AQLAGAKGVI

SEQ ID NO: 5846 - protein, 10 aa, Artificial Sequence
  Synthetic Peptide
LQDFDKSNPI

SEQ ID NO: 5847 - protein, 10 aa, Artificial Sequence
  Synthetic Peptide
RQIYVAAFTB

SEQ ID NO: 5848 - protein, 10 aa, Artificial Sequence
  Synthetic Peptide
ILLSVGCTGA

SEQ ID NO: 5849 - protein, 10 aa, Artificial Sequence
  Synthetic Peptide
IVLSVGCTGA

SEQ ID NO: 5850 - protein, 10 aa, Artificial Sequence
  Synthetic Peptide
ITLSVGCTGA

SEQ ID NO: 5851 - protein, 10 aa, Artificial Sequence
  Synthetic Peptide
IALSVGCTGV

SEQ ID NO: 5852 - protein, 10 aa, Artificial Sequence
  Synthetic Peptide
GLVPLIQSRI

SEQ ID NO: 5853 - protein, 10 aa, Artificial Sequence
  Synthetic Peptide
GVVPLIQSRI

SEQ ID NO: 5854 - protein, 10 aa, Artificial Sequence
  Synthetic Peptide
GTVPLIQSRI

SEQ ID NO: 5855 - protein, 10 aa, Artificial Sequence
  Synthetic Peptide
GAVPLIQSRV

SEQ ID NO: 5856 - protein, 10 aa, Artificial Sequence
  Synthetic Peptide
CLRAYSEKVT

SEQ ID NO: 5857 - protein, 10 aa, Artificial Sequence
  Synthetic Peptide
CVRAYSEKVT

SEQ ID NO: 5858 - protein, 10 aa, Artificial Sequence
  Synthetic Peptide
CTRAYSEKVT

SEQ ID NO: 5859 - protein, 10 aa, Artificial Sequence
  Synthetic Peptide
CARAYSEKVV

SEQ ID NO: 5860 - protein, 11 aa, Artificial Sequence
  Synthetic Peptide
TQLGMEQHYEL

SEQ ID NO: 5861 - protein, 11 aa, Artificial Sequence
  Synthetic Peptide
WQPIPVHTVPL

SEQ ID NO: 5862 - protein, 11 aa, Artificial Sequence
  Synthetic Peptide
GQDLFGIWSKV

SEQ ID NO: 5863 - protein, 11 aa, Artificial Sequence
  Synthetic Peptide
LQGGVLVNEIL

SEQ ID NO: 5864 - protein, 11 aa, Artificial Sequence
  Synthetic Peptide
TQIPSYKKLIM

SEQ ID NO: 5865 - protein, 11 aa, Artificial Sequence
  Synthetic Peptide
LQMALDVYNGL

SEQ ID NO: 5866 - protein, 11 aa, Artificial Sequence
  Synthetic Peptide
PQDWSTECMTT

SEQ ID NO: 5867 - protein, 11 aa, Artificial Sequence
  Synthetic Peptide
WQVLVASRGRA

SEQ ID NO: 5868 - protein, 11 aa, Artificial Sequence
  Synthetic Peptide
PQWVLTAACHI

SEQ ID NO: 5869 - protein, 11 aa, Artificial Sequence
  Synthetic Peptide
FQVSHSFPHPL

SEQ ID NO: 5870 - protein, 11 aa, Artificial Sequence
  Synthetic Peptide
PQKVTKFMLCA

SEQ ID NO: 5871 - protein, 11 aa, Artificial Sequence
  Synthetic Peptide
SQWKEFGLDSV

SEQ ID NO: 5872 - protein, 11 aa, Artificial Sequence
  Synthetic Peptide
AQLAGAKGVIL

SEQ ID NO: 5873 - protein, 11 aa, Artificial Sequence
  Synthetic Peptide
TQKVKMHIHST

SEQ ID NO: 5874 - protein, 11 aa, Artificial Sequence
  Synthetic Peptide
PQSGAAVVHEI

SEQ ID NO: 5875 - protein, 11 aa, Artificial Sequence
  Synthetic Peptide
LQERGVAYINA

SEQ ID NO: 5876 - protein, 11 aa, Artificial Sequence
  Synthetic Peptide
FQRLGIASGRA

SEQ ID NO: 5877 - protein, 11 aa, Artificial Sequence
  Synthetic Peptide
AQVRGGMVFEL

SEQ ID NO: 5878 - protein, 11 aa, Artificial Sequence
  Synthetic Peptide
LQDFDKSNPIV

SEQ ID NO: 5879 - protein, 11 aa, Artificial Sequence
  Synthetic Peptide
DQLMFLERAFI

SEQ ID NO: 5880 - protein, 11 aa, Artificial Sequence
  Synthetic Peptide
VQAAAETLSEV

SEQ ID NO: 5881 - protein, 11 aa, Artificial Sequence
  Synthetic Peptide
SLALSVGCTGA

SEQ ID NO: 5882 - protein, 11 aa, Artificial Sequence
  Synthetic Peptide
SVALSVGCTGA

SEQ ID NO: 5883 - protein, 11 aa, Artificial Sequence
  Synthetic Peptide
STALSVGCTGA

SEQ ID NO: 5884 - protein, 11 aa, Artificial Sequence
  Synthetic Peptide
SIALSVGCTGV

SEQ ID NO: 5885 - protein, 9 aa, Artificial Sequence
  Synthetic Peptide
AYAKAAAAF

SEQ ID NO: 5886 - protein, 9 aa, Artificial Sequence
  Synthetic Peptide
AFAKAAAAF

SEQ ID NO: 5887 - protein, 9 aa, Artificial Sequence
  Synthetic Peptide
APAKAAAAF

SEQ ID NO: 5888 - protein, 9 aa, Artificial Sequence
  Synthetic Peptide
AAAKAAAAF

SEQ ID NO: 5889 - protein, 9 aa, Artificial Sequence
  Synthetic Peptide
AKAKAAAAF

SEQ ID NO: 5890 - protein, 9 aa, Artificial Sequence
  Synthetic Peptide
AYAKAAAAI

SEQ ID NO: 5891 - protein, 9 aa, Artificial Sequence
  Synthetic Peptide
AYAKAAAAL

SEQ ID NO: 5892 - protein, 9 aa, Artificial Sequence
  Synthetic Peptide
AYAKAAAAV

SEQ ID NO: 5893 - protein, 9 aa, Artificial Sequence
  Synthetic Peptide
AYAKAAAAA

SEQ ID NO: 5894 - protein, 9 aa, Artificial Sequence
  Synthetic Peptide
AYAKAAAAY

SEQ ID NO: 5895 - protein, 9 aa, Artificial Sequence
  Synthetic Peptide
AYAKAAAAK

SEQ ID NO: 5896 - protein, 11 aa, Artificial Sequence
  Synthetic Peptide
GLAPPQQLIRV

SEQ ID NO: 5897 - protein, 11 aa, Artificial Sequence
  Synthetic Peptide
GLAPPQSLIRV

SEQ ID NO: 5898 - protein, 9 aa, Artificial Sequence
  Synthetic Peptide
LLGRDSFEV

SEQ ID NO: 5899 - protein, 9 aa, Artificial Sequence
  Synthetic Peptide
LLSRDSFEV

SEQ ID NO: 5900 - protein, 9 aa, Artificial Sequence
  Synthetic Peptide
LLDRDSFEV

SEQ ID NO: 5901 - protein, 9 aa, Artificial Sequence
  Synthetic Peptide
LLHRDSFEV

SEQ ID NO: 5902 - protein, 9 aa, Artificial Sequence
  Synthetic Peptide
LLGRNSFEV

SEQ ID NO: 5903 - protein, 9 aa, Artificial Sequence
  Synthetic Peptide
LLGRQSFEV

SEQ ID NO: 5904 - protein, 9 aa, Artificial Sequence
  Synthetic Peptide
LLGRGSFEV

SEQ ID NO: 5905 - protein, 9 aa, Artificial Sequence
  Synthetic Peptide
LLGRDSLEV

SEQ ID NO: 5906 - protein, 9 aa, Artificial Sequence
  Synthetic Peptide
LLGRDSMEV

SEQ ID NO: 5907 - protein, 9 aa, Artificial Sequence
  Synthetic Peptide
LLGRDSHEV

SEQ ID NO: 5908 - protein, 10 aa, Artificial Sequence
  Synthetic Peptide
YLQLVFGIEV

SEQ ID NO: 5909 - protein, 10 aa, Artificial Sequence
  Synthetic Peptide
YLQLIFGIEV

SEQ ID NO: 5910 - protein, 10 aa, Artificial Sequence
  Synthetic Peptide
YLQLFFGIEV

SEQ ID NO: 5911 - protein, 9 aa, Artificial Sequence
  Synthetic Peptide
SMPPPGTRV

SEQ ID NO: 5912 - protein, 9 aa, Artificial Sequence
  Synthetic Peptide
CMPPPGTRV

SEQ ID NO: 5913 - protein, 9 aa, Artificial Sequence
  Synthetic Peptide
SMPPPGPRV

SEQ ID NO: 5914 - protein, 9 aa, Artificial Sequence
  Synthetic Peptide
ILLEPVHGV

SEQ ID NO: 5915 - protein, 9 aa, Artificial Sequence
  Synthetic Peptide
ILHEPVHGV

SEQ ID NO: 5916 - protein, 9 aa, Artificial Sequence
  Synthetic Peptide
GLSRYVPRL

SEQ ID NO: 5917 - protein, 9 aa, Artificial Sequence
  Synthetic Peptide
GLRSYVARL

SEQ ID NO: 5918 - protein, 9 aa, Artificial Sequence
  Synthetic Peptide
ILVEPVHGV

SEQ ID NO: 5919 - protein, 9 aa, Artificial Sequence
  Synthetic Peptide
ILKDPVHGV

SEQ ID NO: 5920 - protein, 9 aa, Artificial Sequence
  Synthetic Peptide
ILKQPVHGV

SEQ ID NO: 5921 - protein, 9 aa, Artificial Sequence
  Synthetic Peptide
ILKNPVHGV

SEQ ID NO: 5922 - protein, 9 aa, Artificial Sequence
  Synthetic Peptide
ILKHPVHGV

SEQ ID NO: 5923 - protein, 9 aa, Artificial Sequence
  Synthetic Peptide
ILKTPVHGV

SEQ ID NO: 5924 - protein, 9 aa, Artificial Sequence
  Synthetic Peptide
ILKRPVHGV

SEQ ID NO: 5925 - protein, 9 aa, Artificial Sequence
  Synthetic Peptide
ILKVPVHGV

SEQ ID NO: 5926 - protein, 9 aa, Artificial Sequence
  Synthetic Peptide
ILKLPVHGV

SEQ ID NO: 5927 - protein, 9 aa, Artificial Sequence
  Synthetic Peptide
ILKYPVHGV

SEQ ID NO: 5928 - protein, 9 aa, Artificial Sequence
  Synthetic Peptide
ILKFPVHGV

SEQ ID NO: 5929 - protein, 9 aa, Artificial Sequence
  Synthetic Peptide
ILKETVHGV

SEQ ID NO: 5930 - protein, 9 aa, Artificial Sequence
  Synthetic Peptide
ILKESVHGV

SEQ ID NO: 5931 - protein, 9 aa, Artificial Sequence
  Synthetic Peptide
ILKEFVHGV

SEQ ID NO: 5932 - protein, 9 aa, Artificial Sequence
  Synthetic Peptide
ATDKAAAAY

SEQ ID NO: 5933 - protein, 9 aa, Artificial Sequence
  Synthetic Peptide
ATAKAAAAY

SEQ ID NO: 5934 - protein, 9 aa, Artificial Sequence
  Synthetic Peptide
ASAKAAAAY

SEQ ID NO: 5935 - protein, 9 aa, Artificial Sequence
  Synthetic Peptide
AMAKAAAAY

SEQ ID NO: 5936 - protein, 9 aa, Artificial Sequence
  Synthetic Peptide
AAAKAAAAY

SEQ ID NO: 5937 - protein, 9 aa, Artificial Sequence
  Synthetic Peptide
ALAKAAAAY

SEQ ID NO: 5938 - protein, 9 aa, Artificial Sequence
  Synthetic Peptide
AIAKAAAAY

SEQ ID NO: 5939 - protein, 9 aa, Artificial Sequence
  Synthetic Peptide
AVAKAAAAY

SEQ ID NO: 5940 - protein, 9 aa, Artificial Sequence
  Synthetic Peptide
AKAKAAAAY

SEQ ID NO: 5941 - protein, 9 aa, Artificial Sequence
  Synthetic Peptide
ANAKAAAAY

SEQ ID NO: 5942 - protein, 9 aa, Artificial Sequence
  Synthetic Peptide
ADAKAAAAY

SEQ ID NO: 5943 - protein, 9 aa, Artificial Sequence
  Synthetic Peptide
AGAKAAAAY

SEQ ID NO: 5944 - protein, 9 aa, Artificial Sequence
  Synthetic Peptide
APAKAAAAY

SEQ ID NO: 5945 - protein, 9 aa, Artificial Sequence
  Synthetic Peptide
AYAKAAAAY

SEQ ID NO: 5946 - protein, 9 aa, Artificial Sequence
  Synthetic Peptide
AHAKAAAAY

SEQ ID NO: 5947 - protein, 9 aa, Artificial Sequence
  Synthetic Peptide
ATAKAAAAA

SEQ ID NO: 5948 - protein, 9 aa, Artificial Sequence
  Synthetic Peptide
ATAKAAAAF

SEQ ID NO: 5949 - protein, 9 aa, Artificial Sequence
  Synthetic Peptide
ATAKAAAAH

SEQ ID NO: 5950 - protein, 9 aa, Artificial Sequence
  Synthetic Peptide
ATAKAAAAV

SEQ ID NO: 5951 - protein, 9 aa, Artificial Sequence
  Synthetic Peptide
ATAKAAAAN

SEQ ID NO: 5952 - protein, 9 aa, Artificial Sequence
  Synthetic Peptide
ATAKAAAAD

SEQ ID NO: 5953 - protein, 9 aa, Artificial Sequence
  Synthetic Peptide
ATAKAAAAW

SEQ ID NO: 5954 - protein, 9 aa, Artificial Sequence
  Synthetic Peptide
ATAKAAAAK

SEQ ID NO: 5955 - protein, 9 aa, Artificial Sequence
  Synthetic Peptide
ATAKAAAAI

SEQ ID NO: 5956 - protein, 9 aa, Artificial Sequence
  Synthetic Peptide
ATAKAAAAP

SEQ ID NO: 5957 - protein, 9 aa, Artificial Sequence
  Synthetic Peptide
ATDKAAAAY

SEQ ID NO: 5958 - protein, 9 aa, Artificial Sequence
  Synthetic Peptide
ATAKAAAAY

SEQ ID NO: 5959 - protein, 9 aa, Artificial Sequence
  Synthetic Peptide
AADKAAAAY

SEQ ID NO: 5960 - protein, 9 aa, Artificial Sequence
  Synthetic Peptide
AAEKAAAAY

SEQ ID NO: 5961 - protein, 9 aa, Artificial Sequence
  Synthetic Peptide
AAAKAAAAY

SEQ ID NO: 5962 - protein, 9 aa, Artificial Sequence
  Synthetic Peptide
AASKAAAAY

SEQ ID NO: 5963 - protein, 9 aa, Artificial Sequence
  Synthetic Peptide
AANKAAAAY

SEQ ID NO: 5964 - protein, 9 aa, Artificial Sequence
  Synthetic Peptide
AAQKAAAAY

SEQ ID NO: 5965 - protein, 9 aa, Artificial Sequence
  Synthetic Peptide
AAKKAAAAY

SEQ ID NO: 5966 - protein, 9 aa, Artificial Sequence
  Synthetic Peptide
AADKAAAAA

SEQ ID NO: 5967 - protein, 9 aa, Artificial Sequence
  Synthetic Peptide
AADKAAAAW

SEQ ID NO: 5968 - protein, 9 aa, Artificial Sequence
  Synthetic Peptide
AADKAAAAF

SEQ ID NO: 5969 - protein, 9 aa, Artificial Sequence
  Synthetic Peptide
AADKAAAAK

SEQ ID NO: 5970 - protein, 9 aa, Artificial Sequence
  Synthetic Peptide
AATLGFGAY

SEQ ID NO: 5971 - protein, 10 aa, Artificial Sequence
  Synthetic Peptide
AQPGYPWPLY

SEQ ID NO: 5972 - protein, 9 aa, Artificial Sequence
  Synthetic Peptide
CSFSIFLLA

SEQ ID NO: 5973 - protein, 9 aa, Artificial Sequence
  Synthetic Peptide
LHGPTPLLY

SEQ ID NO: 5974 - protein, 10 aa, Artificial Sequence
  Synthetic Peptide
TCGFADLMGY

SEQ ID NO: 5975 - protein, 9 aa, Artificial Sequence
  Synthetic Peptide
RYLRDQQLL

SEQ ID NO: 5976 - protein, 10 aa, Artificial Sequence
  Synthetic Peptide
RYPLTFGWCF

SEQ ID NO: 5977 - protein, 9 aa, Artificial Sequence
  Synthetic Peptide
AFADLTVVY

SEQ ID NO: 5978 - protein, 9 aa, Artificial Sequence
  Synthetic Peptide
AFKDLCIVY

SEQ ID NO: 5979 - protein, 9 aa, Artificial Sequence
  Synthetic Peptide
AFKDLFVVY

SEQ ID NO: 5980 - protein, 9 aa, Artificial Sequence
  Synthetic Peptide
ATLERTEVY

SEQ ID NO: 5981 - protein, 10 aa, Artificial Sequence
  Synthetic Peptide
ATSNYYIVTY

SEQ ID NO: 5982 - protein, 9 aa, Artificial Sequence
  Synthetic Peptide
AYAACHKCI

SEQ ID NO: 5983 - protein, 9 aa, Artificial Sequence
  Synthetic Peptide
CYSLYGTTL

SEQ ID NO: 5984 - protein, 9 aa, Artificial Sequence
  Synthetic Peptide
DYSVYGATL

SEQ ID NO: 5985 - protein, 10 aa, Artificial Sequence
  Synthetic Peptide
EYRHYCYSLY

SEQ ID NO: 5986 - protein, 9 aa, Artificial Sequence
  Synthetic Peptide
EYRHYNYSL

SEQ ID NO: 5987 - protein, 10 aa, Artificial Sequence
  Synthetic Peptide
EYRHYNYSLY

SEQ ID NO: 5988 - protein, 10 aa, Artificial Sequence
  Synthetic Peptide
EYRHYNYSVY

SEQ ID NO: 5989 - protein, 9 aa, Artificial Sequence
  Synthetic Peptide
EYRHYQYSL

SEQ ID NO: 5990 - protein, 10 aa, Artificial Sequence
  Synthetic Peptide
EYRHYQYSLY

SEQ ID NO: 5991 - protein, 10 aa, Artificial Sequence
  Synthetic Peptide
FYSKVRKYRY

SEQ ID NO: 5992 - protein, 10 aa, Artificial Sequence
  Synthetic Peptide
FYSKVSEFRW

SEQ ID NO: 5993 - protein, 10 aa, Artificial Sequence
  Synthetic Peptide
FYSRIRELRY

SEQ ID NO: 5994 - protein, 9 aa, Artificial Sequence
  Synthetic Peptide
ISEYRHYNY

SEQ ID NO: 5995 - protein, 9 aa, Artificial Sequence
  Synthetic Peptide
ISEYRHYNY

SEQ ID NO: 5996 - protein, 9 aa, Artificial Sequence
  Synthetic Peptide
KFLFTDLRI

SEQ ID NO: 5997 - protein, 9 aa, Artificial Sequence
  Synthetic Peptide
KFYSKISEY

SEQ ID NO: 5998 - protein, 10 aa, Artificial Sequence
  Synthetic Peptide
KYRYYDYSVY

SEQ ID NO: 5999 - protein, 9 aa, Artificial Sequence
  Synthetic Peptide
LCDLLIRCY

SEQ ID NO: 6000 - protein, 9 aa, Artificial Sequence
  Synthetic Peptide
LFTDLRIVY

SEQ ID NO: 6001 - protein, 9 aa, Artificial Sequence
  Synthetic Peptide
LFVVYRDSI

SEQ ID NO: 6002 - protein, 9 aa, Artificial Sequence
  Synthetic Peptide
LFYSKVRKY

SEQ ID NO: 6003 - protein, 9 aa, Artificial Sequence
  Synthetic Peptide
LKEYVLDLY

SEQ ID NO: 6004 - protein, 10 aa, Artificial Sequence
  Synthetic Peptide
LQDIEITCVY

SEQ ID NO: 6005 - protein, 10 aa, Artificial Sequence
  Synthetic Peptide
LSKISEYRHY

SEQ ID NO: 6006 - protein, 10 aa, Artificial Sequence
  Synthetic Peptide
LSKISEYRHY

SEQ ID NO: 6007 - protein, 9 aa, Artificial Sequence
  Synthetic Peptide
LYPEPTDLY

SEQ ID NO: 6008 - protein, 9 aa, Artificial Sequence
  Synthetic Peptide
NFACTELKL

SEQ ID NO: 6009 - protein, 9 aa, Artificial Sequence
  Synthetic Peptide
NYSVYGNTL

SEQ ID NO: 6010 - protein, 9 aa, Artificial Sequence
  Synthetic Peptide
PYAVCDKCL

SEQ ID NO: 6011 - protein, 9 aa, Artificial Sequence
  Synthetic Peptide
PYAVCRVCL

SEQ ID NO: 6012 - protein, 10 aa, Artificial Sequence
  Synthetic Peptide
PYAVCRVCLL

SEQ ID NO: 6013 - protein, 9 aa, Artificial Sequence
  Synthetic Peptide
QAEQATSNY

SEQ ID NO: 6014 - protein, 9 aa, Artificial Sequence
  Synthetic Peptide
QFAFKDLCI

SEQ ID NO: 6015 - protein, 10 aa, Artificial Sequence
  Synthetic Peptide
RFEDPTRRPY

SEQ ID NO: 6016 - protein, 9 aa, Artificial Sequence
  Synthetic Peptide
RFHNIGGRW

SEQ ID NO: 6017 - protein, 9 aa, Artificial Sequence
  Synthetic Peptide
RFHNIMGRW

SEQ ID NO: 6018 - protein, 9 aa, Artificial Sequence
  Synthetic Peptide
RFHNIRGRW

SEQ ID NO: 6019 - protein, 9 aa, Artificial Sequence
  Synthetic Peptide
RFHNISGRW

SEQ ID NO: 6020 - protein, 9 aa, Artificial Sequence
  Synthetic Peptide
RFHNISGRW

SEQ ID NO: 6021 - protein, 9 aa, Artificial Sequence
  Synthetic Peptide
RFHSIAGQY

SEQ ID NO: 6022 - protein, 9 aa, Artificial Sequence
  Synthetic Peptide
RFLSKISEY

SEQ ID NO: 6023 - protein, 9 aa, Artificial Sequence
  Synthetic Peptide
RFLSKISEY

SEQ ID NO: 6024 - protein, 10 aa, Artificial Sequence
  Synthetic Peptide
TFCCKCDSTL

SEQ ID NO: 6025 - protein, 9 aa, Artificial Sequence
  Synthetic Peptide
TSNYYIVTY

SEQ ID NO: 6026 - protein, 10 aa, Artificial Sequence
  Synthetic Peptide
TYCHSCDSTL

SEQ ID NO: 6027 - protein, 9 aa, Artificial Sequence
  Synthetic Peptide
VFADLRIVY

SEQ ID NO: 6028 - protein, 10 aa, Artificial Sequence
  Synthetic Peptide
VFEFAFKDLF

SEQ ID NO: 6029 - protein, 9 aa, Artificial Sequence
  Synthetic Peptide
VYCKTVLEL

SEQ ID NO: 6030 - protein, 9 aa, Artificial Sequence
  Synthetic Peptide
VYDFAFADL

SEQ ID NO: 6031 - protein, 9 aa, Artificial Sequence
  Synthetic Peptide
VYDFVFADL

SEQ ID NO: 6032 - protein, 9 aa, Artificial Sequence
  Synthetic Peptide
VYGETLEKI

SEQ ID NO: 6033 - protein, 9 aa, Artificial Sequence
  Synthetic Peptide
VYKFLFTDL

SEQ ID NO: 6034 - protein, 9 aa, Artificial Sequence
  Synthetic Peptide
VYNFACTEL

SEQ ID NO: 6035 - protein, 10 aa, Artificial Sequence
  Synthetic Peptide
YSKISEYRHY

SEQ ID NO: 6036 - protein, 10 aa, Artificial Sequence
  Synthetic Peptide
YSKVSEFRWY

SEQ ID NO: 6037 - protein, 9 aa, Artificial Sequence
  Synthetic Peptide
YSRIRELRY

SEQ ID NO: 6038 - protein, 9 aa, Artificial Sequence
  Synthetic Peptide
ALFQEYQCY

SEQ ID NO: 6039 - protein, 10 aa, Artificial Sequence
  Synthetic Peptide
FVVPGAATPY

SEQ ID NO: 6040 - protein, 10 aa, Artificial Sequence
  Synthetic Peptide
FYFILVNLLI

SEQ ID NO: 6041 - protein, 9 aa, Artificial Sequence
  Synthetic Peptide
YYGKQENWY

SEQ ID NO: 6042 - protein, 9 aa, Artificial Sequence
  Synthetic Peptide
AFLPWHRLF

SEQ ID NO: 6043 - protein, 9 aa, Artificial Sequence
  Synthetic Peptide
FVQENYLEY

SEQ ID NO: 6044 - protein, 9 aa, Artificial Sequence
  Synthetic Peptide
LVQENYLEY

SEQ ID NO: 6045 - protein, 9 aa, Artificial Sequence
  Synthetic Peptide
LVTCLGLSY

SEQ ID NO: 6046 - protein, 10 aa, Artificial Sequence
  Synthetic Peptide
MEVDPIGHLY

SEQ ID NO: 6047 - protein, 9 aa, Artificial Sequence
  Synthetic Peptide
SYLDSGIHF

SEQ ID NO: 6048 - protein, 9 aa, Artificial Sequence
  Synthetic Peptide
ISEYRHYAY

SEQ ID NO: 6049 - protein, 9 aa, Artificial Sequence
  Synthetic Peptide
VADKALKFY

SEQ ID NO: 6050 - protein, 9 aa, Artificial Sequence
  Synthetic Peptide
QAEPDRAHY

SEQ ID NO: 6051 - protein, 9 aa, Artificial Sequence
  Synthetic Peptide
EIDGPAGQA

SEQ ID NO: 6052 - protein, 9 aa, Artificial Sequence
  Synthetic Peptide
TTDLYAYEQ

SEQ ID NO: 6053 - protein, 9 aa, Artificial Sequence
  Synthetic Peptide
MSAARSSRT

SEQ ID NO: 6054 - protein, 9 aa, Artificial Sequence
  Synthetic Peptide
HVDIRTLED

SEQ ID NO: 6055 - protein, 9 aa, Artificial Sequence
  Synthetic Peptide
WTGRAMSAA

SEQ ID NO: 6056 - protein, 9 aa, Artificial Sequence
  Synthetic Peptide
YRDGNPYAV

SEQ ID NO: 6057 - protein, 9 aa, Artificial Sequence
  Synthetic Peptide
LIRAINAQK

SEQ ID NO: 6058 - protein, 9 aa, Artificial Sequence
  Synthetic Peptide
IVYRDGNPY

SEQ ID NO: 6059 - protein, 9 aa, Artificial Sequence
  Synthetic Peptide
IVAPIASQK

SEQ ID NO: 6060 - protein, 9 aa, Artificial Sequence
  Synthetic Peptide
IILEAVYAK

SEQ ID NO: 6061 - protein, 9 aa, Artificial Sequence
  Synthetic Peptide
HLDKKQRFH

SEQ ID NO: 6062 - protein, 9 aa, Artificial Sequence
  Synthetic Peptide
AMSAARSSR

SEQ ID NO: 6063 - protein, 9 aa, Artificial Sequence
  Synthetic Peptide
AMFQDPQER

SEQ ID NO: 6064 - protein, 9 aa, Artificial Sequence
  Synthetic Peptide
TTLEQQYNK

SEQ ID NO: 6065 - protein, 9 aa, Artificial Sequence
  Synthetic Peptide
AVYAKQQLL

SEQ ID NO: 6066 - protein, 9 aa, Artificial Sequence
  Synthetic Peptide
HYNIVTFAA

SEQ ID NO: 6067 - protein, 9 aa, Artificial Sequence
  Synthetic Peptide
SAARSSRTR

SEQ ID NO: 6068 - protein, 9 aa, Artificial Sequence
  Synthetic Peptide
KFYSKISEY

SEQ ID NO: 6069 - protein, 9 aa, Artificial Sequence
  Synthetic Peptide
SLYGTTLEQ

SEQ ID NO: 6070 - protein, 9 aa, Artificial Sequence
  Synthetic Peptide
YNIVTFAAK

SEQ ID NO: 6071 - protein, 9 aa, Artificial Sequence
  Synthetic Peptide
ISEYRHYAY

SEQ ID NO: 6072 - protein, 9 aa, Artificial Sequence
  Synthetic Peptide
QQLLRREVY

SEQ ID NO: 6073 - protein, 9 aa, Artificial Sequence
  Synthetic Peptide
AVADKALKF

SEQ ID NO: 6074 - protein, 9 aa, Artificial Sequence
  Synthetic Peptide
QQYNKPLAD

SEQ ID NO: 6075 - protein, 9 aa, Artificial Sequence
  Synthetic Peptide
KISEYRHYA

SEQ ID NO: 6076 - protein, 9 aa, Artificial Sequence
  Synthetic Peptide
RHYAYSLYG

SEQ ID NO: 6077 - protein, 9 aa, Artificial Sequence
  Synthetic Peptide
VADKALKFY

SEQ ID NO: 6078 - protein, 9 aa, Artificial Sequence
  Synthetic Peptide
AARSSRTRR

SEQ ID NO: 6079 - protein, 9 aa, Artificial Sequence
  Synthetic Peptide
AAKADSTLR

SEQ ID NO: 6080 - protein, 9 aa, Artificial Sequence
  Synthetic Peptide
VYAKQQLLR

SEQ ID NO: 6081 - protein, 9 aa, Artificial Sequence
  Synthetic Peptide
YAVADKALK

SEQ ID NO: 6082 - protein, 9 aa, Artificial Sequence
  Synthetic Peptide
KADSTLRLA

SEQ ID NO: 6083 - protein, 9 aa, Artificial Sequence
  Synthetic Peptide
IILEAVYAK

SEQ ID NO: 6084 - protein, 9 aa, Artificial Sequence
  Synthetic Peptide
TTLEQQYNK

SEQ ID NO: 6085 - protein, 9 aa, Artificial Sequence
  Synthetic Peptide
IVAPIASQK

SEQ ID NO: 6086 - protein, 9 aa, Artificial Sequence
  Synthetic Peptide
AMFQDPQER

SEQ ID NO: 6087 - protein, 9 aa, Artificial Sequence
  Synthetic Peptide
IVYRDGNPY

SEQ ID NO: 6088 - protein, 9 aa, Artificial Sequence
  Synthetic Peptide
ISEYRHYAY

SEQ ID NO: 6089 - protein, 9 aa, Artificial Sequence
  Synthetic Peptide
AVYAKQQLL

SEQ ID NO: 6090 - protein, 9 aa, Artificial Sequence
  Synthetic Peptide
SAARSSRTR

SEQ ID NO: 6091 - protein, 9 aa, Artificial Sequence
  Synthetic Peptide
LIRAINAQK

SEQ ID NO: 6092 - protein, 9 aa, Artificial Sequence
  Synthetic Peptide
AAKADSTLR

SEQ ID NO: 6093 - protein, 9 aa, Artificial Sequence
  Synthetic Peptide
QQLLRREVY

SEQ ID NO: 6094 - protein, 9 aa, Artificial Sequence
  Synthetic Peptide
AMSAARSSR

SEQ ID NO: 6095 - protein, 9 aa, Artificial Sequence
  Synthetic Peptide
KISEYRHYA

SEQ ID NO: 6096 - protein, 9 aa, Artificial Sequence
  Synthetic Peptide
YAVADKALK

SEQ ID NO: 6097 - protein, 9 aa, Artificial Sequence
  Synthetic Peptide
YNIVTFAAK

SEQ ID NO: 6098 - protein, 9 aa, Artificial Sequence
  Synthetic Peptide
AVADKALKF

SEQ ID NO: 6099 - protein, 9 aa, Artificial Sequence
  Synthetic Peptide
VADKALKFY

SEQ ID NO: 6100 - protein, 9 aa, Artificial Sequence
  Synthetic Peptide
VYAKQQLLR

SEQ ID NO: 6101 - protein, 9 aa, Artificial Sequence
  Synthetic Peptide
TGRAMSAAR

SEQ ID NO: 6102 - protein, 9 aa, Artificial Sequence
  Synthetic Peptide
VAPIASQKP

SEQ ID NO: 6103 - protein, 9 aa, Artificial Sequence
  Synthetic Peptide
HYNIVTFAA

SEQ ID NO: 6104 - protein, 9 aa, Artificial Sequence
  Synthetic Peptide
AYSLYGTTL

SEQ ID NO: 6105 - protein, 9 aa, Artificial Sequence
  Synthetic Peptide
KALKFYSKI

SEQ ID NO: 6106 - protein, 9 aa, Artificial Sequence
  Synthetic Peptide
RFHNIRGRW

SEQ ID NO: 6107 - protein, 9 aa, Artificial Sequence
  Synthetic Peptide
RAHYNIVTF

SEQ ID NO: 6108 - protein, 9 aa, Artificial Sequence
  Synthetic Peptide
VYDFAFRDL

SEQ ID NO: 6109 - protein, 9 aa, Artificial Sequence
  Synthetic Peptide
EYRHYAYSL

SEQ ID NO: 6110 - protein, 9 aa, Artificial Sequence
  Synthetic Peptide
LQTTIHDII

SEQ ID NO: 6111 - protein, 9 aa, Artificial Sequence
  Synthetic Peptide
PYAVADKAL

SEQ ID NO: 6112 - protein, 9 aa, Artificial Sequence
  Synthetic Peptide
MHQKRTAMF

SEQ ID NO: 6113 - protein, 9 aa, Artificial Sequence
  Synthetic Peptide
HYAYSLYGT

SEQ ID NO: 6114 - protein, 9 aa, Artificial Sequence
  Synthetic Peptide
LLRREVYDF

SEQ ID NO: 6115 - protein, 9 aa, Artificial Sequence
  Synthetic Peptide
VYAKQQLLR

SEQ ID NO: 6116 - protein, 10 aa, Artificial Sequence
  Synthetic Peptide
FYNPPTTAKF

SEQ ID NO: 6117 - protein, 9 aa, Artificial Sequence
  Synthetic Peptide
IYPNASLLF

SEQ ID NO: 6118 - protein, 9 aa, Artificial Sequence
  Synthetic Peptide
LYGPDAPTF

SEQ ID NO: 6119 - protein, 9 aa, Artificial Sequence
  Synthetic Peptide
LYWVNGQSF

SEQ ID NO: 6120 - protein, 9 aa, Artificial Sequence
  Synthetic Peptide
LYWVNNQSF

SEQ ID NO: 6121 - protein, 10 aa, Artificial Sequence
  Synthetic Peptide
QYSWLIDGNF

SEQ ID NO: 6122 - protein, 9 aa, Artificial Sequence
  Synthetic Peptide
QYSWRINGF

SEQ ID NO: 6123 - protein, 9 aa, Artificial Sequence
  Synthetic Peptide
RYCIPWQRF

SEQ ID NO: 6124 - protein, 10 aa, Artificial Sequence
  Synthetic Peptide
RYCIPWQRLF

SEQ ID NO: 6125 - protein, 10 aa, Artificial Sequence
  Synthetic Peptide
SYLSGANLNF

SEQ ID NO: 6126 - protein, 9 aa, Artificial Sequence
  Synthetic Peptide
TYACFVSNF

SEQ ID NO: 6127 - protein, 10 aa, Artificial Sequence
  Synthetic Peptide
TYQQSTQELF

SEQ ID NO: 6128 - protein, 9 aa, Artificial Sequence
  Synthetic Peptide
TYYRPGVNF

SEQ ID NO: 6129 - protein, 10 aa, Artificial Sequence
  Synthetic Peptide
VYAEPPKPFF

SEQ ID NO: 6130 - protein, 10 aa, Artificial Sequence
  Synthetic Peptide
VYPELPKPSF

SEQ ID NO: 6131 - protein, 10 aa, Artificial Sequence
  Synthetic Peptide
YYRPGVNLSF

SEQ ID NO: 6132 - protein, 9 aa, Artificial Sequence
  Synthetic Peptide
SYVPSAEQI

SEQ ID NO: 6133 - protein, 9 aa, Artificial Sequence
  Synthetic Peptide
TYQRTRALF

SEQ ID NO: 6134 - protein, 9 aa, Artificial Sequence
  Synthetic Peptide
TYQRTRALI

SEQ ID NO: 6135 - protein, 9 aa, Artificial Sequence
  Synthetic Peptide
TYQRTRALL

SEQ ID NO: 6136 - protein, 9 aa, Artificial Sequence
  Synthetic Peptide
AYPDSLPDF

SEQ ID NO: 6137 - protein, 9 aa, Artificial Sequence
  Synthetic Peptide
AYSLTLQGF

SEQ ID NO: 6138 - protein, 9 aa, Artificial Sequence
  Synthetic Peptide
CYGLGMEHF

SEQ ID NO: 6139 - protein, 9 aa, Artificial Sequence
  Synthetic Peptide
EYVNARHCF

SEQ ID NO: 6140 - protein, 10 aa, Artificial Sequence
  Synthetic Peptide
GYSYLEDVRF

SEQ ID NO: 6141 - protein, 9 aa, Artificial Sequence
  Synthetic Peptide
KYMALESIF

SEQ ID NO: 6142 - protein, 10 aa, Artificial Sequence
  Synthetic Peptide
LYISAWPDSF

SEQ ID NO: 6143 - protein, 9 aa, Artificial Sequence
  Synthetic Peptide
PYVSRLLGF

SEQ ID NO: 6144 - protein, 9 aa, Artificial Sequence
  Synthetic Peptide
RYARDPQRF

SEQ ID NO: 6145 - protein, 9 aa, Artificial Sequence
  Synthetic Peptide
RYGLLLALF

SEQ ID NO: 6146 - protein, 9 aa, Artificial Sequence
  Synthetic Peptide
RYRELVSEF

SEQ ID NO: 6147 - protein, 9 aa, Artificial Sequence
  Synthetic Peptide
RYTHQSDVF

SEQ ID NO: 6148 - protein, 9 aa, Artificial Sequence
  Synthetic Peptide
SYGVTVWEF

SEQ ID NO: 6149 - protein, 9 aa, Artificial Sequence
  Synthetic Peptide
TYLPTNASF

SEQ ID NO: 6150 - protein, 9 aa, Artificial Sequence
  Synthetic Peptide
VYMIMVKCF

SEQ ID NO: 6151 - protein, 9 aa, Artificial Sequence
  Synthetic Peptide
VYSYGVTVF

SEQ ID NO: 6152 - protein, 9 aa, Artificial Sequence
  Synthetic Peptide
NYKRCFPVI

SEQ ID NO: 6153 - protein, 9 aa, Artificial Sequence
  Synthetic Peptide
EYLQLVFGF

SEQ ID NO: 6154 - protein, 10 aa, Artificial Sequence
  Synthetic Peptide
EYLWGPRALF

SEQ ID NO: 6155 - protein, 9 aa, Artificial Sequence
  Synthetic Peptide
IYSKASEYF

SEQ ID NO: 6156 - protein, 9 aa, Artificial Sequence
  Synthetic Peptide
KYVELVHFF

SEQ ID NO: 6157 - protein, 10 aa, Artificial Sequence
  Synthetic Peptide
LYILVTCLGF

SEQ ID NO: 6158 - protein, 9 aa, Artificial Sequence
  Synthetic Peptide
MYPDLESEF

SEQ ID NO: 6159 - protein, 10 aa, Artificial Sequence
  Synthetic Peptide
SYSTTINYTF

SEQ ID NO: 6160 - protein, 10 aa, Artificial Sequence
  Synthetic Peptide
SYVKVLHHTF

SEQ ID NO: 6161 - protein, 9 aa, Artificial Sequence
  Synthetic Peptide
VYPKTGLLF

SEQ ID NO: 6162 - protein, 10 aa, Artificial Sequence
  Synthetic Peptide
VYPKTGLLIF

SEQ ID NO: 6163 - protein, 9 aa, Artificial Sequence
  Synthetic Peptide
IYPKAGLLF

SEQ ID NO: 6164 - protein, 10 aa, Artificial Sequence
  Synthetic Peptide
IYPKAGLLIF

SEQ ID NO: 6165 - protein, 9 aa, Artificial Sequence
  Synthetic Peptide
IYSKASSSF

SEQ ID NO: 6166 - protein, 10 aa, Artificial Sequence
  Synthetic Peptide
LYIFATCLGF

SEQ ID NO: 6167 - protein, 9 aa, Artificial Sequence
  Synthetic Peptide
NYQYFFPVF

SEQ ID NO: 6168 - protein, 10 aa, Artificial Sequence
  Synthetic Peptide
NYQYFFPVIF

SEQ ID NO: 6169 - protein, 10 aa, Artificial Sequence
  Synthetic Peptide
SYPPLHEWVF

SEQ ID NO: 6170 - protein, 9 aa, Artificial Sequence
  Synthetic Peptide
TYPDLESEF

SEQ ID NO: 6171 - protein, 9 aa, Artificial Sequence
  Synthetic Peptide
SYGFRLGFF

SEQ ID NO: 6172 - protein, 10 aa, Artificial Sequence
  Synthetic Peptide
TYQGSYGFRF

SEQ ID NO: 6173 - protein, 9 aa, Artificial Sequence
  Synthetic Peptide
TYSDLWKLF

SEQ ID NO: 6174 - protein, 9 aa, Artificial Sequence
  Synthetic Peptide
SYFPEITHI

SEQ ID NO: 6175 - protein, 9 aa, Artificial Sequence
  Synthetic Peptide
AWAKAAAAF

SEQ ID NO: 6176 - protein, 10 aa, Artificial Sequence
  Synthetic Peptide
AYAKAAAAAF

SEQ ID NO: 6177 - protein, 9 aa, Artificial Sequence
  Synthetic Peptide
AYAKAAAAW

SEQ ID NO: 6178 - protein, 9 aa, Artificial Sequence
  Synthetic Peptide
KYNPMKTHI

SEQ ID NO: 6179 - protein, 9 aa, Artificial Sequence
  Synthetic Peptide
KYPDFVDAL

SEQ ID NO: 6180 - protein, 9 aa, Artificial Sequence
  Synthetic Peptide
AYVHMVTHF

SEQ ID NO: 6181 - protein, 9 aa, Artificial Sequence
  Synthetic Peptide
KYPENFFLL

SEQ ID NO: 6182 - protein, 9 aa, Artificial Sequence
  Synthetic Peptide
YYEEQHPEL

SEQ ID NO: 6183 - protein, 9 aa, Artificial Sequence
  Synthetic Peptide
FPVRPQVPL

SEQ ID NO: 6184 - protein, 9 aa, Artificial Sequence
  Synthetic Peptide
IPIPSSWAF

SEQ ID NO: 6185 - protein, 9 aa, Artificial Sequence
  Synthetic Peptide
LPGCSFSIF

SEQ ID NO: 6186 - protein, 9 aa, Artificial Sequence
  Synthetic Peptide
VPISHLYIL

SEQ ID NO: 6187 - protein, 9 aa, Artificial Sequence
  Synthetic Peptide
FPHCLAFSY

SEQ ID NO: 6188 - protein, 9 aa, Artificial Sequence
  Synthetic Peptide
MPKAGLLII

SEQ ID NO: 6189 - protein, 9 aa, Artificial Sequence
  Synthetic Peptide
LPTTMNYPL

SEQ ID NO: 6190 - protein, 9 aa, Artificial Sequence
  Synthetic Peptide
FPYLVAYQA

SEQ ID NO: 6191 - protein, 9 aa, Artificial Sequence
  Synthetic Peptide
LPVCAFSSA

SEQ ID NO: 6192 - protein, 8 aa, Artificial Sequence
  Synthetic Peptide
FPRIWLHL

SEQ ID NO: 6193 - protein, 9 aa, Artificial Sequence
  Synthetic Peptide
APLLLARAA

SEQ ID NO: 6194 - protein, 9 aa, Artificial Sequence
  Synthetic Peptide
HPQWVLTAA

SEQ ID NO: 6195 - protein, 9 aa, Artificial Sequence
  Synthetic Peptide
YPCTVNFTI

SEQ ID NO: 6196 - protein, 9 aa, Artificial Sequence
  Synthetic Peptide
FPISPIETV

SEQ ID NO: 6197 - protein, 10 aa, Artificial Sequence
  Synthetic Peptide
FPHCLAFSYM

SEQ ID NO: 6198 - protein, 10 aa, Artificial Sequence
  Synthetic Peptide
YPLASLRSLF

SEQ ID NO: 6199 - protein, 10 aa, Artificial Sequence
  Synthetic Peptide
TPYAGEPAPF

SEQ ID NO: 6200 - protein, 10 aa, Artificial Sequence
  Synthetic Peptide
TPARVTGGVF

SEQ ID NO: 6201 - protein, 10 aa, Artificial Sequence
  Synthetic Peptide
YPCTVNFTIF

SEQ ID NO: 6202 - protein, 10 aa, Artificial Sequence
  Synthetic Peptide
IPQAVVDMVA

SEQ ID NO: 6203 - protein, 10 aa, Artificial Sequence
  Synthetic Peptide
LPCSFTTLPA

SEQ ID NO: 6204 - protein, 10 aa, Artificial Sequence
  Synthetic Peptide
LPQGWKGSPA

SEQ ID NO: 6205 - protein, 11 aa, Artificial Sequence
  Synthetic Peptide
QPRAPIRPIPT

SEQ ID NO: 6206 - protein, 9 aa, Artificial Sequence
  Synthetic Peptide
RPPIFIRRL

SEQ ID NO: 6207 - protein, 9 aa, Artificial Sequence
  Synthetic Peptide
APIMFSNKM

SEQ ID NO: 6208 - protein, 9 aa, Artificial Sequence
  Synthetic Peptide
APSPYNSRF

SEQ ID NO: 6209 - protein, 10 aa, Artificial Sequence
  Synthetic Peptide
CPVGEAPSPY

SEQ ID NO: 6210 - protein, 9 aa, Artificial Sequence
  Synthetic Peptide
DPDEGTAGV

SEQ ID NO: 6211 - protein, 10 aa, Artificial Sequence
  Synthetic Peptide
DPGNAEFEDL

SEQ ID NO: 6212 - protein, 10 aa, Artificial Sequence
  Synthetic Peptide
DPLAIAANII

SEQ ID NO: 6213 - protein, 10 aa, Artificial Sequence
  Synthetic Peptide
DPNTVSSFQV

SEQ ID NO: 6214 - protein, 9 aa, Artificial Sequence
  Synthetic Peptide
DPSHEGEGI

SEQ ID NO: 6215 - protein, 10 aa, Artificial Sequence
  Synthetic Peptide
EPFQSLVPKA

SEQ ID NO: 6216 - protein, 10 aa, Artificial Sequence
  Synthetic Peptide
EPNGYIEGKL

SEQ ID NO: 6217 - protein, 9 aa, Artificial Sequence
  Synthetic Peptide
FPNEVGARI

SEQ ID NO: 6218 - protein, 10 aa, Artificial Sequence
  Synthetic Peptide
FPNEVGARIL

SEQ ID NO: 6219 - protein, 9 aa, Artificial Sequence
  Synthetic Peptide
FPYTGDPPY

SEQ ID NO: 6220 - protein, 9 aa, Artificial Sequence
  Synthetic Peptide
GPATAQMAL

SEQ ID NO: 6221 - protein, 9 aa, Artificial Sequence
  Synthetic Peptide
IPAEMLASI

SEQ ID NO: 6222 - protein, 10 aa, Artificial Sequence
  Synthetic Peptide
IPEVCLKWEL

SEQ ID NO: 6223 - protein, 10 aa, Artificial Sequence
  Synthetic Peptide
IPKQKVAGPL

SEQ ID NO: 6224 - protein, 9 aa, Artificial Sequence
  Synthetic Peptide
IPSIQSRGL

SEQ ID NO: 6225 - protein, 10 aa, Artificial Sequence
  Synthetic Peptide
KPGDTIIFEA

SEQ ID NO: 6226 - protein, 9 aa, Artificial Sequence
  Synthetic Peptide
LPFDRTTVM

SEQ ID NO: 6227 - protein, 9 aa, Artificial Sequence
  Synthetic Peptide
LPSFGVSGI

SEQ ID NO: 6228 - protein, 9 aa, Artificial Sequence
  Synthetic Peptide
LPSLPGHTA

SEQ ID NO: 6229 - protein, 10 aa, Artificial Sequence
  Synthetic Peptide
MPAHGPAKNM

SEQ ID NO: 6230 - protein, 9 aa, Artificial Sequence
  Synthetic Peptide
NPAHKSQLV

SEQ ID NO: 6231 - protein, 10 aa, Artificial Sequence
  Synthetic Peptide
NPECDPLLPV

SEQ ID NO: 6232 - protein, 9 aa, Artificial Sequence
  Synthetic Peptide
NPRMFLAMI

SEQ ID NO: 6233 - protein, 9 aa, Artificial Sequence
  Synthetic Peptide
QPEWFRNVL

SEQ ID NO: 6234 - protein, 9 aa, Artificial Sequence
  Synthetic Peptide
RPCFWVELI

SEQ ID NO: 6235 - protein, 9 aa, Artificial Sequence
  Synthetic Peptide
RPLLIEGTA

SEQ ID NO: 6236 - protein, 9 aa, Artificial Sequence
  Synthetic Peptide
SPIVPSFDM

SEQ ID NO: 6237 - protein, 10 aa, Artificial Sequence
  Synthetic Peptide
SPKGVEESSI

SEQ ID NO: 6238 - protein, 9 aa, Artificial Sequence
  Synthetic Peptide
SPQLEGFSA

SEQ ID NO: 6239 - protein, 10 aa, Artificial Sequence
  Synthetic Peptide
TPLGAINSSL

SEQ ID NO: 6240 - protein, 10 aa, Artificial Sequence
  Synthetic Peptide
VPASRYLTDM

SEQ ID NO: 6241 - protein, 10 aa, Artificial Sequence
  Synthetic Peptide
YPDTGKVMCV

SEQ ID NO: 6242 - protein, 9 aa, Artificial Sequence
  Synthetic Peptide
YPITADKRI

SEQ ID NO: 6243 - protein, 9 aa, Artificial Sequence
  Synthetic Peptide
YPKIYKTYF

SEQ ID NO: 6244 - protein, 9 aa, Artificial Sequence
  Synthetic Peptide
YPKLKNSYV

SEQ ID NO: 6245 - protein, 10 aa, Artificial Sequence
  Synthetic Peptide
IPIPSSWAFI

SEQ ID NO: 6246 - protein, 9 aa, Artificial Sequence
  Synthetic Peptide
LPSDFFPSI

SEQ ID NO: 6247 - protein, 8 aa, Artificial Sequence
  Synthetic Peptide
APTLWARI

SEQ ID NO: 6248 - protein, 9 aa, Artificial Sequence
  Synthetic Peptide
FPYLVAYQI

SEQ ID NO: 6249 - protein, 8 aa, Artificial Sequence
  Synthetic Peptide
IPLVGAPI

SEQ ID NO: 6250 - protein, 10 aa, Artificial Sequence
  Synthetic Peptide
IPQAVVDMVI

SEQ ID NO: 6251 - protein, 10 aa, Artificial Sequence
  Synthetic Peptide
LPAILSPGAI

SEQ ID NO: 6252 - protein, 10 aa, Artificial Sequence
  Synthetic Peptide
LPGCSFSIFI

SEQ ID NO: 6253 - protein, 8 aa, Artificial Sequence
  Synthetic Peptide
LPRRGPRI

SEQ ID NO: 6254 - protein, 10 aa, Artificial Sequence
  Synthetic Peptide
YPCTVNFTII

SEQ ID NO: 6255 - protein, 8 aa, Artificial Sequence
  Synthetic Peptide
FPGGLREI

SEQ ID NO: 6256 - protein, 8 aa, Artificial Sequence
  Synthetic Peptide
FPGGLREL

SEQ ID NO: 6257 - protein, 10 aa, Artificial Sequence
  Synthetic Peptide
FPGGLRELQL

SEQ ID NO: 6258 - protein, 8 aa, Artificial Sequence
  Synthetic Peptide
FPKANKEI

SEQ ID NO: 6259 - protein, 11 aa, Artificial Sequence
  Synthetic Peptide
LPAARPAGATI

SEQ ID NO: 6260 - protein, 8 aa, Artificial Sequence
  Synthetic Peptide
LPSETDGI

SEQ ID NO: 6261 - protein, 10 aa, Artificial Sequence
  Synthetic Peptide
SPGGLRELQI

SEQ ID NO: 6262 - protein, 11 aa, Artificial Sequence
  Synthetic Peptide
SPLDSTFYRSI

SEQ ID NO: 6263 - protein, 9 aa, Artificial Sequence
  Synthetic Peptide
FAVRPQVPL

SEQ ID NO: 6264 - protein, 9 aa, Artificial Sequence
  Synthetic Peptide
FLVRPQVPL

SEQ ID NO: 6265 - protein, 9 aa, Artificial Sequence
  Synthetic Peptide
FPVRPQVPC

SEQ ID NO: 6266 - protein, 9 aa, Artificial Sequence
  Synthetic Peptide
FPVRPQVPG

SEQ ID NO: 6267 - protein, 9 aa, Artificial Sequence
  Synthetic Peptide
FPVRPQVPK

SEQ ID NO: 6268 - protein, 9 aa, Artificial Sequence
  Synthetic Peptide
FPVRPQVPN

SEQ ID NO: 6269 - protein, 9 aa, Artificial Sequence
  Synthetic Peptide
FPVRPQVPQ

SEQ ID NO: 6270 - protein, 9 aa, Artificial Sequence
  Synthetic Peptide
FPVRPQVPT

SEQ ID NO: 6271 - protein, 9 aa, Artificial Sequence
  Synthetic Peptide
FPVRPQVPY

SEQ ID NO: 6272 - protein, 9 aa, Artificial Sequence
  Synthetic Peptide
  VARIANT 2: Xaa = Any Amino Acid
FXVRPQVPL

SEQ ID NO: 6273 - protein, 9 aa, Artificial Sequence
  Synthetic Peptide
IPIHYCAPI

SEQ ID NO: 6274 - protein, 10 aa, Artificial Sequence
  Synthetic Peptide
IPYNPQSQGI

SEQ ID NO: 6275 - protein, 9 aa, Artificial Sequence
  Synthetic Peptide
LPPLERLTI

SEQ ID NO: 6276 - protein, 8 aa, Artificial Sequence
  Synthetic Peptide
SPIETVPI

SEQ ID NO: 6277 - protein, 9 aa, Artificial Sequence
  Synthetic Peptide
TPPLVKLWI

SEQ ID NO: 6278 - protein, 9 aa, Artificial Sequence
  Synthetic Peptide
YPLASLRSI

SEQ ID NO: 6279 - protein, 9 aa, Artificial Sequence
  Synthetic Peptide
IPYCNYSKY

SEQ ID NO: 6280 - protein, 10 aa, Artificial Sequence
  Synthetic Peptide
IPYCNYSKYW

SEQ ID NO: 6281 - protein, 9 aa, Artificial Sequence
  Synthetic Peptide
EPHISYPPI

SEQ ID NO: 6282 - protein, 11 aa, Artificial Sequence
  Synthetic Peptide
GPRALIETSYI

SEQ ID NO: 6283 - protein, 11 aa, Artificial Sequence
  Synthetic Peptide
HPRKLLMQDLI

SEQ ID NO: 6284 - protein, 9 aa, Artificial Sequence
  Synthetic Peptide
VPFSHLYIL

SEQ ID NO: 6285 - protein, 9 aa, Artificial Sequence
  Synthetic Peptide
VPISHLYIA

SEQ ID NO: 6286 - protein, 11 aa, Artificial Sequence
  Synthetic Peptide
GPRALVETSYI

SEQ ID NO: 6287 - protein, 9 aa, Artificial Sequence
  Synthetic Peptide
YPPLHEWVI

SEQ ID NO: 6288 - protein, 11 aa, Artificial Sequence
  Synthetic Peptide
APRMPEAAPPI

SEQ ID NO: 6289 - protein, 8 aa, Artificial Sequence
  Synthetic Peptide
FPALNKMF

SEQ ID NO: 6290 - protein, 11 aa, Artificial Sequence
  Synthetic Peptide
FPALNKMFCQL

SEQ ID NO: 6291 - protein, 9 aa, Artificial Sequence
  Synthetic Peptide
FPGTRVRAI

SEQ ID NO: 6292 - protein, 10 aa, Artificial Sequence
  Synthetic Peptide
FPPGSTKRAL

SEQ ID NO: 6293 - protein, 9 aa, Artificial Sequence
  Synthetic Peptide
FPQPKKKPI

SEQ ID NO: 6294 - protein, 9 aa, Artificial Sequence
  Synthetic Peptide
FPQPKKKPL

SEQ ID NO: 6295 - protein, 9 aa, Artificial Sequence
  Synthetic Peptide
PPGSTKRAI

SEQ ID NO: 6296 - protein, 11 aa, Artificial Sequence
  Synthetic Peptide
VPSQKTYQGSI

SEQ ID NO: 6297 - protein, 9 aa, Artificial Sequence
  Synthetic Peptide
IPSLALMLI

SEQ ID NO: 6298 - protein, 8 aa, Artificial Sequence
  Synthetic Peptide
LPYGRTNI

SEQ ID NO: 6299 - protein, 8 aa, Artificial Sequence
  Synthetic Peptide
TPFAGEPI

SEQ ID NO: 6300 - protein, 10 aa, Artificial Sequence
  Synthetic Peptide
TPYAGEPAPI

SEQ ID NO: 6301 - protein, 9 aa, Artificial Sequence
  Synthetic Peptide
APRTLVLYL

SEQ ID NO: 6302 - protein, 9 aa, Artificial Sequence
  Synthetic Peptide
APRTYVLLL

SEQ ID NO: 6303 - protein, 9 aa, Artificial Sequence
  Synthetic Peptide
YAFNMKATV

SEQ ID NO: 6304 - protein, 9 aa, Artificial Sequence
  Synthetic Peptide
YTNPQFNVY

SEQ ID NO: 6305 - protein, 9 aa, Artificial Sequence
  Synthetic Peptide
APAKAAAAV

SEQ ID NO: 6306 - protein, 9 aa, Artificial Sequence
  Synthetic Peptide
AVAKAAAAL

SEQ ID NO: 6307 - protein, 9 aa, Artificial Sequence
  Synthetic Peptide
FATPNFYTL

SEQ ID NO: 6308 - protein, 9 aa, Artificial Sequence
  Synthetic Peptide
FPFKYAAAY

SEQ ID NO: 6309 - protein, 9 aa, Artificial Sequence
  Synthetic Peptide
FPVTFFFAF

SEQ ID NO: 6310 - protein, 9 aa, Artificial Sequence
  Synthetic Peptide
FPVTMFFAA

SEQ ID NO: 6311 - protein, 9 aa, Artificial Sequence
  Synthetic Peptide
FPVTMFFAF

SEQ ID NO: 6312 - protein, 9 aa, Artificial Sequence
  Synthetic Peptide
FPVTMFFAI

SEQ ID NO: 6313 - protein, 9 aa, Artificial Sequence
  Synthetic Peptide
FPVTMFFAV

SEQ ID NO: 6314 - protein, 9 aa, Artificial Sequence
  Synthetic Peptide
FPVTMFFAW

SEQ ID NO: 6315 - protein, 9 aa, Artificial Sequence
  Synthetic Peptide
FPVTMFFAY

SEQ ID NO: 6316 - protein, 9 aa, Artificial Sequence
  Synthetic Peptide
LPFDYTPGF

SEQ ID NO: 6317 - protein, 9 aa, Artificial Sequence
  Synthetic Peptide
LPGPYFLQF

SEQ ID NO: 6318 - protein, 9 aa, Artificial Sequence
  Synthetic Peptide
GPRLGVRAT

SEQ ID NO: 6319 - protein, 8 aa, Artificial Sequence
  Synthetic Peptide
IPLVGAPL

SEQ ID NO: 6320 - protein, 9 aa, Artificial Sequence
  Synthetic Peptide
LPALSTGLI

SEQ ID NO: 6321 - protein, 10 aa, Artificial Sequence
  Synthetic Peptide
LPCSFTTLPA

SEQ ID NO: 6322 - protein, 9 aa, Artificial Sequence
  Synthetic Peptide
CPEEKQRHL

SEQ ID NO: 6323 - protein, 9 aa, Artificial Sequence
  Synthetic Peptide
CPEEKQRHL

SEQ ID NO: 6324 - protein, 9 aa, Artificial Sequence
  Synthetic Peptide
DPQERPRKL

SEQ ID NO: 6325 - protein, 9 aa, Artificial Sequence
  Synthetic Peptide
DPTRRPYKL

SEQ ID NO: 6326 - protein, 10 aa, Artificial Sequence
  Synthetic Peptide
EPQRHTMLCM

SEQ ID NO: 6327 - protein, 10 aa, Artificial Sequence
  Synthetic Peptide
FPYAVCRVCL

SEQ ID NO: 6328 - protein, 10 aa, Artificial Sequence
  Synthetic Peptide
GPRETLQEIV

SEQ ID NO: 6329 - protein, 10 aa, Artificial Sequence
  Synthetic Peptide
HPEPTDLFCY

SEQ ID NO: 6330 - protein, 10 aa, Artificial Sequence
  Synthetic Peptide
IPHAACHKCI

SEQ ID NO: 6331 - protein, 9 aa, Artificial Sequence
  Synthetic Peptide
KPLNPAEKL

SEQ ID NO: 6332 - protein, 9 aa, Artificial Sequence
  Synthetic Peptide
NPQERPRSL

SEQ ID NO: 6333 - protein, 9 aa, Artificial Sequence
  Synthetic Peptide
NPTLREYIL

SEQ ID NO: 6334 - protein, 10 aa, Artificial Sequence
  Synthetic Peptide
NPYAVCDKCL

SEQ ID NO: 6335 - protein, 10 aa, Artificial Sequence
  Synthetic Peptide
NPYGVCIMCL

SEQ ID NO: 6336 - protein, 9 aa, Artificial Sequence
  Synthetic Peptide
RPDGQAQPA

SEQ ID NO: 6337 - protein, 10 aa, Artificial Sequence
  Synthetic Peptide
RPRKLPQLCT

SEQ ID NO: 6338 - protein, 9 aa, Artificial Sequence
  Synthetic Peptide
RPRRRQTQV

SEQ ID NO: 6339 - protein, 10 aa, Artificial Sequence
  Synthetic Peptide
TPHGVCTKCL

SEQ ID NO: 6340 - protein, 9 aa, Artificial Sequence
  Synthetic Peptide
TPTLQDYVL

SEQ ID NO: 6341 - protein, 10 aa, Artificial Sequence
  Synthetic Peptide
VPCCECKFVV

SEQ ID NO: 6342 - protein, 10 aa, Artificial Sequence
  Synthetic Peptide
YPEPTDLYCY

SEQ ID NO: 6343 - protein, 9 aa, Artificial Sequence
  Synthetic Peptide
LGFVFTLTV

SEQ ID NO: 6344 - protein, 9 aa, Artificial Sequence
  Synthetic Peptide
LPFDFTPGF

SEQ ID NO: 6345 - protein, 9 aa, Artificial Sequence
  Synthetic Peptide
TAVPWNASW

SEQ ID NO: 6346 - protein, 9 aa, Artificial Sequence
  Synthetic Peptide
HLDMLRHLY

SEQ ID NO: 6347 - protein, 9 aa, Artificial Sequence
  Synthetic Peptide
LLDIDETEY

SEQ ID NO: 6348 - protein, 9 aa, Artificial Sequence
  Synthetic Peptide
GTQLFEDNY

SEQ ID NO: 6349 - protein, 9 aa, Artificial Sequence
  Synthetic Peptide
LTCSPQPEY

SEQ ID NO: 6350 - protein, 9 aa, Artificial Sequence
  Synthetic Peptide
ETLEEITGY

SEQ ID NO: 6351 - protein, 10 aa, Artificial Sequence
  Synthetic Peptide
FTHQSDVWSY

SEQ ID NO: 6352 - protein, 10 aa, Artificial Sequence
  Synthetic Peptide
RLLDIDETEY

SEQ ID NO: 6353 - protein, 10 aa, Artificial Sequence
  Synthetic Peptide
TLEEITGYLY

SEQ ID NO: 6354 - protein, 10 aa, Artificial Sequence
  Synthetic Peptide
YVMAGVGSPY

SEQ ID NO: 6355 - protein, 10 aa, Artificial Sequence
  Synthetic Peptide
GTPTAENPEY

SEQ ID NO: 6356 - protein, 10 aa, Artificial Sequence
  Synthetic Peptide
LIQRNPQLCY

SEQ ID NO: 6357 - protein, 10 aa, Artificial Sequence
  Synthetic Peptide
VVQGNLELTY

SEQ ID NO: 6358 - protein, 10 aa, Artificial Sequence
  Synthetic Peptide
MGDLVDAEEY

SEQ ID NO: 6359 - protein, 9 aa, Artificial Sequence
  Synthetic Peptide
KIRKYTMRR

SEQ ID NO: 6360 - protein, 9 aa, Artificial Sequence
  Synthetic Peptide
VVFGILIKR

SEQ ID NO: 6361 - protein, 9 aa, Artificial Sequence
  Synthetic Peptide
LVKSPNHVK

SEQ ID NO: 6362 - protein, 9 aa, Artificial Sequence
  Synthetic Peptide
VLRENTSPK

SEQ ID NO: 6363 - protein, 9 aa, Artificial Sequence
  Synthetic Peptide
ILIKRRQQK

SEQ ID NO: 6364 - protein, 9 aa, Artificial Sequence
  Synthetic Peptide
ILWKDIFHK

SEQ ID NO: 6365 - protein, 9 aa, Artificial Sequence
  Synthetic Peptide
KITDFGLAR

SEQ ID NO: 6366 - protein, 9 aa, Artificial Sequence
  Synthetic Peptide
GVVFGILIK

SEQ ID NO: 6367 - protein, 9 aa, Artificial Sequence
  Synthetic Peptide
QVCTGTDMK

SEQ ID NO: 6368 - protein, 9 aa, Artificial Sequence
  Synthetic Peptide
LLDHVRENR

SEQ ID NO: 6369 - protein, 9 aa, Artificial Sequence
  Synthetic Peptide
CVNCSQFLR

SEQ ID NO: 6370 - protein, 9 aa, Artificial Sequence
  Synthetic Peptide
TVCAGGCAR

SEQ ID NO: 6371 - protein, 9 aa, Artificial Sequence
  Synthetic Peptide
ILKETELRK

SEQ ID NO: 6372 - protein, 9 aa, Artificial Sequence
  Synthetic Peptide
VTAEDGTQR

SEQ ID NO: 6373 - protein, 9 aa, Artificial Sequence
  Synthetic Peptide
DLSYMPIWK

SEQ ID NO: 6374 - protein, 10 aa, Artificial Sequence
  Synthetic Peptide
TILWKDIFHK

SEQ ID NO: 6375 - protein, 10 aa, Artificial Sequence
  Synthetic Peptide
GTQRCEKCSK

SEQ ID NO: 6376 - protein, 10 aa, Artificial Sequence
  Synthetic Peptide
KVLRENTSPK

SEQ ID NO: 6377 - protein, 10 aa, Artificial Sequence
  Synthetic Peptide
QLRSLTETLK

SEQ ID NO: 6378 - protein, 10 aa, Artificial Sequence
  Synthetic Peptide
RLVHRDLAAR

SEQ ID NO: 6379 - protein, 10 aa, Artificial Sequence
  Synthetic Peptide
LLNWCMQIAK

SEQ ID NO: 6380 - protein, 10 aa, Artificial Sequence
  Synthetic Peptide
TIDVYMIMVK

SEQ ID NO: 6381 - protein, 10 aa, Artificial Sequence
  Synthetic Peptide
RILKETELRK

SEQ ID NO: 6382 - protein, 10 aa, Artificial Sequence
  Synthetic Peptide
VLVKSPNHVK

SEQ ID NO: 6383 - protein, 10 aa, Artificial Sequence
  Synthetic Peptide
SVPQNLQVIR

SEQ ID NO: 6384 - protein, 10 aa, Artificial Sequence
  Synthetic Peptide
HTVPWDQLFR

SEQ ID NO: 6385 - protein, 10 aa, Artificial Sequence
  Synthetic Peptide
ILKGGVLIQR

SEQ ID NO: 6386 - protein, 10 aa, Artificial Sequence
  Synthetic Peptide
LVSEPSRMAR

SEQ ID NO: 6387 - protein, 10 aa, Artificial Sequence
  Synthetic Peptide
GVVFGILIKR

SEQ ID NO: 6388 - protein, 10 aa, Artificial Sequence
  Synthetic Peptide
CVARCPSGVK

SEQ ID NO: 6389 - protein, 10 aa, Artificial Sequence
  Synthetic Peptide
VVPGILIKRR

SEQ ID NO: 6390 - protein, 10 aa, Artificial Sequence
  Synthetic Peptide
GILIKRRQQK

SEQ ID NO: 6391 - protein, 10 aa, Artificial Sequence
  Synthetic Peptide
RTVCAGGCAR

SEQ ID NO: 6392 - protein, 10 aa, Artificial Sequence
  Synthetic Peptide
GLACHQLCAR

SEQ ID NO: 6393 - protein, 10 aa, Artificial Sequence
  Synthetic Peptide
KIPVAIKVLR

SEQ ID NO: 6394 - protein, 9 aa, Artificial Sequence
  Synthetic Peptide
VGEADYFEY

SEQ ID NO: 6395 - protein, 9 aa, Artificial Sequence
  Synthetic Peptide
PLRESIVCY

SEQ ID NO: 6396 - protein, 10 aa, Artificial Sequence
  Synthetic Peptide
PVGEADYFEY

SEQ ID NO: 6397 - protein, 10 aa, Artificial Sequence
  Synthetic Peptide
GTWVAGVFVY

SEQ ID NO: 6398 - protein, 9 aa, Artificial Sequence
  Synthetic Peptide
GVFVYGGSK

SEQ ID NO: 6399 - protein, 9 aa, Artificial Sequence
  Synthetic Peptide
KTSLYNLRR

SEQ ID NO: 6400 - protein, 9 aa, Artificial Sequence
  Synthetic Peptide
AIKDLVMTK

SEQ ID NO: 6401 - protein, 10 aa, Artificial Sequence
  Synthetic Peptide
QTHIFAEVLK

SEQ ID NO: 6402 - protein, 10 aa, Artificial Sequence
  Synthetic Peptide
GTALAIPQCR

SEQ ID NO: 6403 - protein, 9 aa, Artificial Sequence
  Synthetic Peptide
CTELKLSDY

SEQ ID NO: 6404 - protein, 9 aa, Artificial Sequence
  Synthetic Peptide
STLELRSRY

SEQ ID NO: 6405 - protein, 9 aa, Artificial Sequence
  Synthetic Peptide
ILRGSVAHK

SEQ ID NO: 6406 - protein, 9 aa, Artificial Sequence
  Synthetic Peptide
RMCNILKGK

SEQ ID NO: 6407 - protein, 9 aa, Artificial Sequence
  Synthetic Peptide
LMQGSTLPR

SEQ ID NO: 6408 - protein, 9 aa, Artificial Sequence
  Synthetic Peptide
MIDGIGRFY

SEQ ID NO: 6409 - protein, 9 aa, Artificial Sequence
  Synthetic Peptide
MVLSAFDER

SEQ ID NO: 6410 - protein, 9 aa, Artificial Sequence
  Synthetic Peptide
YIQMCTELK

SEQ ID NO: 6411 - protein, 10 aa, Artificial Sequence
  Synthetic Peptide
SLMQGSTLPR

SEQ ID NO: 6412 - protein, 10 aa, Artificial Sequence
  Synthetic Peptide
KMIDGIGRFY

SEQ ID NO: 6413 - protein, 10 aa, Artificial Sequence
  Synthetic Peptide
LILRGSVAHK

SEQ ID NO: 6414 - protein, 10 aa, Artificial Sequence
  Synthetic Peptide
RSGAAGAAVK

SEQ ID NO: 6415 - protein, 10 aa, Artificial Sequence
  Synthetic Peptide
SSTLELRSRY

SEQ ID NO: 6416 - protein, 10 aa, Artificial Sequence
  Synthetic Peptide
RSRYWAIRTR

SEQ ID NO: 6417 - protein, 10 aa, Artificial Sequence
  Synthetic Peptide
RMVLSAFDER

SEQ ID NO: 6418 - protein, 9 aa, Artificial Sequence
  Synthetic Peptide
FYIQMCTEL

SEQ ID NO: 6419 - protein, 9 aa, Artificial Sequence
  Synthetic Peptide
AYERMCNIL

SEQ ID NO: 6420 - protein, 9 aa, Artificial Sequence
  Synthetic Peptide
RFYQMCTEL

SEQ ID NO: 6421 - protein, 9 aa, Artificial Sequence
  Synthetic Peptide
LLDTASALY

SEQ ID NO: 6422 - protein, 9 aa, Artificial Sequence
  Synthetic Peptide
SLDVSAAFY

SEQ ID NO: 6423 - protein, 9 aa, Artificial Sequence
  Synthetic Peptide
PTTGRTSLY

SEQ ID NO: 6424 - protein, 9 aa, Artificial Sequence
  Synthetic Peptide
MSTTDLEAY

SEQ ID NO: 6425 - protein, 9 aa, Artificial Sequence
  Synthetic Peptide
PTTGRTSLY

SEQ ID NO: 6426 - protein, 9 aa, Artificial Sequence
  Synthetic Peptide
LTKQYLNLY

SEQ ID NO: 6427 - protein, 9 aa, Artificial Sequence
  Synthetic Peptide
LTKQYLNLY

SEQ ID NO: 6428 - protein, 9 aa, Artificial Sequence
  Synthetic Peptide
KVGNFTGLY

SEQ ID NO: 6429 - protein, 9 aa, Artificial Sequence
  Synthetic Peptide
MSPTDLEAY

SEQ ID NO: 6430 - protein, 9 aa, Artificial Sequence
  Synthetic Peptide
FSQFSRGNY

SEQ ID NO: 6431 - protein, 9 aa, Artificial Sequence
  Synthetic Peptide
PSSWAFAKY

SEQ ID NO: 6432 - protein, 9 aa, Artificial Sequence
  Synthetic Peptide
QSAVRKEAY

SEQ ID NO: 6433 - protein, 9 aa, Artificial Sequence
  Synthetic Peptide
PLDKGIKPY

SEQ ID NO: 6434 - protein, 9 aa, Artificial Sequence
  Synthetic Peptide
SLMLLYKTY

SEQ ID NO: 6435 - protein, 9 aa, Artificial Sequence
  Synthetic Peptide
ASRDLVVSY

SEQ ID NO: 6436 - protein, 9 aa, Artificial Sequence
  Synthetic Peptide
PSRGRLGLY

SEQ ID NO: 6437 - protein, 9 aa, Artificial Sequence
  Synthetic Peptide
SSTSRNINY

SEQ ID NO: 6438 - protein, 10 aa, Artificial Sequence
  Synthetic Peptide
DLLDTASALY

SEQ ID NO: 6439 - protein, 10 aa, Artificial Sequence
  Synthetic Peptide
LLDPRVRGLY

SEQ ID NO: 6440 - protein, 10 aa, Artificial Sequence
  Synthetic Peptide
LSLDVSAAFY

SEQ ID NO: 6441 - protein, 10 aa, Artificial Sequence
  Synthetic Peptide
FLCQQYLHLY

SEQ ID NO: 6442 - protein, 10 aa, Artificial Sequence
  Synthetic Peptide
QTFGRKLHLY

SEQ ID NO: 6443 - protein, 10 aa, Artificial Sequence
  Synthetic Peptide
KTYGRKLHLY

SEQ ID NO: 6444 - protein, 10 aa, Artificial Sequence
  Synthetic Peptide
KTYGRKLHLY

SEQ ID NO: 6445 - protein, 10 aa, Artificial Sequence
  Synthetic Peptide
QTFGRKLHLY

SEQ ID NO: 6446 - protein, 10 aa, Artificial Sequence
  Synthetic Peptide
KTFGRKLHLY

SEQ ID NO: 6447 - protein, 10 aa, Artificial Sequence
  Synthetic Peptide
KTFGRKLHLY

SEQ ID NO: 6448 - protein, 10 aa, Artificial Sequence
  Synthetic Peptide
LQDPRVRALY

SEQ ID NO: 6449 - protein, 10 aa, Artificial Sequence
  Synthetic Peptide
TTPAQGTSMY

SEQ ID NO: 6450 - protein, 10 aa, Artificial Sequence
  Synthetic Peptide
LSSTSRNINY

SEQ ID NO: 6451 - protein, 10 aa, Artificial Sequence
  Synthetic Peptide
PLDKGIKPYY

SEQ ID NO: 6452 - protein, 10 aa, Artificial Sequence
  Synthetic Peptide
HSASFCGSPY

SEQ ID NO: 6453 - protein, 10 aa, Artificial Sequence
  Synthetic Peptide
FLTKQYLNLY

SEQ ID NO: 6454 - protein, 10 aa, Artificial Sequence
  Synthetic Peptide
RSASFCGSPY

SEQ ID NO: 6455 - protein, 10 aa, Artificial Sequence
  Synthetic Peptide
WLWGMDIDPY

SEQ ID NO: 6456 - protein, 10 aa, Artificial Sequence
  Synthetic Peptide
TTPAQGTSMY

SEQ ID NO: 6457 - protein, 10 aa, Artificial Sequence
  Synthetic Peptide
HTLWKAGILY

SEQ ID NO: 6458 - protein, 10 aa, Artificial Sequence
  Synthetic Peptide
TSCPPICPGY

SEQ ID NO: 6459 - protein, 10 aa, Artificial Sequence
  Synthetic Peptide
KSVQHLESLY

SEQ ID NO: 6460 - protein, 10 aa, Artificial Sequence
  Synthetic Peptide
NLYVSLLLLY

SEQ ID NO: 6461 - protein, 10 aa, Artificial Sequence
  Synthetic Peptide
VMMWYWGPSL

SEQ ID NO: 6462 - protein, 9 aa, Artificial Sequence
  Synthetic Peptide
LLYQTFGRK

SEQ ID NO: 6463 - protein, 9 aa, Artificial Sequence
  Synthetic Peptide
IMPARFYPK

SEQ ID NO: 6464 - protein, 9 aa, Artificial Sequence
  Synthetic Peptide
CLHQSPVRK

SEQ ID NO: 6465 - protein, 9 aa, Artificial Sequence
  Synthetic Peptide
SAICSVVRR

SEQ ID NO: 6466 - protein, 9 aa, Artificial Sequence
  Synthetic Peptide
HLHQDIIKK

SEQ ID NO: 6467 - protein, 10 aa, Artificial Sequence
  Synthetic Peptide
SLPQEHIIQK

SEQ ID NO: 6468 - protein, 10 aa, Artificial Sequence
  Synthetic Peptide
SMFPSCCCTK

SEQ ID NO: 6469 - protein, 10 aa, Artificial Sequence
  Synthetic Peptide
SMYPSCCCTK

SEQ ID NO: 6470 - protein, 10 aa, Artificial Sequence
  Synthetic Peptide
QAFTFSPTYK

SEQ ID NO: 6471 - protein, 10 aa, Artificial Sequence
  Synthetic Peptide
LLLYQTFGRK

SEQ ID NO: 6472 - protein, 10 aa, Artificial Sequence
  Synthetic Peptide
YMDDVVLGAK

SEQ ID NO: 6473 - protein, 10 aa, Artificial Sequence
  Synthetic Peptide
TSAICSVVRR

SEQ ID NO: 6474 - protein, 9 aa, Artificial Sequence
  Synthetic Peptide
PTYKAFLCK

SEQ ID NO: 6475 - protein, 9 aa, Artificial Sequence
  Synthetic Peptide
PTDLEAYFK

SEQ ID NO: 6476 - protein, 9 aa, Artificial Sequence
  Synthetic Peptide
KYTSFPWLL

SEQ ID NO: 6477 - protein, 9 aa, Artificial Sequence
  Synthetic Peptide
LYAAVTNFL

SEQ ID NO: 6478 - protein, 9 aa, Artificial Sequence
  Synthetic Peptide
FYPNLTKYL

SEQ ID NO: 6479 - protein, 9 aa, Artificial Sequence
  Synthetic Peptide
LYSSTVPSF

SEQ ID NO: 6480 - protein, 9 aa, Artificial Sequence
  Synthetic Peptide
FYPKVTKYL

SEQ ID NO: 6481 - protein, 9 aa, Artificial Sequence
  Synthetic Peptide
FYPKVTKYL

SEQ ID NO: 6482 - protein, 9 aa, Artificial Sequence
  Synthetic Peptide
LYSILSPFL

SEQ ID NO: 6483 - protein, 9 aa, Artificial Sequence
  Synthetic Peptide
LYSSTVPVL

SEQ ID NO: 6484 - protein, 9 aa, Artificial Sequence
  Synthetic Peptide
LYNILSPFL

SEQ ID NO: 6485 - protein, 9 aa, Artificial Sequence
  Synthetic Peptide
NYRVSWPKF

SEQ ID NO: 6486 - protein, 9 aa, Artificial Sequence
  Synthetic Peptide
HYFQTRHYL

SEQ ID NO: 6487 - protein, 9 aa, Artificial Sequence
  Synthetic Peptide
HYFKTRHYL

SEQ ID NO: 6488 - protein, 9 aa, Artificial Sequence
  Synthetic Peptide
GYPALMPLY

SEQ ID NO: 6489 - protein, 9 aa, Artificial Sequence
  Synthetic Peptide
AYRPPNAPI

SEQ ID NO: 6490 - protein, 9 aa, Artificial Sequence
  Synthetic Peptide
LYQTFGRKL

SEQ ID NO: 6491 - protein, 9 aa, Artificial Sequence
  Synthetic Peptide
SYQHFRRLL

SEQ ID NO: 6492 - protein, 10 aa, Artificial Sequence
  Synthetic Peptide
LYSHPIILGF

SEQ ID NO: 6493 - protein, 10 aa, Artificial Sequence
  Synthetic Peptide
LYAAVTNFLL

SEQ ID NO: 6494 - protein, 10 aa, Artificial Sequence
  Synthetic Peptide
LYRPLLSLPF

SEQ ID NO: 6495 - protein, 10 aa, Artificial Sequence
  Synthetic Peptide
SYQHFRRLLL

SEQ ID NO: 6496 - protein, 10 aa, Artificial Sequence
  Synthetic Peptide
SYQHFRKLLL

SEQ ID NO: 6497 - protein, 10 aa, Artificial Sequence
  Synthetic Peptide
YYPEHLVNHY

SEQ ID NO: 6498 - protein, 10 aa, Artificial Sequence
  Synthetic Peptide
AYRPPHAPIL

SEQ ID NO: 6499 - protein, 10 aa, Artificial Sequence
  Synthetic Peptide
GYRWMCLRRF

SEQ ID NO: 6500 - protein, 10 aa, Artificial Sequence
  Synthetic Peptide
NFLLSLGIHL

SEQ ID NO: 6501 - protein, 9 aa, Artificial Sequence
  Synthetic Peptide
YVSLMLLYK

SEQ ID NO: 6502 - protein, 9 aa, Artificial Sequence
  Synthetic Peptide
LLYKTPGRK

SEQ ID NO: 6503 - protein, 9 aa, Artificial Sequence
  Synthetic Peptide
LLYKTYGRK

SEQ ID NO: 6504 - protein, 9 aa, Artificial Sequence
  Synthetic Peptide
VTKYLPLDK

SEQ ID NO: 6505 - protein, 9 aa, Artificial Sequence
  Synthetic Peptide
RHYLHTLWK

SEQ ID NO: 6506 - protein, 9 aa, Artificial Sequence
  Synthetic Peptide
STVPSFNPK

SEQ ID NO: 6507 - protein, 9 aa, Artificial Sequence
  Synthetic Peptide
TTDLEAYFK

SEQ ID NO: 6508 - protein, 9 aa, Artificial Sequence
  Synthetic Peptide
YVSLLLLYK

SEQ ID NO: 6509 - protein, 9 aa, Artificial Sequence
  Synthetic Peptide
PTYKAFLTK

SEQ ID NO: 6510 - protein, 9 aa, Artificial Sequence
  Synthetic Peptide
HLYPVARQR

SEQ ID NO: 6511 - protein, 9 aa, Artificial Sequence
  Synthetic Peptide
STNRQLGRK

SEQ ID NO: 6512 - protein, 9 aa, Artificial Sequence
  Synthetic Peptide
ALRFTSARR

SEQ ID NO: 6513 - protein, 9 aa, Artificial Sequence
  Synthetic Peptide
PVNRPIDWK

SEQ ID NO: 6514 - protein, 9 aa, Artificial Sequence
  Synthetic Peptide
TVNFNRRLK

SEQ ID NO: 6515 - protein, 9 aa, Artificial Sequence
  Synthetic Peptide
VVNHYFQTR

SEQ ID NO: 6516 - protein, 9 aa, Artificial Sequence
  Synthetic Peptide
STTSTGPCK

SEQ ID NO: 6517 - protein, 9 aa, Artificial Sequence
  Synthetic Peptide
QVLPKLLHK

SEQ ID NO: 6518 - protein, 9 aa, Artificial Sequence
  Synthetic Peptide
LTKYLPLDK

SEQ ID NO: 6519 - protein, 9 aa, Artificial Sequence
  Synthetic Peptide
CLHQSAVRK

SEQ ID NO: 6520 - protein, 9 aa, Artificial Sequence
  Synthetic Peptide
VVDPSQFSR

SEQ ID NO: 6521 - protein, 9 aa, Artificial Sequence
  Synthetic Peptide
PLYACIQAK

SEQ ID NO: 6522 - protein, 9 aa, Artificial Sequence
  Synthetic Peptide
YVNTNMGLK

SEQ ID NO: 6523 - protein, 9 aa, Artificial Sequence
  Synthetic Peptide
PLYACIQSK

SEQ ID NO: 6524 - protein, 9 aa, Artificial Sequence
  Synthetic Peptide
RLADEGLNR

SEQ ID NO: 6525 - protein, 9 aa, Artificial Sequence
  Synthetic Peptide
AVNHYFKTR

SEQ ID NO: 6526 - protein, 8 aa, Artificial Sequence
  Synthetic Peptide
RLKLMPAR

SEQ ID NO: 6527 - protein, 9 aa, Artificial Sequence
  Synthetic Peptide
ILYKRETTR

SEQ ID NO: 6528 - protein, 9 aa, Artificial Sequence
  Synthetic Peptide
NVSIPWTHK

SEQ ID NO: 6529 - protein, 9 aa, Artificial Sequence
  Synthetic Peptide
LLLYKTFGR

SEQ ID NO: 6530 - protein, 9 aa, Artificial Sequence
  Synthetic Peptide
RLVFQTSTR

SEQ ID NO: 6531 - protein, 9 aa, Artificial Sequence
  Synthetic Peptide
FVLGGCRHK

SEQ ID NO: 6532 - protein, 9 aa, Artificial Sequence
  Synthetic Peptide
RLVLQTSTR

SEQ ID NO: 6533 - protein, 9 aa, Artificial Sequence
  Synthetic Peptide
MLLYKTYGR

SEQ ID NO: 6534 - protein, 9 aa, Artificial Sequence
  Synthetic Peptide
TVNEKRRLK

SEQ ID NO: 6535 - protein, 9 aa, Artificial Sequence
  Synthetic Peptide
NLYPVARQR

SEQ ID NO: 6536 - protein, 9 aa, Artificial Sequence
  Synthetic Peptide
LPYRPTTGR

SEQ ID NO: 6537 - protein, 9 aa, Artificial Sequence
  Synthetic Peptide
LVSFGVWIR

SEQ ID NO: 6538 - protein, 9 aa, Artificial Sequence
  Synthetic Peptide
LVGSSGLPR

SEQ ID NO: 6539 - protein, 9 aa, Artificial Sequence
  Synthetic Peptide
HISCLTFGR

SEQ ID NO: 6540 - protein, 9 aa, Artificial Sequence
  Synthetic Peptide
SVPSRLPDR

SEQ ID NO: 6541 - protein, 9 aa, Artificial Sequence
  Synthetic Peptide
SVPSHLPDR

SEQ ID NO: 6542 - protein, 10 aa, Artificial Sequence
  Synthetic Peptide
TLPQEHIVLK

SEQ ID NO: 6543 - protein, 10 aa, Artificial Sequence
  Synthetic Peptide
TVPVFNPHWK

SEQ ID NO: 6544 - protein, 10 aa, Artificial Sequence
  Synthetic Peptide
TLWKAGILYK

SEQ ID NO: 6545 - protein, 10 aa, Artificial Sequence
  Synthetic Peptide
SMYPSCCCTK

SEQ ID NO: 6546 - protein, 10 aa, Artificial Sequence
  Synthetic Peptide
RLPYRPTTGR

SEQ ID NO: 6547 - protein, 10 aa, Artificial Sequence
  Synthetic Peptide
STTDLEAYFK

SEQ ID NO: 6548 - protein, 10 aa, Artificial Sequence
  Synthetic Peptide
LLLYKTFGRK

SEQ ID NO: 6549 - protein, 10 aa, Artificial Sequence
  Synthetic Peptide
TVNAHRNLPK

SEQ ID NO: 6550 - protein, 10 aa, Artificial Sequence
  Synthetic Peptide
EAYFKDCLFK

SEQ ID NO: 6551 - protein, 10 aa, Artificial Sequence
  Synthetic Peptide
LVVDESQFSR

SEQ ID NO: 6552 - protein, 10 aa, Artificial Sequence
  Synthetic Peptide
MLLYKTYGRK

SEQ ID NO: 6553 - protein, 10 aa, Artificial Sequence
  Synthetic Peptide
TAYSHLSTSK

SEQ ID NO: 6554 - protein, 10 aa, Artificial Sequence
  Synthetic Peptide
SLGIHLNPNK

SEQ ID NO: 6555 - protein, 10 aa, Artificial Sequence
  Synthetic Peptide
RLGLYRPLLR

SEQ ID NO: 6556 - protein, 10 aa, Artificial Sequence
  Synthetic Peptide
VTGGVFLVDK

SEQ ID NO: 6557 - protein, 10 aa, Artificial Sequence
  Synthetic Peptide
RIRTPRTPAR

SEQ ID NO: 6558 - protein, 10 aa, Artificial Sequence
  Synthetic Peptide
TVNGHQVLPK

SEQ ID NO: 6559 - protein, 10 aa, Artificial Sequence
  Synthetic Peptide
SLPFQPTTGR

SEQ ID NO: 6560 - protein, 10 aa, Artificial Sequence
  Synthetic Peptide
TLPETTVVRR

SEQ ID NO: 6561 - protein, 10 aa, Artificial Sequence
  Synthetic Peptide
GTDNSVVLSR

SEQ ID NO: 6562 - protein, 10 aa, Artificial Sequence
  Synthetic Peptide
STLPETTVVR

SEQ ID NO: 6563 - protein, 10 aa, Artificial Sequence
  Synthetic Peptide
KVTKYLPLDK

SEQ ID NO: 6564 - protein, 10 aa, Artificial Sequence
  Synthetic Peptide
STRHGDKSFR

SEQ ID NO: 6565 - protein, 10 aa, Artificial Sequence
  Synthetic Peptide
VLSCWWLQFR

SEQ ID NO: 6566 - protein, 9 aa, Artificial Sequence
  Synthetic Peptide
NVTKYLPDK

SEQ ID NO: 6567 - protein, 10 aa, Artificial Sequence
  Synthetic Peptide
RVCCQLDPAR

SEQ ID NO: 6568 - protein, 10 aa, Artificial Sequence
  Synthetic Peptide
SLGIHLNPQK

SEQ ID NO: 6569 - protein, 10 aa, Artificial Sequence
  Synthetic Peptide
YLVSFGVWIR

SEQ ID NO: 6570 - protein, 10 aa, Artificial Sequence
  Synthetic Peptide
FVGPLTVNEK

SEQ ID NO: 6571 - protein, 10 aa, Artificial Sequence
  Synthetic Peptide
YVGPLTVNEK

SEQ ID NO: 6572 - protein, 10 aa, Artificial Sequence
  Synthetic Peptide
RLADEGLNRR

SEQ ID NO: 6573 - protein, 10 aa, Artificial Sequence
  Synthetic Peptide
IVLKLKQCFR

SEQ ID NO: 6574 - protein, 10 aa, Artificial Sequence
  Synthetic Peptide
PIPSSWAFAK

SEQ ID NO: 6575 - protein, 10 aa, Artificial Sequence
  Synthetic Peptide
LTVNENRRLK

SEQ ID NO: 6576 - protein, 9 aa, Artificial Sequence
  Synthetic Peptide
CTCGSSDLY

SEQ ID NO: 6577 - protein, 9 aa, Artificial Sequence
  Synthetic Peptide
NIVDVQYLY

SEQ ID NO: 6578 - protein, 9 aa, Artificial Sequence
  Synthetic Peptide
VQDCNCSIY

SEQ ID NO: 6579 - protein, 9 aa, Artificial Sequence
  Synthetic Peptide
LTPRCMVDY

SEQ ID NO: 6580 - protein, 9 aa, Artificial Sequence
  Synthetic Peptide
RVCEKMALY

SEQ ID NO: 6581 - protein, 9 aa, Artificial Sequence
  Synthetic Peptide
DVVCCSMSY

SEQ ID NO: 6582 - protein, 9 aa, Artificial Sequence
  Synthetic Peptide
FTIFKIRMY

SEQ ID NO: 6583 - protein, 10 aa, Artificial Sequence
  Synthetic Peptide
GLSAFSLHSY

SEQ ID NO: 6584 - protein, 10 aa, Artificial Sequence
  Synthetic Peptide
TLHGPTPLLY

SEQ ID NO: 6585 - protein, 9 aa, Artificial Sequence
  Synthetic Peptide
EYVLLLFLL

SEQ ID NO: 6586 - protein, 10 aa, Artificial Sequence
  Synthetic Peptide
MYVGGVEHRL

SEQ ID NO: 6587 - protein, 10 aa, Artificial Sequence
  Synthetic Peptide
EYVLLLFLLL

SEQ ID NO: 6588 - protein, 9 aa, Artificial Sequence
  Synthetic Peptide
SVPAEILRK

SEQ ID NO: 6589 - protein, 9 aa, Artificial Sequence
  Synthetic Peptide
QLFTFSPRR

SEQ ID NO: 6590 - protein, 9 aa, Artificial Sequence
  Synthetic Peptide
RLGVRATRK

SEQ ID NO: 6591 - protein, 9 aa, Artificial Sequence
  Synthetic Peptide
LIFCHSKKK

SEQ ID NO: 6592 - protein, 9 aa, Artificial Sequence
  Synthetic Peptide
HLFPCHSKK

SEQ ID NO: 6593 - protein, 9 aa, Artificial Sequence
  Synthetic Peptide
KTSERSQPR

SEQ ID NO: 6594 - protein, 9 aa, Artificial Sequence
  Synthetic Peptide
AVCTRGVAK

SEQ ID NO: 6595 - protein, 9 aa, Artificial Sequence
  Synthetic Peptide
EVFCVQPEK

SEQ ID NO: 6596 - protein, 9 aa, Artificial Sequence
  Synthetic Peptide
ITRVESENK

SEQ ID NO: 6597 - protein, 9 aa, Artificial Sequence
  Synthetic Peptide
CIITSLTGR

SEQ ID NO: 6598 - protein, 10 aa, Artificial Sequence
  Synthetic Peptide
GVAGALVAFK

SEQ ID NO: 6599 - protein, 10 aa, Artificial Sequence
  Synthetic Peptide
HLHAPTGSGK

SEQ ID NO: 6600 - protein, 10 aa, Artificial Sequence
  Synthetic Peptide
RMYVGGVEHR

SEQ ID NO: 6601 - protein, 10 aa, Artificial Sequence
  Synthetic Peptide
HLIFCHSKKK

SEQ ID NO: 6602 - protein, 10 aa, Artificial Sequence
  Synthetic Peptide
TLGFGAYMSK

SEQ ID NO: 6603 - protein, 10 aa, Artificial Sequence
  Synthetic Peptide
GVGIYLLPNR

SEQ ID NO: 6604 - protein, 10 aa, Artificial Sequence
  Synthetic Peptide
LLFLLLADAR

SEQ ID NO: 6605 - protein, 9 aa, Artificial Sequence
  Synthetic Peptide
FRDYVDRFY

SEQ ID NO: 6606 - protein, 9 aa, Artificial Sequence
  Synthetic Peptide
IYQYMDDLY

SEQ ID NO: 6607 - protein, 9 aa, Artificial Sequence
  Synthetic Peptide
TVLDVGDAY

SEQ ID NO: 6608 - protein, 10 aa, Artificial Sequence
  Synthetic Peptide
VTVLDVGDAY

SEQ ID NO: 6609 - protein, 10 aa, Artificial Sequence
  Synthetic Peptide
VIYQYMDDLY

SEQ ID NO: 6610 - protein, 10 aa, Artificial Sequence
  Synthetic Peptide
VTVLDVGDAY

SEQ ID NO: 6611 - protein, 10 aa, Artificial Sequence
  Synthetic Peptide
EVNIVTDSQY

SEQ ID NO: 6612 - protein, 10 aa, Artificial Sequence
  Synthetic Peptide
LVAVHVASGY

SEQ ID NO: 6613 - protein, 10 aa, Artificial Sequence
  Synthetic Peptide
PAETGQETAY

SEQ ID NO: 6614 - protein, 10 aa, Artificial Sequence
  Synthetic Peptide
ISKIGPENPY

SEQ ID NO: 6615 - protein, 10 aa, Artificial Sequence
  Synthetic Peptide
QMAVFIHNFK

SEQ ID NO: 6616 - protein, 9 aa, Artificial Sequence
  Synthetic Peptide
RYLKDQQLL

SEQ ID NO: 6617 - protein, 9 aa, Artificial Sequence
  Synthetic Peptide
RYLKDQQLL

SEQ ID NO: 6618 - protein, 9 aa, Artificial Sequence
  Synthetic Peptide
TYQIYQEPF

SEQ ID NO: 6619 - protein, 8 aa, Artificial Sequence
  Synthetic Peptide
TYQIQEPF

SEQ ID NO: 6620 - protein, 9 aa, Artificial Sequence
  Synthetic Peptide
IYQEPFKNL

SEQ ID NO: 6621 - protein, 9 aa, Artificial Sequence
  Synthetic Peptide
IYQEPFKNL

SEQ ID NO: 6622 - protein, 9 aa, Artificial Sequence
  Synthetic Peptide
IYQYMDDLY

SEQ ID NO: 6623 - protein, 10 aa, Artificial Sequence
  Synthetic Peptide
IYKRVVILGL

SEQ ID NO: 6624 - protein, 10 aa, Artificial Sequence
  Synthetic Peptide
IYKRVVILGL

SEQ ID NO: 6625 - protein, 10 aa, Artificial Sequence
  Synthetic Peptide
LYPLASLRSL

SEQ ID NO: 6626 - protein, 9 aa, Artificial Sequence
  Synthetic Peptide
KLAGRWPVK

SEQ ID NO: 6627 - protein, 9 aa, Artificial Sequence
  Synthetic Peptide
AVFIHNFKR

SEQ ID NO: 6628 - protein, 9 aa, Artificial Sequence
  Synthetic Peptide
AIPQSSMTK

SEQ ID NO: 6629 - protein, 9 aa, Artificial Sequence
  Synthetic Peptide
IVTWGKTPK

SEQ ID NO: 6630 - protein, 9 aa, Artificial Sequence
  Synthetic Peptide
KLTEDRWNK

SEQ ID NO: 6631 - protein, 9 aa, Artificial Sequence
  Synthetic Peptide
GIPHPAGLK

SEQ ID NO: 6632 - protein, 9 aa, Artificial Sequence
  Synthetic Peptide
QIIEQLIKK

SEQ ID NO: 6633 - protein, 9 aa, Artificial Sequence
  Synthetic Peptide
KIWPSYKGR

SEQ ID NO: 6634 - protein, 9 aa, Artificial Sequence
  Synthetic Peptide
IIATDIQTK

SEQ ID NO: 6635 - protein, 9 aa, Artificial Sequence
  Synthetic Peptide
MGYELHPDK

SEQ ID NO: 6636 - protein, 9 aa, Artificial Sequence
  Synthetic Peptide
YLAWVPAHK

SEQ ID NO: 6637 - protein, 9 aa, Artificial Sequence
  Synthetic Peptide
KIWPSHKGR

SEQ ID NO: 6638 - protein, 9 aa, Artificial Sequence
  Synthetic Peptide
FVNTPPLVK

SEQ ID NO: 6639 - protein, 9 aa, Artificial Sequence
  Synthetic Peptide
NTPVFAIKK

SEQ ID NO: 6640 - protein, 9 aa, Artificial Sequence
  Synthetic Peptide
TVQCTHGIK

SEQ ID NO: 6641 - protein, 9 aa, Artificial Sequence
  Synthetic Peptide
ILDIRQGPK

SEQ ID NO: 6642 - protein, 9 aa, Artificial Sequence
  Synthetic Peptide
RDYVDRFYK

SEQ ID NO: 6643 - protein, 9 aa, Artificial Sequence
  Synthetic Peptide
GIIQAQPDK

SEQ ID NO: 6644 - protein, 9 aa, Artificial Sequence
  Synthetic Peptide
VLFLDGIDK

SEQ ID NO: 6645 - protein, 9 aa, Artificial Sequence
  Synthetic Peptide
LVDFRELNK

SEQ ID NO: 6646 - protein, 9 aa, Artificial Sequence
  Synthetic Peptide
KVVPRRKAK

SEQ ID NO: 6647 - protein, 9 aa, Artificial Sequence
  Synthetic Peptide
MTKILEPFR

SEQ ID NO: 6648 - protein, 10 aa, Artificial Sequence
  Synthetic Peptide
TVYYGVPVWK

SEQ ID NO: 6649 - protein, 10 aa, Artificial Sequence
  Synthetic Peptide
TVQPIVLPEK

SEQ ID NO: 6650 - protein, 10 aa, Artificial Sequence
  Synthetic Peptide
AVFIHNFKRK

SEQ ID NO: 6651 - protein, 10 aa, Artificial Sequence
  Synthetic Peptide
KVLFLDGIDK

SEQ ID NO: 6652 - protein, 10 aa, Artificial Sequence
  Synthetic Peptide
KLVDFRELNK

SEQ ID NO: 6653 - protein, 10 aa, Artificial Sequence
  Synthetic Peptide
KLKPGMDGPK

SEQ ID NO: 6654 - protein, 10 aa, Artificial Sequence
  Synthetic Peptide
FLGKIWPSYK

SEQ ID NO: 6655 - protein, 10 aa, Artificial Sequence
  Synthetic Peptide
KIQNFRVYYR

SEQ ID NO: 6656 - protein, 10 aa, Artificial Sequence
  Synthetic Peptide
GIPHPAGLKK

SEQ ID NO: 6657 - protein, 10 aa, Artificial Sequence
  Synthetic Peptide
LVKLWYQLEK

SEQ ID NO: 6658 - protein, 10 aa, Artificial Sequence
  Synthetic Peptide
MIGGIGGFIK

SEQ ID NO: 6659 - protein, 10 aa, Artificial Sequence
  Synthetic Peptide
MTKILEPFRK

SEQ ID NO: 6660 - protein, 10 aa, Artificial Sequence
  Synthetic Peptide
VVIQDNSDIK

SEQ ID NO: 6661 - protein, 10 aa, Artificial Sequence
  Synthetic Peptide
FLGKIWPSHK

SEQ ID NO: 6662 - protein, 10 aa, Artificial Sequence
  Synthetic Peptide
IVQQQNNLLR

SEQ ID NO: 6663 - protein, 10 aa, Artificial Sequence
  Synthetic Peptide
FTTPDKKHQK

SEQ ID NO: 6664 - protein, 10 aa, Artificial Sequence
  Synthetic Peptide
LVEICTEMEK

SEQ ID NO: 6665 - protein, 10 aa, Artificial Sequence
  Synthetic Peptide
LVQNANPDCK

SEQ ID NO: 6666 - protein, 9 aa, Artificial Sequence
  Synthetic Peptide
ISEYRHYCY

SEQ ID NO: 6667 - protein, 9 aa, Artificial Sequence
  Synthetic Peptide
QAEPDRAHY

SEQ ID NO: 6668 - protein, 10 aa, Artificial Sequence
  Synthetic Peptide
LQDIEITCVY

SEQ ID NO: 6669 - protein, 10 aa, Artificial Sequence
  Synthetic Peptide
YSKISEYRHY

SEQ ID NO: 6670 - protein, 10 aa, Artificial Sequence
  Synthetic Peptide
YSKISEYRHY

SEQ ID NO: 6671 - protein, 10 aa, Artificial Sequence
  Synthetic Peptide
HGDTPTLHEY

SEQ ID NO: 6672 - protein, 10 aa, Artificial Sequence
  Synthetic Peptide
QPETTDLYCY

SEQ ID NO: 6673 - protein, 10 aa, Artificial Sequence
  Synthetic Peptide
IHDIILECVY

SEQ ID NO: 6674 - protein, 10 aa, Artificial Sequence
  Synthetic Peptide
YSRIRELRHY

SEQ ID NO: 6675 - protein, 10 aa, Artificial Sequence
  Synthetic Peptide
YSRIRELRHY

SEQ ID NO: 6676 - protein, 10 aa, Artificial Sequence
  Synthetic Peptide
AVCDKCLKFY

SEQ ID NO: 6677 - protein, 10 aa, Artificial Sequence
  Synthetic Peptide
LLIRCLRCQK

SEQ ID NO: 6678 - protein, 9 aa, Artificial Sequence
  Synthetic Peptide
HTMLCMCCK

SEQ ID NO: 6679 - protein, 9 aa, Artificial Sequence
  Synthetic Peptide
VYCKTVLEL

SEQ ID NO: 6680 - protein, 9 aa, Artificial Sequence
  Synthetic Peptide
CYSLYGTTL

SEQ ID NO: 6681 - protein, 9 aa, Artificial Sequence
  Synthetic Peptide
VYDFAFRDL

SEQ ID NO: 6682 - protein, 9 aa, Artificial Sequence
  Synthetic Peptide
LYNLLIRCL

SEQ ID NO: 6683 - protein, 9 aa, Artificial Sequence
  Synthetic Peptide
VYGDTLEKL

SEQ ID NO: 6684 - protein, 9 aa, Artificial Sequence
  Synthetic Peptide
SVYGDTLEK

SEQ ID NO: 6685 - protein, 9 aa, Artificial Sequence
  Synthetic Peptide
SVYGDTLEK

SEQ ID NO: 6686 - protein, 9 aa, Artificial Sequence
  Synthetic Peptide
SVYGDTLEK

SEQ ID NO: 6687 - protein, 9 aa, Artificial Sequence
  Synthetic Peptide
TTLEQQYNK

SEQ ID NO: 6688 - protein, 9 aa, Artificial Sequence
  Synthetic Peptide
SIPHAACHK

SEQ ID NO: 6689 - protein, 9 aa, Artificial Sequence
  Synthetic Peptide
SIPHAACHK

SEQ ID NO: 6690 - protein, 9 aa, Artificial Sequence
  Synthetic Peptide
IVCPICSQK

SEQ ID NO: 6691 - protein, 9 aa, Artificial Sequence
  Synthetic Peptide
KLRHLNEKR

SEQ ID NO: 6692 - protein, 9 aa, Artificial Sequence
  Synthetic Peptide
LIRCLRCQK

SEQ ID NO: 6693 - protein, 9 aa, Artificial Sequence
  Synthetic Peptide
IILECVYCK

SEQ ID NO: 6694 - protein, 9 aa, Artificial Sequence
  Synthetic Peptide
CIDFYSRIR

SEQ ID NO: 6695 - protein, 9 aa, Artificial Sequence
  Synthetic Peptide
CIDFYSRIR

SEQ ID NO: 6696 - protein, 10 aa, Artificial Sequence
  Synthetic Peptide
GTTLEQQYNK

SEQ ID NO: 6697 - protein, 10 aa, Artificial Sequence
  Synthetic Peptide
LLIRCLRCQK

SEQ ID NO: 6698 - protein, 10 aa, Artificial Sequence
  Synthetic Peptide
LLIRCINCQK

SEQ ID NO: 6699 - protein, 10 aa, Artificial Sequence
  Synthetic Peptide
LLIRCLRCQK

SEQ ID NO: 6700 - protein, 10 aa, Artificial Sequence
  Synthetic Peptide
LTEVFEFAFK

SEQ ID NO: 6701 - protein, 10 aa, Artificial Sequence
  Synthetic Peptide
GIVCPICSQK

SEQ ID NO: 6702 - protein, 10 aa, Artificial Sequence
  Synthetic Peptide
LTEVFEFAFK

SEQ ID NO: 6703 - protein, 10 aa, Artificial Sequence
  Synthetic Peptide
DIILECVYCK

SEQ ID NO: 6704 - protein, 10 aa, Artificial Sequence
  Synthetic Peptide
KLRHLNEKRR

SEQ ID NO: 6705 - protein, 10 aa, Artificial Sequence
  Synthetic Peptide
CVYCKQQLLR

SEQ ID NO: 6706 - protein, 9 aa, Artificial Sequence
  Synthetic Peptide
EVDPIGHLY

SEQ ID NO: 6707 - protein, 9 aa, Artificial Sequence
  Synthetic Peptide
EADPTSNTY

SEQ ID NO: 6708 - protein, 9 aa, Artificial Sequence
  Synthetic Peptide
TQDLVQEKY

SEQ ID NO: 6709 - protein, 9 aa, Artificial Sequence
  Synthetic Peptide
EVDPIGHVY

SEQ ID NO: 6710 - protein, 9 aa, Artificial Sequence
  Synthetic Peptide
EADPTGHSY

SEQ ID NO: 6711 - protein, 9 aa, Artificial Sequence
  Synthetic Peptide
LVQEKYLEY

SEQ ID NO: 6712 - protein, 9 aa, Artificial Sequence
  Synthetic Peptide
TSYVKVLEY

SEQ ID NO: 6713 - protein, 9 aa, Artificial Sequence
  Synthetic Peptide
SSLFTTMNY

SEQ ID NO: 6714 - protein, 9 aa, Artificial Sequence
  Synthetic Peptide
GSVVGNWQY

SEQ ID NO: 6715 - protein, 9 aa, Artificial Sequence
  Synthetic Peptide
SSFSTTINY

SEQ ID NO: 6716 - protein, 9 aa, Artificial Sequence
  Synthetic Peptide
MLESVIKNY

SEQ ID NO: 6717 - protein, 10 aa, Artificial Sequence
  Synthetic Peptide
ASSLPTTMNY

SEQ ID NO: 6718 - protein, 10 aa, Artificial Sequence
  Synthetic Peptide
LTQDLVQEKY

SEQ ID NO: 6719 - protein, 10 aa, Artificial Sequence
  Synthetic Peptide
ETSYVKVLEY

SEQ ID NO: 6720 - protein, 10 aa, Artificial Sequence
  Synthetic Peptide
ASSFSTTINY

SEQ ID NO: 6721 - protein, 10 aa, Artificial Sequence
  Synthetic Peptide
DLVQEKYLEY

SEQ ID NO: 6722 - protein, 9 aa, Artificial Sequence
  Synthetic Peptide
TSYVKVLEY

SEQ ID NO: 6723 - protein, 9 aa, Artificial Sequence
  Synthetic Peptide
TTINFTRQR

SEQ ID NO: 6724 - protein, 9 aa, Artificial Sequence
  Synthetic Peptide
ALAETSYVK

SEQ ID NO: 6725 - protein, 9 aa, Artificial Sequence
  Synthetic Peptide
LTQDLVQEK

SEQ ID NO: 6726 - protein, 9 aa, Artificial Sequence
  Synthetic Peptide
LVQEKYLEY

SEQ ID NO: 6727 - protein, 9 aa, Artificial Sequence
  Synthetic Peptide
HSAYGEPRK

SEQ ID NO: 6728 - protein, 10 aa, Artificial Sequence
  Synthetic Peptide
LFRAVITTKK

SEQ ID NO: 6729 - protein, 10 aa, Artificial Sequence
  Synthetic Peptide
RVRFFFPSLP

SEQ ID NO: 6730 - protein, 10 aa, Artificial Sequence
  Synthetic Peptide
ADLVGFLLLK

SEQ ID NO: 6731 - protein, 10 aa, Artificial Sequence
  Synthetic Peptide
ESLFRAVITK

SEQ ID NO: 6732 - protein, 10 aa, Artificial Sequence
  Synthetic Peptide
DLVQEKYLEY

SEQ ID NO: 6733 - protein, 10 aa, Artificial Sequence
  Synthetic Peptide
YVIKVSARVR

SEQ ID NO: 6734 - protein, 10 aa, Artificial Sequence
  Synthetic Peptide
LSVMEVYDGR

SEQ ID NO: 6735 - protein, 10 aa, Artificial Sequence
  Synthetic Peptide
KAEMLESVIK

SEQ ID NO: 6736 - protein, 10 aa, Artificial Sequence
  Synthetic Peptide
RALAETSYVK

SEQ ID NO: 6737 - protein, 9 aa, Artificial Sequence
  Synthetic Peptide
NYPLWSQSY

SEQ ID NO: 6738 - protein, 10 aa, Artificial Sequence
  Synthetic Peptide
NYKHCFPEIF

SEQ ID NO: 6739 - protein, 10 aa, Artificial Sequence
  Synthetic Peptide
LYIFATCLGL

SEQ ID NO: 6740 - protein, 10 aa, Artificial Sequence
  Synthetic Peptide
SYVKVLEYVI

SEQ ID NO: 6741 - protein, 9 aa, Artificial Sequence
  Synthetic Peptide
SLFRAVITK

SEQ ID NO: 6742 - protein, 9 aa, Artificial Sequence
  Synthetic Peptide
SVMEVYDGR

SEQ ID NO: 6743 - protein, 9 aa, Artificial Sequence
  Synthetic Peptide
TTINFTRQR

SEQ ID NO: 6744 - protein, 9 aa, Artificial Sequence
  Synthetic Peptide
LTQDLVQEK

SEQ ID NO: 6745 - protein, 10 aa, Artificial Sequence
  Synthetic Peptide
SLFRAVITKK

SEQ ID NO: 6746 - protein, 10 aa, Artificial Sequence
  Synthetic Peptide
LLTQDLVQEK

SEQ ID NO: 6747 - protein, 10 aa, Artificial Sequence
  Synthetic Peptide
MLESVIKNYK

SEQ ID NO: 6748 - protein, 10 aa, Artificial Sequence
  Synthetic Peptide
LLGDNQIMPK

SEQ ID NO: 6749 - protein, 10 aa, Artificial Sequence
  Synthetic Peptide
SLEQRSLHCK

SEQ ID NO: 6750 - protein, 9 aa, Artificial Sequence
  Synthetic Peptide
GSDCTTIHY

SEQ ID NO: 6751 - protein, 10 aa, Artificial Sequence
  Synthetic Peptide
GTAKSVTCTY

SEQ ID NO: 6752 - protein, 10 aa, Artificial Sequence
  Synthetic Peptide
RVEGNLRVEY

SEQ ID NO: 6753 - protein, 9 aa, Artificial Sequence
  Synthetic Peptide
RVRAMAIYK

SEQ ID NO: 6754 - protein, 9 aa, Artificial Sequence
  Synthetic Peptide
CTYSPALNK

SEQ ID NO: 6755 - protein, 9 aa, Artificial Sequence
  Synthetic Peptide
NTSSSPQPK

SEQ ID NO: 6756 - protein, 9 aa, Artificial Sequence
  Synthetic Peptide
RTEEENLRK

SEQ ID NO: 6757 - protein, 9 aa, Artificial Sequence
  Synthetic Peptide
ELNEALELK

SEQ ID NO: 6758 - protein, 10 aa, Artificial Sequence
  Synthetic Peptide
RTEEENLRKK

SEQ ID NO: 6759 - protein, 10 aa, Artificial Sequence
  Synthetic Peptide
KTYQGSYGFR

SEQ ID NO: 6760 - protein, 10 aa, Artificial Sequence
  Synthetic Peptide
VVRRCPHHER

SEQ ID NO: 6761 - protein, 10 aa, Artificial Sequence
  Synthetic Peptide
NTSSSPQPKK

SEQ ID NO: 6762 - protein, 10 aa, Artificial Sequence
  Synthetic Peptide
RVCACPGRDR

SEQ ID NO: 6763 - protein, 10 aa, Artificial Sequence
  Synthetic Peptide
GLAPPQHLIR

SEQ ID NO: 6764 - protein, 9 aa, Artificial Sequence
  Synthetic Peptide
KGEYFVEMY

SEQ ID NO: 6765 - protein, 9 aa, Artificial Sequence
  Synthetic Peptide
LGEYIRKRY

SEQ ID NO: 6766 - protein, 9 aa, Artificial Sequence
  Synthetic Peptide
ASCHLTELY

SEQ ID NO: 6767 - protein, 9 aa, Artificial Sequence
  Synthetic Peptide
ESYKHEQVY

SEQ ID NO: 6768 - protein, 10 aa, Artificial Sequence
  Synthetic Peptide
LSELSLLSLY

SEQ ID NO: 6769 - protein, 10 aa, Artificial Sequence
  Synthetic Peptide
LSELSLLSLY

SEQ ID NO: 6770 - protein, 10 aa, Artificial Sequence
  Synthetic Peptide
LTQLGMEQHY

SEQ ID NO: 6771 - protein, 10 aa, Artificial Sequence
  Synthetic Peptide
KGEYFVEMYY

SEQ ID NO: 6772 - protein, 10 aa, Artificial Sequence
  Synthetic Peptide
LVNEILNHMK

SEQ ID NO: 6773 - protein, 9 aa, Artificial Sequence
  Synthetic Peptide
ATQIPSYKK

SEQ ID NO: 6774 - protein, 10 aa, Artificial Sequence
  Synthetic Peptide
ETLKSEEFQK

SEQ ID NO: 6775 - protein, 9 aa, Artificial Sequence
  Synthetic Peptide
LYFEKGEYF

SEQ ID NO: 6776 - protein, 9 aa, Artificial Sequence
  Synthetic Peptide
LYCESVHNF

SEQ ID NO: 6777 - protein, 9 aa, Artificial Sequence
  Synthetic Peptide
PYKDFIATL

SEQ ID NO: 6778 - protein, 9 aa, Artificial Sequence
  Synthetic Peptide
VYNGLLPPY

SEQ ID NO: 6779 - protein, 10 aa, Artificial Sequence
  Synthetic Peptide
PYASCHLTEL

SEQ ID NO: 6780 - protein, 9 aa, Artificial Sequence
  Synthetic Peptide
ALPERPSLY

SEQ ID NO: 6781 - protein, 10 aa, Artificial Sequence
  Synthetic Peptide
VSHSFPHPLY

SEQ ID NO: 6782 - protein, 9 aa, Artificial Sequence
  Synthetic Peptide
PLYDMSLLK

SEQ ID NO: 6783 - protein, 9 aa, Artificial Sequence
  Synthetic Peptide
VVHYRKWIK

SEQ ID NO: 6784 - protein, 9 aa, Artificial Sequence
  Synthetic Peptide
YTKVVHYRK

SEQ ID NO: 6785 - protein, 9 aa, Artificial Sequence
  Synthetic Peptide
SLLKNRFLR

SEQ ID NO: 6786 - protein, 9 aa, Artificial Sequence
  Synthetic Peptide
IVGGWECEK

SEQ ID NO: 6787 - protein, 9 aa, Artificial Sequence
  Synthetic Peptide
QVHPQKVTK

SEQ ID NO: 6788 - protein, 10 aa, Artificial Sequence
  Synthetic Peptide
SLYTKVVHYR

SEQ ID NO: 6789 - protein, 10 aa, Artificial Sequence
  Synthetic Peptide
LTAAHCIRNK

SEQ ID NO: 6790 - protein, 10 aa, Artificial Sequence
  Synthetic Peptide
RSVGGWECEK

SEQ ID NO: 6791 - protein, 10 aa, Artificial Sequence
  Synthetic Peptide
KVVHYRKWIK

SEQ ID NO: 6792 - protein, 10 aa, Artificial Sequence
  Synthetic Peptide
VTKFMLCAGR

SEQ ID NO: 6793 - protein, 9 aa, Artificial Sequence
  Synthetic Peptide
MLLRLSEPA

SEQ ID NO: 6794 - protein, 9 aa, Artificial Sequence
  Synthetic Peptide
MPNDPNRNV

SEQ ID NO: 6795 - protein, 10 aa, Artificial Sequence
  Synthetic Peptide
NPDPNANPNV

SEQ ID NO: 6796 - protein, 10 aa, Artificial Sequence
  Synthetic Peptide
EPSDKHIKEY

SEQ ID NO: 6797 - protein, 9 aa, Artificial Sequence
  Synthetic Peptide
IPQSLDSWW

SEQ ID NO: 6798 - protein, 9 aa, Artificial Sequence
  Synthetic Peptide
CPGYRWMCL

SEQ ID NO: 6799 - protein, 9 aa, Artificial Sequence
  Synthetic Peptide
IPIPSSWAF

SEQ ID NO: 6800 - protein, 9 aa, Artificial Sequence
  Synthetic Peptide
TPARVTGGV

SEQ ID NO: 6801 - protein, 9 aa, Artificial Sequence
  Synthetic Peptide
LPIFFCLWV

SEQ ID NO: 6802 - protein, 9 aa, Artificial Sequence
  Synthetic Peptide
WPKFAVPNL

SEQ ID NO: 6803 - protein, 9 aa, Artificial Sequence
  Synthetic Peptide
HPAAMPHLL

SEQ ID NO: 6804 - protein, 9 aa, Artificial Sequence
  Synthetic Peptide
FPHCLAFSY

SEQ ID NO: 6805 - protein, 9 aa, Artificial Sequence
  Synthetic Peptide
DPSRGRLGL

SEQ ID NO: 6806 - protein, 10 aa, Artificial Sequence
  Synthetic Peptide
GPLEEELPRL

SEQ ID NO: 6807 - protein, 10 aa, Artificial Sequence
  Synthetic Peptide
IPWTHKVGNF

SEQ ID NO: 6808 - protein, 10 aa, Artificial Sequence
  Synthetic Peptide
LPLDKGIKPY

SEQ ID NO: 6809 - protein, 10 aa, Artificial Sequence
  Synthetic Peptide
PPNAPILSTL

SEQ ID NO: 6810 - protein, 10 aa, Artificial Sequence
  Synthetic Peptide
GPLLVLQAGF

SEQ ID NO: 6811 - protein, 10 aa, Artificial Sequence
  Synthetic Peptide
VPFVQWFVGL

SEQ ID NO: 6812 - protein, 10 aa, Artificial Sequence
  Synthetic Peptide
TPARVTGGVF

SEQ ID NO: 6813 - protein, 10 aa, Artificial Sequence
  Synthetic Peptide
LPIFFCLWVY

SEQ ID NO: 6814 - protein, 10 aa, Artificial Sequence
  Synthetic Peptide
VPNLQSLTNL

SEQ ID NO: 6815 - protein, 10 aa, Artificial Sequence
  Synthetic Peptide
FPHCLAFSYM

SEQ ID NO: 6816 - protein, 9 aa, Artificial Sequence
  Synthetic Peptide
QPRGRRQPI

SEQ ID NO: 6817 - protein, 9 aa, Artificial Sequence
  Synthetic Peptide
QPGYPWPLY

SEQ ID NO: 6818 - protein, 9 aa, Artificial Sequence
  Synthetic Peptide
WPLYGNEGL

SEQ ID NO: 6819 - protein, 9 aa, Artificial Sequence
  Synthetic Peptide
SPRGSRPSW

SEQ ID NO: 6820 - protein, 9 aa, Artificial Sequence
  Synthetic Peptide
DPRRRSRNL

SEQ ID NO: 6821 - protein, 9 aa, Artificial Sequence
  Synthetic Peptide
LPGCSFSIF

SEQ ID NO: 6822 - protein, 9 aa, Artificial Sequence
  Synthetic Peptide
IPQAVVDMV

SEQ ID NO: 6823 - protein, 9 aa, Artificial Sequence
  Synthetic Peptide
GPWLTPRCM

SEQ ID NO: 6824 - protein, 9 aa, Artificial Sequence
  Synthetic Peptide
YPCTVNFTI

SEQ ID NO: 6825 - protein, 9 aa, Artificial Sequence
  Synthetic Peptide
LPALSTGLI

SEQ ID NO: 6826 - protein, 9 aa, Artificial Sequence
  Synthetic Peptide
HPNIEEVAL

SEQ ID NO: 6827 - protein, 9 aa, Artificial Sequence
  Synthetic Peptide
TPAETTVRL

SEQ ID NO: 6828 - protein, 9 aa, Artificial Sequence
  Synthetic Peptide
APPPSWDQM

SEQ ID NO: 6829 - protein, 9 aa, Artificial Sequence
  Synthetic Peptide
PPPSWDQMW

SEQ ID NO: 6830 - protein, 9 aa, Artificial Sequence
  Synthetic Peptide
GPTPLLYRL

SEQ ID NO: 6831 - protein, 9 aa, Artificial Sequence
  Synthetic Peptide
SPGALVVGV

SEQ ID NO: 6832 - protein, 8 aa, Artificial Sequence
  Synthetic Peptide
GPEGAVQW

SEQ ID NO: 6833 - protein, 9 aa, Artificial Sequence
  Synthetic Peptide
LPCEPEPDV

SEQ ID NO: 6834 - protein, 9 aa, Artificial Sequence
  Synthetic Peptide
EPEPDVAVL

SEQ ID NO: 6835 - protein, 9 aa, Artificial Sequence
  Synthetic Peptide
DPDLSDGSW

SEQ ID NO: 6836 - protein, 9 aa, Artificial Sequence
  Synthetic Peptide
PPHSAKSKF

SEQ ID NO: 6837 - protein, 9 aa, Artificial Sequence
  Synthetic Peptide
SPGQRVEFL

SEQ ID NO: 6838 - protein, 9 aa, Artificial Sequence
  Synthetic Peptide
DPPQPEYDL

SEQ ID NO: 6839 - protein, 9 aa, Artificial Sequence
  Synthetic Peptide
QPEYDLELI

SEQ ID NO: 6840 - protein, 9 aa, Artificial Sequence
  Synthetic Peptide
APTLWARMI

SEQ ID NO: 6841 - protein, 10 aa, Artificial Sequence
  Synthetic Peptide
LPRRGPRLGV

SEQ ID NO: 6842 - protein, 10 aa, Artificial Sequence
  Synthetic Peptide
APLGGAARAL

SEQ ID NO: 6843 - protein, 10 aa, Artificial Sequence
  Synthetic Peptide
LPGCSFSIFL

SEQ ID NO: 6844 - protein, 10 aa, Artificial Sequence
  Synthetic Peptide
IPTTTIRRHV

SEQ ID NO: 6845 - protein, 10 aa, Artificial Sequence
  Synthetic Peptide
YPGHVSGHRM

SEQ ID NO: 6846 - protein, 10 aa, Artificial Sequence
  Synthetic Peptide
VPASQVCGPV

SEQ ID NO: 6847 - protein, 10 aa, Artificial Sequence
  Synthetic Peptide
GPWLTPRCMV

SEQ ID NO: 6848 - protein, 10 aa, Artificial Sequence
  Synthetic Peptide
YPCTVNFTIF

SEQ ID NO: 6849 - protein, 10 aa, Artificial Sequence
  Synthetic Peptide
SPLLLSTTEW

SEQ ID NO: 6850 - protein, 10 aa, Artificial Sequence
  Synthetic Peptide
WPLLLLLLAL

SEQ ID NO: 6851 - protein, 10 aa, Artificial Sequence
  Synthetic Peptide
TPCTCGSSDL

SEQ ID NO: 6852 - protein, 10 aa, Artificial Sequence
  Synthetic Peptide
APAAYAAQGY

SEQ ID NO: 6853 - protein, 10 aa, Artificial Sequence
  Synthetic Peptide
NPSVAATLGF

SEQ ID NO: 6854 - protein, 10 aa, Artificial Sequence
  Synthetic Peptide
RPSGMFDSSV

SEQ ID NO: 6855 - protein, 9 aa, Artificial Sequence
  Synthetic Peptide
DEEEAIVAY

SEQ ID NO: 6856 - protein, 10 aa, Artificial Sequence
  Synthetic Peptide
DEEEAIVAYT

SEQ ID NO: 6857 - protein, 11 aa, Artificial Sequence
  Synthetic Peptide
DEEEAIVAYTL

SEQ ID NO: 6858 - protein, 9 aa, Artificial Sequence
  Synthetic Peptide
EEAIVAYTL

SEQ ID NO: 6859 - protein, 9 aa, Artificial Sequence
  Synthetic Peptide
EEEAIVAYT

SEQ ID NO: 6860 - protein, 10 aa, Artificial Sequence
  Synthetic Peptide
EEEAIVAYTL

SEQ ID NO: 6861 - protein, 9 aa, Artificial Sequence
  Synthetic Peptide
SDEEEAIVA

SEQ ID NO: 6862 - protein, 10 aa, Artificial Sequence
  Synthetic Peptide
SDEEEAIVAY

SEQ ID NO: 6863 - protein, 11 aa, Artificial Sequence
  Synthetic Peptide
SDEEEAIVAYT

SEQ ID NO: 6864 - protein, 12 aa, Artificial Sequence
  Synthetic Peptide
SDEEEAIVAYTL

SEQ ID NO: 6865 - protein, 9 aa, Artificial Sequence
  Synthetic Peptide
DEVEFLGHY

SEQ ID NO: 6866 - protein, 10 aa, Artificial Sequence
  Synthetic Peptide
EENLLDFVRF

SEQ ID NO: 6867 - protein, 10 aa, Artificial Sequence
  Synthetic Peptide
EENLLDFVRM

SEQ ID NO: 6868 - protein, 9 aa, Artificial Sequence
  Synthetic Peptide
IEDPPFNSL

SEQ ID NO: 6869 - protein, 9 aa, Artificial Sequence
  Synthetic Peptide
KEHVIQNAF

SEQ ID NO: 6870 - protein, 9 aa, Artificial Sequence
  Synthetic Peptide
SENDRLRLL

SEQ ID NO: 6871 - protein, 9 aa, Artificial Sequence
  Synthetic Peptide
VEITPYKPT

SEQ ID NO: 6872 - protein, 9 aa, Artificial Sequence
  Synthetic Peptide
FEDLRVLSF

SEQ ID NO: 6873 - protein, 9 aa, Artificial Sequence
  Synthetic Peptide
GEISPLPSL

SEQ ID NO: 6874 - protein, 11 aa, Artificial Sequence
  Synthetic Peptide
AEDLNLGNLNV

SEQ ID NO: 6875 - protein, 8 aa, Artificial Sequence
  Synthetic Peptide
AELLAACF

SEQ ID NO: 6876 - protein, 9 aa, Artificial Sequence
  Synthetic Peptide
AELLAACFA

SEQ ID NO: 6877 - protein, 10 aa, Artificial Sequence
  Synthetic Peptide
DEAGPLEEEL

SEQ ID NO: 6878 - protein, 10 aa, Artificial Sequence
  Synthetic Peptide
EDLNLGNLNV

SEQ ID NO: 6879 - protein, 8 aa, Artificial Sequence
  Synthetic Peptide
EEELPRLA

SEQ ID NO: 6880 - protein, 9 aa, Artificial Sequence
  Synthetic Peptide
EELGEEIRL

SEQ ID NO: 6881 - protein, 9 aa, Artificial Sequence
  Synthetic Peptide
IDWKVCQRI

SEQ ID NO: 6882 - protein, 8 aa, Artificial Sequence
  Synthetic Peptide
LDSWWTSL

SEQ ID NO: 6883 - protein, 10 aa, Artificial Sequence
  Synthetic Peptide
LDSWWTSLNF

SEQ ID NO: 6884 - protein, 11 aa, Artificial Sequence
  Synthetic Peptide
LDSWWTSLNFL

SEQ ID NO: 6885 - protein, 8 aa, Artificial Sequence
  Synthetic Peptide
LDTASALY

SEQ ID NO: 6886 - protein, 8 aa, Artificial Sequence
  Synthetic Peptide
LDVSAAFY

SEQ ID NO: 6887 - protein, 9 aa, Artificial Sequence
  Synthetic Peptide
LDYQGMLPV

SEQ ID NO: 6888 - protein, 8 aa, Artificial Sequence
  Synthetic Peptide
LEEELPRL

SEQ ID NO: 6889 - protein, 9 aa, Artificial Sequence
  Synthetic Peptide
LEEELPRLA

SEQ ID NO: 6890 - protein, 9 aa, Artificial Sequence
  Synthetic Peptide
RDLLDTASA

SEQ ID NO: 6891 - protein, 10 aa, Artificial Sequence
  Synthetic Peptide
RDLLDTASAL

SEQ ID NO: 6892 - protein, 11 aa, Artificial Sequence
  Synthetic Peptide
RDLLDTASALY

SEQ ID NO: 6893 - protein, 9 aa, Artificial Sequence
  Synthetic Peptide
RDVLCLRPV

SEQ ID NO: 6894 - protein, 8 aa, Artificial Sequence
  Synthetic Peptide
RETVLEYL

SEQ ID NO: 6895 - protein, 9 aa, Artificial Sequence
  Synthetic Peptide
RETVLEYLV

SEQ ID NO: 6896 - protein, 11 aa, Artificial Sequence
  Synthetic Peptide
TDNSVVLSRKY

SEQ ID NO: 6897 - protein, 11 aa, Artificial Sequence
  Synthetic Peptide
VELLSFLPSDF

SEQ ID NO: 6898 - protein, 8 aa, Artificial Sequence
  Synthetic Peptide
WEELGEEI

SEQ ID NO: 6899 - protein, 10 aa, Artificial Sequence
  Synthetic Peptide
WEELGEEIRL

SEQ ID NO: 6900 - protein, 10 aa, Artificial Sequence
  Synthetic Peptide
ADLEVVTSTW

SEQ ID NO: 6901 - protein, 9 aa, Artificial Sequence
  Synthetic Peptide
ADLMGYIPL

SEQ ID NO: 6902 - protein, 8 aa, Artificial Sequence
  Synthetic Peptide
AEAALENL

SEQ ID NO: 6903 - protein, 9 aa, Artificial Sequence
  Synthetic Peptide
AEAALENLV

SEQ ID NO: 6904 - protein, 8 aa, Artificial Sequence
  Synthetic Peptide
AETAGARL

SEQ ID NO: 6905 - protein, 9 aa, Artificial Sequence
  Synthetic Peptide
AETAGARLV

SEQ ID NO: 6906 - protein, 10 aa, Artificial Sequence
  Synthetic Peptide
AETAGARLVV

SEQ ID NO: 6907 - protein, 11 aa, Artificial Sequence
  Synthetic Peptide
AETAGARLVVL

SEQ ID NO: 6908 - protein, 8 aa, Artificial Sequence
  Synthetic Peptide
CDELAAKL

SEQ ID NO: 6909 - protein, 10 aa, Artificial Sequence
  Synthetic Peptide
CECYDAGCAW

SEQ ID NO: 6910 - protein, 11 aa, Artificial Sequence
  Synthetic Peptide
CECYDAGCAWY

SEQ ID NO: 6911 - protein, 9 aa, Artificial Sequence
  Synthetic Peptide
CEKMALYDV

SEQ ID NO: 6912 - protein, 10 aa, Artificial Sequence
  Synthetic Peptide
CEKMALYDVV

SEQ ID NO: 6913 - protein, 9 aa, Artificial Sequence
  Synthetic Peptide
EDLVNLLPA

SEQ ID NO: 6914 - protein, 8 aa, Artificial Sequence
  Synthetic Peptide
GDLCGSVF

SEQ ID NO: 6915 - protein, 11 aa, Artificial Sequence
  Synthetic Peptide
GEGAVQWMNRL

SEQ ID NO: 6916 - protein, 9 aa, Artificial Sequence
  Synthetic Peptide
GEIPFYGKA

SEQ ID NO: 6917 - protein, 10 aa, Artificial Sequence
  Synthetic Peptide
GEIPFYGKAI

SEQ ID NO: 6918 - protein, 9 aa, Artificial Sequence
  Synthetic Peptide
GQIVGGVYL

SEQ ID NO: 6919 - protein, 11 aa, Artificial Sequence
  Synthetic Peptide
IEANLLWRQEM

SEQ ID NO: 6920 - protein, 9 aa, Artificial Sequence
  Synthetic Peptide
LEDRDRSEL

SEQ ID NO: 6921 - protein, 8 aa, Artificial Sequence
  Synthetic Peptide
LEVVTSTW

SEQ ID NO: 6922 - protein, 9 aa, Artificial Sequence
  Synthetic Peptide
LEVVTSTWV

SEQ ID NO: 6923 - protein, 10 aa, Artificial Sequence
  Synthetic Peptide
LEVVTSTWVL

SEQ ID NO: 6924 - protein, 11 aa, Artificial Sequence
  Synthetic Peptide
LEVVTSTWVLV

SEQ ID NO: 6925 - protein, 8 aa, Artificial Sequence
  Synthetic Peptide
SELSPLLL

SEQ ID NO: 6926 - protein, 9 aa, Artificial Sequence
  Synthetic Peptide
TEAMTRYSA

SEQ ID NO: 6927 - protein, 9 aa, Artificial Sequence
  Synthetic Peptide
VDFSLDPTF

SEQ ID NO: 6928 - protein, 11 aa, Artificial Sequence
  Synthetic Peptide
VDFSLDPTFTI

SEQ ID NO: 6929 - protein, 8 aa, Artificial Sequence
  Synthetic Peptide
VDYPYRLW

SEQ ID NO: 6930 - protein, 8 aa, Artificial Sequence
  Synthetic Peptide
AEHLKTAV

SEQ ID NO: 6931 - protein, 10 aa, Artificial Sequence
  Synthetic Peptide
AEHLKTAVQM

SEQ ID NO: 6932 - protein, 11 aa, Artificial Sequence
  Synthetic Peptide
AEHLKTAVQMA

SEQ ID NO: 6933 - protein, 11 aa, Artificial Sequence
  Synthetic Peptide
AELELAENREI

SEQ ID NO: 6934 - protein, 10 aa, Artificial Sequence
  Synthetic Peptide
AENLWVTVYY

SEQ ID NO: 6935 - protein, 9 aa, Artificial Sequence
  Synthetic Peptide
AETFYVDGA

SEQ ID NO: 6936 - protein, 9 aa, Artificial Sequence
  Synthetic Peptide
AETFYVDGA

SEQ ID NO: 6937 - protein, 8 aa, Artificial Sequence
  Synthetic Peptide
AETGQETA

SEQ ID NO: 6938 - protein, 10 aa, Artificial Sequence
  Synthetic Peptide
AETGQETAYF

SEQ ID NO: 6939 - protein, 9 aa, Artificial Sequence
  Synthetic Peptide
EEKAFSPEV

SEQ ID NO: 6940 - protein, 10 aa, Artificial Sequence
  Synthetic Peptide
EEKAFSPEVI

SEQ ID NO: 6941 - protein, 10 aa, Artificial Sequence
  Synthetic Peptide
EEMMTACQGV

SEQ ID NO: 6942 - protein, 9 aa, Artificial Sequence
  Synthetic Peptide
GDAYFSVPL

SEQ ID NO: 6943 - protein, 8 aa, Artificial Sequence
  Synthetic Peptide
GEAMHGQV

SEQ ID NO: 6944 - protein, 8 aa, Artificial Sequence
  Synthetic Peptide
IEAEVIPA

SEQ ID NO: 6945 - protein, 8 aa, Artificial Sequence
  Synthetic Peptide
IEAQQHLL

SEQ ID NO: 6946 - protein, 8 aa, Artificial Sequence
  Synthetic Peptide
IETVPVKL

SEQ ID NO: 6947 - protein, 8 aa, Artificial Sequence
  Synthetic Peptide
KDCTERQA

SEQ ID NO: 6948 - protein, 10 aa, Artificial Sequence
  Synthetic Peptide
KEPPFLWMGY

SEQ ID NO: 6949 - protein, 10 aa, Artificial Sequence
  Synthetic Peptide
LELAENREIL

SEQ ID NO: 6950 - protein, 8 aa, Artificial Sequence
  Synthetic Peptide
NEQVDKLV

SEQ ID NO: 6951 - protein, 8 aa, Artificial Sequence
  Synthetic Peptide
NETPGIRY

SEQ ID NO: 6952 - protein, 10 aa, Artificial Sequence
  Synthetic Peptide
NETPGIRYQY

SEQ ID NO: 6953 - protein, 8 aa, Artificial Sequence
  Synthetic Peptide
QDFWEVQL

SEQ ID NO: 6954 - protein, 9 aa, Artificial Sequence
  Synthetic Peptide
RDYVDRFYK

SEQ ID NO: 6955 - protein, 9 aa, Artificial Sequence
  Synthetic Peptide
REPRGSDIA

SEQ ID NO: 6956 - protein, 8 aa, Artificial Sequence
  Synthetic Peptide
SELYKYKV

SEQ ID NO: 6957 - protein, 9 aa, Artificial Sequence
  Synthetic Peptide
SELYKYKVV

SEQ ID NO: 6958 - protein, 10 aa, Artificial Sequence
  Synthetic Peptide
TDSQYALGII

SEQ ID NO: 6959 - protein, 8 aa, Artificial Sequence
  Synthetic Peptide
TEEKIKAL

SEQ ID NO: 6960 - protein, 8 aa, Artificial Sequence
  Synthetic Peptide
TERQANFL

SEQ ID NO: 6961 - protein, 9 aa, Artificial Sequence
  Synthetic Peptide
WEFVNTPPL

SEQ ID NO: 6962 - protein, 10 aa, Artificial Sequence
  Synthetic Peptide
WEFVNTPPLV

SEQ ID NO: 6963 - protein, 11 aa, Artificial Sequence
  Synthetic Peptide
WEVQLGIPHPA

SEQ ID NO: 6964 - protein, 8 aa, Artificial Sequence
  Synthetic Peptide
YELHPDKW

SEQ ID NO: 6965 - protein, 10 aa, Artificial Sequence
  Synthetic Peptide
YELHPDKWTV

SEQ ID NO: 6966 - protein, 10 aa, Artificial Sequence
  Synthetic Peptide
AEDLRTLQQL

SEQ ID NO: 6967 - protein, 10 aa, Artificial Sequence
  Synthetic Peptide
AEPDTSNYNI

SEQ ID NO: 6968 - protein, 9 aa, Artificial Sequence
  Synthetic Peptide
AEPQRHTML

SEQ ID NO: 6969 - protein, 9 aa, Artificial Sequence
  Synthetic Peptide
AEQATSNYY

SEQ ID NO: 6970 - protein, 10 aa, Artificial Sequence
  Synthetic Peptide
AEQATSNYYI

SEQ ID NO: 6971 - protein, 10 aa, Artificial Sequence
  Synthetic Peptide
AERPRKLHEL

SEQ ID NO: 6972 - protein, 9 aa, Artificial Sequence
  Synthetic Peptide
CEARIELVV

SEQ ID NO: 6973 - protein, 9 aa, Artificial Sequence
  Synthetic Peptide
CECKFVVQL

SEQ ID NO: 6974 - protein, 9 aa, Artificial Sequence
  Synthetic Peptide
DELRLNCVY

SEQ ID NO: 6975 - protein, 10 aa, Artificial Sequence
  Synthetic Peptide
EEKPRTLHDL

SEQ ID NO: 6976 - protein, 9 aa, Artificial Sequence
  Synthetic Peptide
EENDEADGV

SEQ ID NO: 6977 - protein, 9 aa, Artificial Sequence
  Synthetic Peptide
EENDEIDGV

SEQ ID NO: 6978 - protein, 9 aa, Artificial Sequence
  Synthetic Peptide
EESVHEIRL

SEQ ID NO: 6979 - protein, 9 aa, Artificial Sequence
  Synthetic Peptide
FEDPTRRPY

SEQ ID NO: 6980 - protein, 10 aa, Artificial Sequence
  Synthetic Peptide
FEFAFKDLFV

SEQ ID NO: 6981 - protein, 9 aa, Artificial Sequence
  Synthetic Peptide
HELSSALEI

SEQ ID NO: 6982 - protein, 10 aa, Artificial Sequence
  Synthetic Peptide
KEDLRVVQQL

SEQ ID NO: 6983 - protein, 9 aa, Artificial Sequence
  Synthetic Peptide
KELQRREVY

SEQ ID NO: 6984 - protein, 9 aa, Artificial Sequence
  Synthetic Peptide
KELTRAEVY

SEQ ID NO: 6985 - protein, 10 aa, Artificial Sequence
  Synthetic Peptide
LECVYCKQQL

SEQ ID NO: 6986 - protein, 9 aa, Artificial Sequence
  Synthetic Peptide
LEERVKKPL

SEQ ID NO: 6987 - protein, 10 aa, Artificial Sequence
  Synthetic Peptide
LEESVHEIRL

SEQ ID NO: 6988 - protein, 10 aa, Artificial Sequence
  Synthetic Peptide
LEIPLIDLRL

SEQ ID NO: 6989 - protein, 10 aa, Artificial Sequence
  Synthetic Peptide
LEIPYDELRL

SEQ ID NO: 6990 - protein, 9 aa, Artificial Sequence
  Synthetic Peptide
LEKLTNKGI

SEQ ID NO: 6991 - protein, 10 aa, Artificial Sequence
  Synthetic Peptide
LEKLTNTGLY

SEQ ID NO: 6992 - protein, 9 aa, Artificial Sequence
  Synthetic Peptide
LELTPQTEI

SEQ ID NO: 6993 - protein, 9 aa, Artificial Sequence
  Synthetic Peptide
LEQTLKKCL

SEQ ID NO: 6994 - protein, 9 aa, Artificial Sequence
  Synthetic Peptide
LEQTVKKPL

SEQ ID NO: 6995 - protein, 9 aa, Artificial Sequence
  Synthetic Peptide
LERTEVYQF

SEQ ID NO: 6996 - protein, 9 aa, Artificial Sequence
  Synthetic Peptide
LESITKKQL

SEQ ID NO: 6997 - protein, 10 aa, Artificial Sequence
  Synthetic Peptide
LETSVHEIEL

SEQ ID NO: 6998 - protein, 10 aa, Artificial Sequence
  Synthetic Peptide
LETTIHNIEL

SEQ ID NO: 6999 - protein, 9 aa, Artificial Sequence
  Synthetic Peptide
NEILIRCII

SEQ ID NO: 7000 - protein, 9 aa, Artificial Sequence
  Synthetic Peptide
NEILIRCII

SEQ ID NO: 7001 - protein, 9 aa, Artificial Sequence
  Synthetic Peptide
NEKRRFHNI

SEQ ID NO: 7002 - protein, 9 aa, Artificial Sequence
  Synthetic Peptide
NELDPVDLL

SEQ ID NO: 7003 - protein, 9 aa, Artificial Sequence
  Synthetic Peptide
PEATDLHCY

SEQ ID NO: 7004 - protein, 9 aa, Artificial Sequence
  Synthetic Peptide
PEPTDLFCY

SEQ ID NO: 7005 - protein, 9 aa, Artificial Sequence
  Synthetic Peptide
QEKKRHVDL

SEQ ID NO: 7006 - protein, 9 aa, Artificial Sequence
  Synthetic Peptide
QEKKRHVDL

SEQ ID NO: 7007 - protein, 10 aa, Artificial Sequence
  Synthetic Peptide
QELLMGSFGI

SEQ ID NO: 7008 - protein, 10 aa, Artificial Sequence
  Synthetic Peptide
QERPRKLPQL

SEQ ID NO: 7009 - protein, 10 aa, Artificial Sequence
  Synthetic Peptide
QERPRSLHHL

SEQ ID NO: 7010 - protein, 10 aa, Artificial Sequence
  Synthetic Peptide
RELRHYSDSV

SEQ ID NO: 7011 - protein, 10 aa, Artificial Sequence
  Synthetic Peptide
RELRYYSNSV

SEQ ID NO: 7012 - protein, 9 aa, Artificial Sequence
  Synthetic Peptide
RETLQEIVL

SEQ ID NO: 7013 - protein, 10 aa, Artificial Sequence
  Synthetic Peptide
SEFRWYRYSV

SEQ ID NO: 7014 - protein, 9 aa, Artificial Sequence
  Synthetic Peptide
SEITIRCII

SEQ ID NO: 7015 - protein, 9 aa, Artificial Sequence
  Synthetic Peptide
SEVLEIPLI

SEQ ID NO: 7016 - protein, 10 aa, Artificial Sequence
  Synthetic Peptide
SEYRHYCYSL

SEQ ID NO: 7017 - protein, 10 aa, Artificial Sequence
  Synthetic Peptide
SEYRHYNYSL

SEQ ID NO: 7018 - protein, 10 aa, Artificial Sequence
  Synthetic Peptide
SEYRHYNYSV

SEQ ID NO: 7019 - protein, 10 aa, Artificial Sequence
  Synthetic Peptide
SEYRHYQYSL

SEQ ID NO: 7020 - protein, 10 aa, Artificial Sequence
  Synthetic Peptide
TELNTSLQDI

SEQ ID NO: 7021 - protein, 10 aa, Artificial Sequence
  Synthetic Peptide
TETEVLDFAF

SEQ ID NO: 7022 - protein, 10 aa, Artificial Sequence
  Synthetic Peptide
AEDLYGRLEI

SEQ ID NO: 7023 - protein, 9 aa, Artificial Sequence
  Synthetic Peptide
DEFKPIVQY

SEQ ID NO: 7024 - protein, 9 aa, Artificial Sequence
  Synthetic Peptide
DEIKYREEV

SEQ ID NO: 7025 - protein, 10 aa, Artificial Sequence
  Synthetic Peptide
DELSEDITKY

SEQ ID NO: 7026 - protein, 10 aa, Artificial Sequence
  Synthetic Peptide
DENANANNAV

SEQ ID NO: 7027 - protein, 9 aa, Artificial Sequence
  Synthetic Peptide
DEVDLYLLM

SEQ ID NO: 7028 - protein, 10 aa, Artificial Sequence
  Synthetic Peptide
EENIGIYKEL

SEQ ID NO: 7029 - protein, 10 aa, Artificial Sequence
  Synthetic Peptide
EEVCNDEVDL

SEQ ID NO: 7030 - protein, 10 aa, Artificial Sequence
  Synthetic Peptide
GEPAPFDETL

SEQ ID NO: 7031 - protein, 10 aa, Artificial Sequence
  Synthetic Peptide
GEPLIDVHDL

SEQ ID NO: 7032 - protein, 10 aa, Artificial Sequence
  Synthetic Peptide
KEGKLIEHII

SEQ ID NO: 7033 - protein, 10 aa, Artificial Sequence
  Synthetic Peptide
KEKEKFIKSL

SEQ ID NO: 7034 - protein, 9 aa, Artificial Sequence
  Synthetic Peptide
KEKFIKSLF

SEQ ID NO: 7035 - protein, 10 aa, Artificial Sequence
  Synthetic Peptide
LDEFKPIVQY

SEQ ID NO: 7036 - protein, 10 aa, Artificial Sequence
  Synthetic Peptide
LEEKAAKETL

SEQ ID NO: 7037 - protein, 9 aa, Artificial Sequence
  Synthetic Peptide
LETVNISDV

SEQ ID NO: 7038 - protein, 9 aa, Artificial Sequence
  Synthetic Peptide
NDEVDLYLL

SEQ ID NO: 7039 - protein, 10 aa, Artificial Sequence
  Synthetic Peptide
NDEVDLYLLM

SEQ ID NO: 7040 - protein, 10 aa, Artificial Sequence
  Synthetic Peptide
NDIEKKICKM

SEQ ID NO: 7041 - protein, 10 aa, Artificial Sequence
  Synthetic Peptide
NELNYDNAGI

SEQ ID NO: 7042 - protein, 9 aa, Artificial Sequence
  Synthetic Peptide
QDEENIGIY

SEQ ID NO: 7043 - protein, 10 aa, Artificial Sequence
  Synthetic Peptide
QDSLKESRKL

SEQ ID NO: 7044 - protein, 9 aa, Artificial Sequence
  Synthetic Peptide
QERLANEKL

SEQ ID NO: 7045 - protein, 9 aa, Artificial Sequence
  Synthetic Peptide
QERRAKEKL

SEQ ID NO: 7046 - protein, 9 aa, Artificial Sequence
  Synthetic Peptide
RENANQLVV

SEQ ID NO: 7047 - protein, 9 aa, Artificial Sequence
  Synthetic Peptide
SDLEQDRLA

SEQ ID NO: 7048 - protein, 9 aa, Artificial Sequence
  Synthetic Peptide
SEELSEEKI

SEQ ID NO: 7049 - protein, 9 aa, Artificial Sequence
  Synthetic Peptide
SEKEVPSDV

SEQ ID NO: 7050 - protein, 9 aa, Artificial Sequence
  Synthetic Peptide
SENERGYYI

SEQ ID NO: 7051 - protein, 9 aa, Artificial Sequence
  Synthetic Peptide
SESNGEPNA

SEQ ID NO: 7052 - protein, 9 aa, Artificial Sequence
  Synthetic Peptide
WDEWSPCSV

SEQ ID NO: 7053 - protein, 9 aa, Artificial Sequence
  Synthetic Peptide
YEDEISAEY

SEQ ID NO: 7054 - protein, 9 aa, Artificial Sequence
  Synthetic Peptide
YEKTKDNNF

SEQ ID NO: 7055 - protein, 9 aa, Artificial Sequence
  Synthetic Peptide
YENDIEKKI

SEQ ID NO: 7056 - protein, 9 aa, Artificial Sequence
  Synthetic Peptide
SESPIVVVL

SEQ ID NO: 7057 - protein, 9 aa, Artificial Sequence
  Synthetic Peptide
AEEAAGIGI

SEQ ID NO: 7058 - protein, 10 aa, Artificial Sequence
  Synthetic Peptide
AEEAAGIGIL

SEQ ID NO: 7059 - protein, 11 aa, Artificial Sequence
  Synthetic Peptide
AEEAAGIGILT

SEQ ID NO: 7060 - protein, 9 aa, Artificial Sequence
  Synthetic Peptide
AEIGEVIVL

SEQ ID NO: 7061 - protein, 10 aa, Artificial Sequence
  Synthetic Peptide
AEIGEVIVLW

SEQ ID NO: 7062 - protein, 11 aa, Artificial Sequence
  Synthetic Peptide
AEIGEVIVLWL

SEQ ID NO: 7063 - protein, 9 aa, Artificial Sequence
  Synthetic Peptide
AEIPGEIAL

SEQ ID NO: 7064 - protein, 10 aa, Artificial Sequence
  Synthetic Peptide
AEVDKVTGRF

SEQ ID NO: 7065 - protein, 9 aa, Artificial Sequence
  Synthetic Peptide
DEAPAVISY

SEQ ID NO: 7066 - protein, 9 aa, Artificial Sequence
  Synthetic Peptide
DEFIGVAIY

SEQ ID NO: 7067 - protein, 9 aa, Artificial Sequence
  Synthetic Peptide
DENPLVKQY

SEQ ID NO: 7068 - protein, 9 aa, Artificial Sequence
  Synthetic Peptide
DEVGIVTKY

SEQ ID NO: 7069 - protein, 10 aa, Artificial Sequence
  Synthetic Peptide
DEVPDLERKY

SEQ ID NO: 7070 - protein, 9 aa, Artificial Sequence
  Synthetic Peptide
EEFQFIKKA

SEQ ID NO: 7071 - protein, 9 aa, Artificial Sequence
  Synthetic Peptide
EEFYVDLER

SEQ ID NO: 7072 - protein, 9 aa, Artificial Sequence
  Synthetic Peptide
EEKLIVVAF

SEQ ID NO: 7073 - protein, 9 aa, Artificial Sequence
  Synthetic Peptide
EEKLIVVLF

SEQ ID NO: 7074 - protein, 9 aa, Artificial Sequence
  Synthetic Peptide
FEIPLLDVA

SEQ ID NO: 7075 - protein, 9 aa, Artificial Sequence
  Synthetic Peptide
FEPTVVKKY

SEQ ID NO: 7076 - protein, 9 aa, Artificial Sequence
  Synthetic Peptide
GEFGGFGSV

SEQ ID NO: 7077 - protein, 9 aa, Artificial Sequence
  Synthetic Peptide
GEFIPGNDL

SEQ ID NO: 7078 - protein, 9 aa, Artificial Sequence
  Synthetic Peptide
GEFPGKIFL

SEQ ID NO: 7079 - protein, 10 aa, Artificial Sequence
  Synthetic Peptide
GEFPGKIFLY

SEQ ID NO: 7080 - protein, 11 aa, Artificial Sequence
  Synthetic Peptide
GEFPGKIFLYA

SEQ ID NO: 7081 - protein, 9 aa, Artificial Sequence
  Synthetic Peptide
GEFPNKNIL

SEQ ID NO: 7082 - protein, 10 aa, Artificial Sequence
  Synthetic Peptide
GEFPNKNILY

SEQ ID NO: 7083 - protein, 11 aa, Artificial Sequence
  Synthetic Peptide
GEFPNKNILYA

SEQ ID NO: 7084 - protein, 8 aa, Artificial Sequence
  Synthetic Peptide
GEFSITYK

SEQ ID NO: 7085 - protein, 8 aa, Artificial Sequence
  Synthetic Peptide
GEFVDLYV

SEQ ID NO: 7086 - protein, 9 aa, Artificial Sequence
  Synthetic Peptide
GEHGLIIRV

SEQ ID NO: 7087 - protein, 9 aa, Artificial Sequence
  Synthetic Peptide
GEILDVFDA

SEQ ID NO: 7088 - protein, 9 aa, Artificial Sequence
  Synthetic Peptide
GEVIVLWLW

SEQ ID NO: 7089 - protein, 10 aa, Artificial Sequence
  Synthetic Peptide
HEATLRCWAL

SEQ ID NO: 7090 - protein, 11 aa, Artificial Sequence
  Synthetic Peptide
IEVDPDTKEML

SEQ ID NO: 7091 - protein, 9 aa, Artificial Sequence
  Synthetic Peptide
KESTLHLVL

SEQ ID NO: 7092 - protein, 11 aa, Artificial Sequence
  Synthetic Peptide
KEVGVDVALYA

SEQ ID NO: 7093 - protein, 9 aa, Artificial Sequence
  Synthetic Peptide
MEVDPIGHL

SEQ ID NO: 7094 - protein, 10 aa, Artificial Sequence
  Synthetic Peptide
MEVDPIGHLY

SEQ ID NO: 7095 - protein, 9 aa, Artificial Sequence
  Synthetic Peptide
REIAQDFKT

SEQ ID NO: 7096 - protein, 10 aa, Artificial Sequence
  Synthetic Peptide
REIAQDFKTD

SEQ ID NO: 7097 - protein, 8 aa, Artificial Sequence
  Synthetic Peptide
REIIINAV

SEQ ID NO: 7098 - protein, 9 aa, Artificial Sequence
  Synthetic Peptide
REMIPFADI

SEQ ID NO: 7099 - protein, 9 aa, Artificial Sequence
  Synthetic Peptide
REPVTKAEM

SEQ ID NO: 7100 - protein, 9 aa, Artificial Sequence
  Synthetic Peptide
SEIDTVAKY

SEQ ID NO: 7101 - protein, 9 aa, Artificial Sequence
  Synthetic Peptide
SEIWRDIDF

SEQ ID NO: 7102 - protein, 9 aa, Artificial Sequence
  Synthetic Peptide
TEFPKERHL

SEQ ID NO: 7103 - protein, 9 aa, Artificial Sequence
  Synthetic Peptide
WEFLQPILL

SEQ ID NO: 7104 - protein, 9 aa, Artificial Sequence
  Synthetic Peptide
YEIHDGMNL

SEQ ID NO: 7105 - protein, 9 aa, Artificial Sequence
  Synthetic Peptide
FLLTRILTI

SEQ ID NO: 7106 - protein, 10 aa, Artificial Sequence
  Synthetic Peptide
FLPSDFFPSV

SEQ ID NO: 7107 - protein, 9 aa, Artificial Sequence
  Synthetic Peptide
GLYSSTVPV

SEQ ID NO: 7108 - protein, 9 aa, Artificial Sequence
  Synthetic Peptide
EADPTGHSY

SEQ ID NO: 7109 - protein, 9 aa, Artificial Sequence
  Synthetic Peptide
VLVHPQWVL

SEQ ID NO: 7110 - protein, 10 aa, Artificial Sequence
  Synthetic Peptide
FLPSDYFPSV

SEQ ID NO: 7111 - protein, 9 aa, Artificial Sequence
  Synthetic Peptide
ILLWDPIPV

SEQ ID NO: 7112 - protein, 10 aa, Artificial Sequence
  Synthetic Peptide
KLQCVDLVHI

SEQ ID NO: 7113 - protein, 11 aa, Artificial Sequence
  Synthetic Peptide
MLLRLSEPAEL

SEQ ID NO: 7114 - protein, 15 aa, Artificial Sequence
  Synthetic Peptide
FPDWQNYTPGPGIRY

SEQ ID NO: 7115 - protein, 15 aa, Artificial Sequence
  Synthetic Peptide
FPDWQNYTPGPGTRF

SEQ ID NO: 7116 - protein, 15 aa, Artificial Sequence
  Synthetic Peptide
GFPVRPQVPLRPMTY

SEQ ID NO: 7117 - protein, 15 aa, Artificial Sequence
  Synthetic Peptide
GGKWSKSSIVGWPAI

SEQ ID NO: 7118 - protein, 15 aa, Artificial Sequence
  Synthetic Peptide
GPGIRYPLTFGWCFK

SEQ ID NO: 7119 - protein, 15 aa, Artificial Sequence
  Synthetic Peptide
HGAITSSNTAATNAD

SEQ ID NO: 7120 - protein, 15 aa, Artificial Sequence
  Synthetic Peptide
ILDLWVYHTQGFFPD

SEQ ID NO: 7121 - protein, 15 aa, Artificial Sequence
  Synthetic Peptide
ILDLWVYHTQGYFPD

SEQ ID NO: 7122 - protein, 15 aa, Artificial Sequence
  Synthetic Peptide
NNCLLHPMSQHGMDD

SEQ ID NO: 7123 - protein, 15 aa, Artificial Sequence
  Synthetic Peptide
NNSLLHPICQHGMED

SEQ ID NO: 7124 - protein, 15 aa, Artificial Sequence
  Synthetic Peptide
RFPLTFGWCFKLVPV

SEQ ID NO: 7125 - protein, 15 aa, Artificial Sequence
  Synthetic Peptide
RPQVPLRPMTYKGAF

SEQ ID NO: 7126 - protein, 15 aa, Artificial Sequence
  Synthetic Peptide
RQDILDLWVYHTQGY

SEQ ID NO: 7127 - protein, 15 aa, Artificial Sequence
  Synthetic Peptide
RQDILDLWVYNTQGY

SEQ ID NO: 7128 - protein, 15 aa, Artificial Sequence
  Synthetic Peptide
RQEILDLWVYHTQGF

SEQ ID NO: 7129 - protein, 15 aa, Artificial Sequence
  Synthetic Peptide
RQEILDLWVYHTQGY

SEQ ID NO: 7130 - protein, 15 aa, Artificial Sequence
  Synthetic Peptide
RYPLTFGWCFKLVPV

SEQ ID NO: 7131 - protein, 15 aa, Artificial Sequence
  Synthetic Peptide
SRDLEKHGAITSSNT

SEQ ID NO: 7132 - protein, 15 aa, Artificial Sequence
  Synthetic Peptide
TFGWCFKLVPVDPRE

SEQ ID NO: 7133 - protein, 15 aa, Artificial Sequence
  Synthetic Peptide
AEPVPLQLPPLERLT

SEQ ID NO: 7134 - protein, 15 aa, Artificial Sequence
  Synthetic Peptide
IKFLYQSNPPPSPEG

SEQ ID NO: 7135 - protein, 15 aa, Artificial Sequence
  Synthetic Peptide
LKAVRIIKILYQSNP

SEQ ID NO: 7136 - protein, 15 aa, Artificial Sequence
  Synthetic Peptide
PVPLQLPPLERLTLD

SEQ ID NO: 7137 - protein, 15 aa, Artificial Sequence
  Synthetic Peptide
LEPWKHPGSQPKTAC

SEQ ID NO: 7138 - protein, 15 aa, Artificial Sequence
  Synthetic Peptide
LEPWNHPGSQPKTAC

SEQ ID NO: 7139 - protein, 15 aa, Artificial Sequence
  Synthetic Peptide
LEPWNHPGSQPRTPC

SEQ ID NO: 7140 - protein, 15 aa, Artificial Sequence
  Synthetic Peptide
LEPWNHPGSQPTTAC

SEQ ID NO: 7141 - protein, 15 aa, Artificial Sequence
  Synthetic Peptide
NNCYCKKCCFHCQVC

SEQ ID NO: 7142 - protein, 15 aa, Artificial Sequence
  Synthetic Peptide
QLCFLKKGLGISYGR

SEQ ID NO: 7143 - protein, 15 aa, Artificial Sequence
  Synthetic Peptide
QVCFITKGLGISYGR

SEQ ID NO: 7144 - protein, 15 aa, Artificial Sequence
  Synthetic Peptide
QVCFLNKGLGISYGR

SEQ ID NO: 7145 - protein, 15 aa, Artificial Sequence
  Synthetic Peptide
TNCYCKKCCYHCQVC

SEQ ID NO: 7146 - protein, 15 aa, Artificial Sequence
  Synthetic Peptide
LDGLIYSKKRQEILD

SEQ ID NO: 7147 - protein, 15 aa, Artificial Sequence
  Synthetic Peptide
LSFFLKEKGGLDGLI

SEQ ID NO: 7148 - protein, 15 aa, Artificial Sequence
  Synthetic Peptide
LSHFLKEKGGLEGLI

SEQ ID NO: 7149 - protein, 15 aa, Artificial Sequence
  Synthetic Peptide
QDAVSQDLDKCGAAA

SEQ ID NO: 7150 - protein, 15 aa, Artificial Sequence
  Synthetic Peptide
TQGFFPDWQNYTPGP

SEQ ID NO: 7151 - protein, 15 aa, Artificial Sequence
  Synthetic Peptide
TQGYFPDWQNYTPGP

SEQ ID NO: 7152 - protein, 15 aa, Artificial Sequence
  Synthetic Peptide
TRQARKNRRRRWRAR

SEQ ID NO: 7153 - protein, 15 aa, Artificial Sequence
  Synthetic Peptide
TRQARRNRRRRWRAR

SEQ ID NO: 7154 - protein, 15 aa, Artificial Sequence
  Synthetic Peptide
TRQARRNRRRRWRER

SEQ ID NO: 7155 - protein, 15 aa, Artificial Sequence
  Synthetic Peptide
KEKVERETETDPAVQ

SEQ ID NO: 7156 - protein, 15 aa, Artificial Sequence
  Synthetic Peptide
LWWVNNESLPVSPRL

SEQ ID NO: 7157 - protein, 16 aa, Artificial Sequence
  Synthetic Peptide
IRNLALQTLPAMCNVY

SEQ ID NO: 7158 - protein, 16 aa, Artificial Sequence
  Synthetic Peptide
VQQQQFLGQQQPFPPQ

SEQ ID NO: 7159 - protein, 12 aa, Artificial Sequence
  Synthetic Peptide
QFLGQQQPFPPQ

SEQ ID NO: 7160 - protein, 25 aa, Artificial Sequence
  Synthetic Peptide
MDIDPYKEFGATVELLSFLPSDFFP

SEQ ID NO: 7161 - protein, 15 aa, Artificial Sequence
  Synthetic Peptide
LPETTVVRCRGRSPR

SEQ ID NO: 7162 - protein, 15 aa, Artificial Sequence
  Synthetic Peptide
TNMGLKFRQLLWFHI

SEQ ID NO: 7163 - protein, 15 aa, Artificial Sequence
  Synthetic Peptide
TNVGLKFRQLLWFHI

SEQ ID NO: 7164 - protein, 6 aa, Artificial Sequence
  Synthetic Peptide
  VARIANT 1, 2, 3, 4, 5, 6: Xaa = Any Amino Acid
XXXXXX

SEQ ID NO: 7165 - protein, 15 aa, Artificial Sequence
  Synthetic Peptide
PEFLEQRRAAVDTYC

SEQ ID NO: 7166 - protein, 15 aa, Artificial Sequence
  Synthetic Peptide
MWDLVLSIALSVGCT

SEQ ID NO: 7167 - protein, 15 aa, Artificial Sequence
  Synthetic Peptide
NMSLLKHQSLRPDED

SEQ ID NO: 7168 - protein, 15 aa, Artificial Sequence
  Synthetic Peptide
SHDLMLLRLSEPAKI

SEQ ID NO: 7169 - protein, 15 aa, Artificial Sequence
  Synthetic Peptide
HDLMLLRLSEPAKIT

SEQ ID NO: 7170 - protein, 15 aa, Artificial Sequence
  Synthetic Peptide
PEEFLRPRSLQCVSL

SEQ ID NO: 7171 - protein, 15 aa, Artificial Sequence
  Synthetic Peptide
PRSLQCVSLHLLSND

SEQ ID NO: 7172 - protein, 15 aa, Artificial Sequence
  Synthetic Peptide
LHLLSNDMCARAYSE

SEQ ID NO: 7173 - protein, 15 aa, Artificial Sequence
  Synthetic Peptide
NGVLQGITSWGPEPC

SEQ ID NO: 7174 - protein, 15 aa, Artificial Sequence
  Synthetic Peptide
KPAVYTKVVHYRKWI

SEQ ID NO: 7175 - protein, 15 aa, Artificial Sequence
  Synthetic Peptide
DLVLSIALSVGCTGA

SEQ ID NO: 7176 - protein, 15 aa, Artificial Sequence
  Synthetic Peptide
HPQWVLTAAHCLKKN

SEQ ID NO: 7177 - protein, 15 aa, Artificial Sequence
  Synthetic Peptide
QWVLTAAHCLKKNSQ

SEQ ID NO: 7178 - protein, 15 aa, Artificial Sequence
  Synthetic Peptide
GQRVPVSHSFPHPLY

SEQ ID NO: 7179 - protein, 15 aa, Artificial Sequence
  Synthetic Peptide
RVPVSHSFPHPLYNM

SEQ ID NO: 7180 - protein, 15 aa, Artificial Sequence
  Synthetic Peptide
PHPLYNMSLLKHQSL

SEQ ID NO: 7181 - protein, 15 aa, Artificial Sequence
  Synthetic Peptide
HPLYNMSLLKHQSLR

SEQ ID NO: 7182 - protein, 15 aa, Artificial Sequence
  Synthetic Peptide
LVIPENAKEKPQEGT

SEQ ID NO: 7183 - protein, 15 aa, Artificial Sequence
  Synthetic Peptide
ENPVVHFFKNIVTPR

SEQ ID NO: 7184 - protein, 15 aa, Artificial Sequence
  Synthetic Peptide
ENPVVAFFKNIVTPR

SEQ ID NO: 7185 - protein, 15 aa, Artificial Sequence
  Synthetic Peptide
ENPVVHAFKNIVTPR

SEQ ID NO: 7186 - protein, 15 aa, Artificial Sequence
  Synthetic Peptide
ENPVVHFFANIVTPR

SEQ ID NO: 7187 - protein, 15 aa, Artificial Sequence
  Synthetic Peptide
ENPVVHFFKNIVTPA

SEQ ID NO: 7188 - protein, 12 aa, Artificial Sequence
  Synthetic Peptide
NPVVHFFKNIVT

SEQ ID NO: 7189 - protein, 14 aa, Artificial Sequence
  Synthetic Peptide
NPVVHFFKNIVTPR

SEQ ID NO: 7190 - protein, 14 aa, Artificial Sequence
  Synthetic Peptide
HFFKNIVTPRTPPY

SEQ ID NO: 7191 - protein, 15 aa, Artificial Sequence
  Synthetic Peptide
DRTLMSAMTNLAALF

SEQ ID NO: 7192 - protein, 15 aa, Artificial Sequence
  Synthetic Peptide
MSAMTNLAALFPPEG

SEQ ID NO: 7193 - protein, 15 aa, Artificial Sequence
  Synthetic Peptide
MTNLAALFPPEGVSI

SEQ ID NO: 7194 - protein, 15 aa, Artificial Sequence
  Synthetic Peptide
PEGVSIWNPILLWQP

SEQ ID NO: 7195 - protein, 15 aa, Artificial Sequence
  Synthetic Peptide
GVSIWNPILLWQPIP

SEQ ID NO: 7196 - protein, 15 aa, Artificial Sequence
  Synthetic Peptide
SLSLGFLFLLFFWLD

SEQ ID NO: 7197 - protein, 15 aa, Artificial Sequence
  Synthetic Peptide
WNPILLWQPIPVHTV

SEQ ID NO: 7198 - protein, 15 aa, Artificial Sequence
  Synthetic Peptide
NPILLWQPIPVHTVP

SEQ ID NO: 7199 - protein, 15 aa, Artificial Sequence
  Synthetic Peptide
PILLWQPIPVHTVPL

SEQ ID NO: 7200 - protein, 15 aa, Artificial Sequence
  Synthetic Peptide
ILLWQPIPVHTVPLS

SEQ ID NO: 7201 - protein, 15 aa, Artificial Sequence
  Synthetic Peptide
WQPIPVHTVPLSEDQ

SEQ ID NO: 7202 - protein, 15 aa, Artificial Sequence
  Synthetic Peptide
TVPLSEDQLLYLPFR

SEQ ID NO: 7203 - protein, 15 aa, Artificial Sequence
  Synthetic Peptide
LSGLHGQDLFGIWSK

SEQ ID NO: 7204 - protein, 15 aa, Artificial Sequence
  Synthetic Peptide
LLFFWLDRSVLAKEL

SEQ ID NO: 7205 - protein, 15 aa, Artificial Sequence
  Synthetic Peptide
YDPLYCESVHNFTLP

SEQ ID NO: 7206 - protein, 15 aa, Artificial Sequence
  Synthetic Peptide
LPSWATEDTMTKLRE

SEQ ID NO: 7207 - protein, 15 aa, Artificial Sequence
  Synthetic Peptide
LRELSELSLLSLYGI

SEQ ID NO: 7208 - protein, 15 aa, Artificial Sequence
  Synthetic Peptide
LSELSLLSLYGIHKQ

SEQ ID NO: 7209 - protein, 15 aa, Artificial Sequence
  Synthetic Peptide
LSLLSLYGIHKQKEK

SEQ ID NO: 7210 - protein, 15 aa, Artificial Sequence
  Synthetic Peptide
KSRLQGGVLVNEILN

SEQ ID NO: 7211 - protein, 15 aa, Artificial Sequence
  Synthetic Peptide
GGVLVNEILNHMKRA

SEQ ID NO: 7212 - protein, 15 aa, Artificial Sequence
  Synthetic Peptide
DRSVLAKELKFVTLV

SEQ ID NO: 7213 - protein, 15 aa, Artificial Sequence
  Synthetic Peptide
IPSYKKLIMYSAHDT

SEQ ID NO: 7214 - protein, 15 aa, Artificial Sequence
  Synthetic Peptide
YKKLIMYSAHDTTVS

SEQ ID NO: 7215 - protein, 15 aa, Artificial Sequence
  Synthetic Peptide
LIMYSAHDTTVSGLQ

SEQ ID NO: 7216 - protein, 15 aa, Artificial Sequence
  Synthetic Peptide
DTTVSGLQMALDVYN

SEQ ID NO: 7217 - protein, 15 aa, Artificial Sequence
  Synthetic Peptide
ALDVYNGLLPPYASC

SEQ ID NO: 7218 - protein, 15 aa, Artificial Sequence
  Synthetic Peptide
AAPLLLARAASLSLG

SEQ ID NO: 7219 - protein, 15 aa, Artificial Sequence
  Synthetic Peptide
LDVYNGLLPPYASCH

SEQ ID NO: 7220 - protein, 15 aa, Artificial Sequence
  Synthetic Peptide
YNGLLPPYASCHLTE

SEQ ID NO: 7221 - protein, 15 aa, Artificial Sequence
  Synthetic Peptide
LTELYFEKGEYFVEM

SEQ ID NO: 7222 - protein, 15 aa, Artificial Sequence
  Synthetic Peptide
AKELKFVTLVFRHGD

SEQ ID NO: 7223 - protein, 15 aa, Artificial Sequence
  Synthetic Peptide
FAELVGPVIPQDWST

SEQ ID NO: 7224 - protein, 15 aa, Artificial Sequence
  Synthetic Peptide
GPVIPQDWSTECMTT

SEQ ID NO: 7225 - protein, 15 aa, Artificial Sequence
  Synthetic Peptide
APLLLARAASLSLGF

SEQ ID NO: 7226 - protein, 15 aa, Artificial Sequence
  Synthetic Peptide
RSPIDTFPTDPIKES

SEQ ID NO: 7227 - protein, 15 aa, Artificial Sequence
  Synthetic Peptide
PLLLARAASLSLGFL

SEQ ID NO: 7228 - protein, 15 aa, Artificial Sequence
  Synthetic Peptide
FGQLTQLGMEQHYEL

SEQ ID NO: 7229 - protein, 20 aa, Artificial Sequence
  Synthetic Peptide
QKGRGYRGQHQAHSLERVCH

SEQ ID NO: 7230 - protein, 20 aa, Artificial Sequence
  Synthetic Peptide
SAVPVYIYFNTWTTCQSIAF

SEQ ID NO: 7231 - protein, 20 aa, Artificial Sequence
  Synthetic Peptide
WTTCQSIAFPSKTSASIGSL

SEQ ID NO: 7232 - protein, 18 aa, Artificial Sequence
  Synthetic Peptide
AATYNFAVLKLMGRGTKF

SEQ ID NO: 7233 - protein, 20 aa, Artificial Sequence
  Synthetic Peptide
FLYGALLLAEGFYTTGAVRQ

SEQ ID NO: 7234 - protein, 15 aa, Artificial Sequence
  Synthetic Peptide
SHDLMLLRLSEPAEL

SEQ ID NO: 7235 - protein, 15 aa, Artificial Sequence
  Synthetic Peptide
HDLMLLRLSEPAELT

SEQ ID NO: 7236 - protein, 15 aa, Artificial Sequence
  Synthetic Peptide
TDAVKVMDLPTQEPA

SEQ ID NO: 7237 - protein, 15 aa, Artificial Sequence
  Synthetic Peptide
LHVISNDVCAQVHPQ

SEQ ID NO: 7238 - protein, 15 aa, Artificial Sequence
  Synthetic Peptide
CAQVHPQKVTKFMLC

SEQ ID NO: 7239 - protein, 15 aa, Artificial Sequence
  Synthetic Peptide
GGPLVCNGVLQGITS

SEQ ID NO: 7240 - protein, 15 aa, Artificial Sequence
  Synthetic Peptide
GPLVCNGVLQGITSW

SEQ ID NO: 7241 - protein, 15 aa, Artificial Sequence
  Synthetic Peptide
NGVLQGITSWGSEPC

SEQ ID NO: 7242 - protein, 15 aa, Artificial Sequence
  Synthetic Peptide
RPSLYTKVVHYRKWI

SEQ ID NO: 7243 - protein, 15 aa, Artificial Sequence
  Synthetic Peptide
SQPWQVLVASRGRAV

SEQ ID NO: 7244 - protein, 15 aa, Artificial Sequence
  Synthetic Peptide
GRAVCGGVLVHPQWV

SEQ ID NO: 7245 - protein, 15 aa, Artificial Sequence
  Synthetic Peptide
GVLVHPQWVLTAAHC

SEQ ID NO: 7246 - protein, 15 aa, Artificial Sequence
  Synthetic Peptide
TLSVTWIGAAPLILS

SEQ ID NO: 7247 - protein, 15 aa, Artificial Sequence
  Synthetic Peptide
HPQWVLTAAHCIRNK

SEQ ID NO: 7248 - protein, 15 aa, Artificial Sequence
  Synthetic Peptide
QWVLTAAHCIRNKSV

SEQ ID NO: 7249 - protein, 15 aa, Artificial Sequence
  Synthetic Peptide
AHCIRNKSVILLGRH

SEQ ID NO: 7250 - protein, 15 aa, Artificial Sequence
  Synthetic Peptide
SVILLGRHSLFHPED

SEQ ID NO: 7251 - protein, 15 aa, Artificial Sequence
  Synthetic Peptide
VILLGRHSLFHPEDT

SEQ ID NO: 7252 - protein, 15 aa, Artificial Sequence
  Synthetic Peptide
SVTWIGAAPLILSRI

SEQ ID NO: 7253 - protein, 15 aa, Artificial Sequence
  Synthetic Peptide
HSLFHPEDTGQVFQV

SEQ ID NO: 7254 - protein, 15 aa, Artificial Sequence
  Synthetic Peptide
VTWIGAAPLILSRIV

SEQ ID NO: 7255 - protein, 15 aa, Artificial Sequence
  Synthetic Peptide
GQVFQVSHSFPHPLY

SEQ ID NO: 7256 - protein, 15 aa, Artificial Sequence
  Synthetic Peptide
VFQVSHSFPHPLYDM

SEQ ID NO: 7257 - protein, 15 aa, Artificial Sequence
  Synthetic Peptide
PHPLYDMSLLKNRFL

SEQ ID NO: 7258 - protein, 15 aa, Artificial Sequence
  Synthetic Peptide
WKEFGLDSVELAHYD

SEQ ID NO: 7259 - protein, 15 aa, Artificial Sequence
  Synthetic Peptide
LAHYDVLLSYPNKTH

SEQ ID NO: 7260 - protein, 15 aa, Artificial Sequence
  Synthetic Peptide
YISIINEDGNEIFNT

SEQ ID NO: 7261 - protein, 15 aa, Artificial Sequence
  Synthetic Peptide
ISIINEDGNEIFNTS

SEQ ID NO: 7262 - protein, 15 aa, Artificial Sequence
  Synthetic Peptide
GNEIFNTSLFEPPPP

SEQ ID NO: 7263 - protein, 15 aa, Artificial Sequence
  Synthetic Peptide
PRWLCAGALVLAGGF

SEQ ID NO: 7264 - protein, 15 aa, Artificial Sequence
  Synthetic Peptide
EDFFKLERDMKINCS

SEQ ID NO: 7265 - protein, 15 aa, Artificial Sequence
  Synthetic Peptide
FFKLERDMKINCSGK

SEQ ID NO: 7266 - protein, 15 aa, Artificial Sequence
  Synthetic Peptide
GKVFRGNKVKNAQLA

SEQ ID NO: 7267 - protein, 15 aa, Artificial Sequence
  Synthetic Peptide
GNKVKNAQLAGAKGV

SEQ ID NO: 7268 - protein, 15 aa, Artificial Sequence
  Synthetic Peptide
GVILYSDPADYFAPG

SEQ ID NO: 7269 - protein, 15 aa, Artificial Sequence
  Synthetic Peptide
EYAYRRGIAEAVGLP

SEQ ID NO: 7270 - protein, 15 aa, Artificial Sequence
  Synthetic Peptide
AEAVGLPSIPVHPIG

SEQ ID NO: 7271 - protein, 15 aa, Artificial Sequence
  Synthetic Peptide
AVGLPSIPVHPIGYY

SEQ ID NO: 7272 - protein, 15 aa, Artificial Sequence
  Synthetic Peptide
IGYYDAQKLLEKMGG

SEQ ID NO: 7273 - protein, 15 aa, Artificial Sequence
  Synthetic Peptide
TGNFSTQKVKMHIHS

SEQ ID NO: 7274 - protein, 15 aa, Artificial Sequence
  Synthetic Peptide
LGFLFGWFIKSSNEA

SEQ ID NO: 7275 - protein, 15 aa, Artificial Sequence
  Synthetic Peptide
TRIYNVIGTLRGAVE

SEQ ID NO: 7276 - protein, 15 aa, Artificial Sequence
  Synthetic Peptide
GAAVVHEIVRSFGTL

SEQ ID NO: 7277 - protein, 15 aa, Artificial Sequence
  Synthetic Peptide
NSRLLQERGVAYINA

SEQ ID NO: 7278 - protein, 15 aa, Artificial Sequence
  Synthetic Peptide
ERGVAYINADSSIEG

SEQ ID NO: 7279 - protein, 15 aa, Artificial Sequence
  Synthetic Peptide
GVAYINADSSIEGNY

SEQ ID NO: 7280 - protein, 15 aa, Artificial Sequence
  Synthetic Peptide
VAYINADSSIEGNYT

SEQ ID NO: 7281 - protein, 15 aa, Artificial Sequence
  Synthetic Peptide
DSSIEGNYTLRVDCT

SEQ ID NO: 7282 - protein, 15 aa, Artificial Sequence
  Synthetic Peptide
NYTLRVDCTPLMYSL

SEQ ID NO: 7283 - protein, 15 aa, Artificial Sequence
  Synthetic Peptide
CTPLMYSLVHNLTKE

SEQ ID NO: 7284 - protein, 15 aa, Artificial Sequence
  Synthetic Peptide
DFEVFFQRLGIASGR

SEQ ID NO: 7285 - protein, 15 aa, Artificial Sequence
  Synthetic Peptide
EVFFQRLGIASGRAR

SEQ ID NO: 7286 - protein, 15 aa, Artificial Sequence
  Synthetic Peptide
TNKFSGYPLYHSVYE

SEQ ID NO: 7287 - protein, 15 aa, Artificial Sequence
  Synthetic Peptide
YDPMFKYHLTVAQVR

SEQ ID NO: 7288 - protein, 15 aa, Artificial Sequence
  Synthetic Peptide
DPMFKYHLTVAQVRG

SEQ ID NO: 7289 - protein, 15 aa, Artificial Sequence
  Synthetic Peptide
MFKYHLTVAQVRGGM

SEQ ID NO: 7290 - protein, 15 aa, Artificial Sequence
  Synthetic Peptide
KYHLTVAQVRGGMVF

SEQ ID NO: 7291 - protein, 15 aa, Artificial Sequence
  Synthetic Peptide
VAQVRGGMVFELANS

SEQ ID NO: 7292 - protein, 15 aa, Artificial Sequence
  Synthetic Peptide
RGGMVFELANSIVLP

SEQ ID NO: 7293 - protein, 15 aa, Artificial Sequence
  Synthetic Peptide
GMVFELANSIVLPFD

SEQ ID NO: 7294 - protein, 15 aa, Artificial Sequence
  Synthetic Peptide
VFELANSIVLPFDCR

SEQ ID NO: 7295 - protein, 15 aa, Artificial Sequence
  Synthetic Peptide
ADKIYSISMKHPQEM

SEQ ID NO: 7296 - protein, 15 aa, Artificial Sequence
  Synthetic Peptide
IYSISMKHPQEMKTY

SEQ ID NO: 7297 - protein, 15 aa, Artificial Sequence
  Synthetic Peptide
PQEMKTYSVSFDSLF

SEQ ID NO: 7298 - protein, 15 aa, Artificial Sequence
  Synthetic Peptide
LDELKAENIKKFLYN

SEQ ID NO: 7299 - protein, 15 aa, Artificial Sequence
  Synthetic Peptide
TYSVSFDSLFSAVKN

SEQ ID NO: 7300 - protein, 15 aa, Artificial Sequence
  Synthetic Peptide
VLRMMNDQLMFLERA

SEQ ID NO: 7301 - protein, 15 aa, Artificial Sequence
  Synthetic Peptide
LRMMNDQLMFLERAF

SEQ ID NO: 7302 - protein, 15 aa, Artificial Sequence
  Synthetic Peptide
DQLMFLERAFIDPLG

SEQ ID NO: 7303 - protein, 15 aa, Artificial Sequence
  Synthetic Peptide
YRHVIYAPSSHNKYA

SEQ ID NO: 7304 - protein, 15 aa, Artificial Sequence
  Synthetic Peptide
RHVIYAPSSHNKYAG

SEQ ID NO: 7305 - protein, 15 aa, Artificial Sequence
  Synthetic Peptide
IKKFLYNFTQIPHLA

SEQ ID NO: 7306 - protein, 15 aa, Artificial Sequence
  Synthetic Peptide
KFLYNFTQIPHLAGT

SEQ ID NO: 7307 - protein, 15 aa, Artificial Sequence
  Synthetic Peptide
RQIYVAAFTVQAAAE

SEQ ID NO: 7308 - protein, 15 aa, Artificial Sequence
  Synthetic Peptide
QIYVAAFTVQAAAET

SEQ ID NO: 7309 - protein, 15 aa, Artificial Sequence
  Synthetic Peptide
VAAFTVQAAAETLSE

SEQ ID NO: 7310 - protein, 20 aa, Artificial Sequence
  Synthetic Peptide
PATLIKAIDGDTVKLMYKGQ

SEQ ID NO: 7311 - protein, 20 aa, Artificial Sequence
  Synthetic Peptide
HEQHLRKSEAQAKKEKLNIW

SEQ ID NO: 7312 - protein, 20 aa, Artificial Sequence
  Synthetic Peptide
TPETKHPKKGVEKYGPEASA

SEQ ID NO: 7313 - protein, 20 aa, Artificial Sequence
  Synthetic Peptide
VEKYGPEASAFTKKMVENAK

SEQ ID NO: 7314 - protein, 20 aa, Artificial Sequence
  Synthetic Peptide
FTKKMVENAKKIEVEFDKGQ

SEQ ID NO: 7315 - protein, 20 aa, Artificial Sequence
  Synthetic Peptide
YIYADGKMVNEALVRQGLAK

SEQ ID NO: 7316 - protein, 14 aa, Artificial Sequence
  Synthetic Peptide
AAWSERAGEAMVLV

SEQ ID NO: 7317 - protein, 12 aa, Artificial Sequence
  Synthetic Peptide
DNVLDHLTGRSC

SEQ ID NO: 7318 - protein, 13 aa, Artificial Sequence
  Synthetic Peptide
DNVLAHLTGRSCQ

SEQ ID NO: 7319 - protein, 13 aa, Artificial Sequence
  Synthetic Peptide
DNVLDHLTGRSAQ

SEQ ID NO: 7320 - protein, 13 aa, Artificial Sequence
  Synthetic Peptide
DNVLDHLTGRSCA

SEQ ID NO: 7321 - protein, 16 aa, Artificial Sequence
  Synthetic Peptide
HYTVDKSKPKVYQWRD

SEQ ID NO: 7322 - protein, 16 aa, Artificial Sequence
  Synthetic Peptide
INTKCYKLEHPVTGCG

SEQ ID NO: 7323 - protein, 16 aa, Artificial Sequence
  Synthetic Peptide
NELGRFKHTDACCRTH

SEQ ID NO: 7324 - protein, 16 aa, Artificial Sequence
  Synthetic Peptide
NNDFYDNSADTISSYF

SEQ ID NO: 7325 - protein, 14 aa, Artificial Sequence
  Synthetic Peptide
SKPKVYQWFDLRKY

SEQ ID NO: 7326 - protein, 16 aa, Artificial Sequence
  Synthetic Peptide
SSYFVGKMYFNLINTK

SEQ ID NO: 7327 - protein, 24 aa, Artificial Sequence
  Synthetic Peptide
PDTRPAPGSTAPPAHGVTSAPDTR

SEQ ID NO: 7328 - protein, 16 aa, Artificial Sequence
  Synthetic Peptide
ALPVFTWLALYFTSAK

SEQ ID NO: 7329 - protein, 16 aa, Artificial Sequence
  Synthetic Peptide
ALYFTSAKIPQEWKPA

SEQ ID NO: 7330 - protein, 16 aa, Artificial Sequence
  Synthetic Peptide
FATSFLIPLTSQFFLP

SEQ ID NO: 7331 - protein, 16 aa, Artificial Sequence
  Synthetic Peptide
GLFCRWSYTEIEKIDI

SEQ ID NO: 7332 - protein, 16 aa, Artificial Sequence
  Synthetic Peptide
GLFSRWSYTEIEKIDI

SEQ ID NO: 7333 - protein, 16 aa, Artificial Sequence
  Synthetic Peptide
IGGAMLSLTVFEFTKY

SEQ ID NO: 7334 - protein, 16 aa, Artificial Sequence
  Synthetic Peptide
IKLPIILAFATSFLIP

SEQ ID NO: 7335 - protein, 16 aa, Artificial Sequence
  Synthetic Peptide
IMEVLFLSWLFPRFKF

SEQ ID NO: 7336 - protein, 16 aa, Artificial Sequence
  Synthetic Peptide
LTNNDQVSGINEEDEE

SEQ ID NO: 7337 - protein, 17 aa, Artificial Sequence
  Synthetic Peptide
MMASSILRSKIIQKPYQ

SEQ ID NO: 7338 - protein, 16 aa, Artificial Sequence
  Synthetic Peptide
PSLHSGSSIMEVLFLS

SEQ ID NO: 7339 - protein, 16 aa, Artificial Sequence
  Synthetic Peptide
SSIIFGAFPSLHSGSS

SEQ ID NO: 7340 - protein, 16 aa, Artificial Sequence
  Synthetic Peptide
VSILFFVFVVFPASFF

SEQ ID NO: 7341 - protein, 15 aa, Artificial Sequence
  Synthetic Peptide
IAKITPDNNGTYACF

SEQ ID NO: 7342 - protein, 15 aa, Artificial Sequence
  Synthetic Peptide
IPNITVDNSGSYTCQ

SEQ ID NO: 7343 - protein, 15 aa, Artificial Sequence
  Synthetic Peptide
IQNIIQDDTGFYTLH

SEQ ID NO: 7344 - protein, 15 aa, Artificial Sequence
  Synthetic Peptide
LFNVTRDDARAYVCG

SEQ ID NO: 7345 - protein, 15 aa, Artificial Sequence
  Synthetic Peptide
LFNVTRDDTASYKCE

SEQ ID NO: 7346 - protein, 15 aa, Artificial Sequence
  Synthetic Peptide
LLSVTRDDVGPYECG

SEQ ID NO: 7347 - protein, 15 aa, Artificial Sequence
  Synthetic Peptide
LWWVNNESLPVSPRL

SEQ ID NO: 7348 - protein, 15 aa, Artificial Sequence
  Synthetic Peptide
LWWVNNESLPVSPRL

SEQ ID NO: 7349 - protein, 15 aa, Artificial Sequence
  Synthetic Peptide
QELFIPDITVNNSGS

SEQ ID NO: 7350 - protein, 15 aa, Artificial Sequence
  Synthetic Peptide
QELFISDITEKNSGL

SEQ ID NO: 7351 - protein, 15 aa, Artificial Sequence
  Synthetic Peptide
REIIYPDASLLIQNI

SEQ ID NO: 7352 - protein, 15 aa, Artificial Sequence
  Synthetic Peptide
SCHAASDPPAQYSWF

SEQ ID NO: 7353 - protein, 15 aa, Artificial Sequence
  Synthetic Peptide
TITVYADPPKPFITS

SEQ ID NO: 7354 - protein, 15 aa, Artificial Sequence
  Synthetic Peptide
VLLLVHDLPQHLFGY

SEQ ID NO: 7355 - protein, 15 aa, Artificial Sequence
  Synthetic Peptide
YACFVSDLATGRNNS

SEQ ID NO: 7356 - protein, 25 aa, Artificial Sequence
  Synthetic Peptide
PTTTPITTTTTVTPTPTPTGTQTYC

SEQ ID NO: 7357 - protein, 11 aa, Artificial Sequence
  Synthetic Peptide
YIAFLKQATAK

SEQ ID NO: 7358 - protein, 10 aa, Artificial Sequence
  Synthetic Peptide
FLRRIRPKLK

SEQ ID NO: 7359 - protein, 11 aa, Artificial Sequence
  Synthetic Peptide
GFLRRIRPKLK

SEQ ID NO: 7360 - protein, 9 aa, Artificial Sequence
  Synthetic Peptide
LRRIRPKLK

SEQ ID NO: 7361 - protein, 13 aa, Artificial Sequence
  Synthetic Peptide
YGGFLRRIRPKLK

SEQ ID NO: 7362 - protein, 15 aa, Artificial Sequence
  Synthetic Peptide
DDNGPQDPDNTDDNG

SEQ ID NO: 7363 - protein, 13 aa, Artificial Sequence
  Synthetic Peptide
PYYTGEHAKAIGN

SEQ ID NO: 7364 - protein, 20 aa, Artificial Sequence
  Synthetic Peptide
FPQPQLPYSQPQPFRPQQPY

SEQ ID NO: 7365 - protein, 16 aa, Artificial Sequence
  Synthetic Peptide
IPPYCTIAPFGIFGIN

SEQ ID NO: 7366 - protein, 16 aa, Artificial Sequence
  Synthetic Peptide
IRNLALQTLPAMCNVY

SEQ ID NO: 7367 - protein, 20 aa, Artificial Sequence
  Synthetic Peptide
LGQQQPFPPQQPYPQPQPFP

SEQ ID NO: 7368 - protein, 20 aa, Artificial Sequence
  Synthetic Peptide
LHQQQKQQQQPSSQVSFQQP

SEQ ID NO: 7369 - protein, 20 aa, Artificial Sequence
  Synthetic Peptide
LLQELCCQHLWQIPEQSQCQ

SEQ ID NO: 7370 - protein, 20 aa, Artificial Sequence
  Synthetic Peptide
LQQHNIAHGRSQVLQQSTYQ

SEQ ID NO: 7371 - protein, 12 aa, Artificial Sequence
  Synthetic Peptide
PQPFRPQQPYPQ

SEQ ID NO: 7372 - protein, 16 aa, Artificial Sequence
  Synthetic Peptide
PQPFRPQQPYPQPQPQ

SEQ ID NO: 7373 - protein, 20 aa, Artificial Sequence
  Synthetic Peptide
PQPFRPQQPYPQPQPQYSQP

SEQ ID NO: 7374 - protein, 20 aa, Artificial Sequence
  Synthetic Peptide
PQPQPQYSQPQQPISQQQQQ

SEQ ID NO: 7375 - protein, 20 aa, Artificial Sequence
  Synthetic Peptide
PSSQVSFQQPLQQYPLGQGS

SEQ ID NO: 7376 - protein, 12 aa, Artificial Sequence
  Synthetic Peptide
QFEEIRNLALQT

SEQ ID NO: 7377 - protein, 16 aa, Artificial Sequence
  Synthetic Peptide
QFEEIRNLALQTLPAM

SEQ ID NO: 7378 - protein, 20 aa, Artificial Sequence
  Synthetic Peptide
QFEEIRNLALQTLPAMCNVY

SEQ ID NO: 7379 - protein, 12 aa, Artificial Sequence
  Synthetic Peptide
QFLGQQQPFPPQ

SEQ ID NO: 7380 - protein, 20 aa, Artificial Sequence
  Synthetic Peptide
QGSVQPQQLPQFEEIRNLAL

SEQ ID NO: 7381 - protein, 20 aa, Artificial Sequence
  Synthetic Peptide
QNPSQQQPQEQVPLVQQQQF

SEQ ID NO: 7382 - protein, 20 aa, Artificial Sequence
  Synthetic Peptide
QPYPQPQPFPSQQPYLQLQP

SEQ ID NO: 7383 - protein, 20 aa, Artificial Sequence
  Synthetic Peptide
QQLIFCMDVVLQQHNIAHGR

SEQ ID NO: 7384 - protein, 12 aa, Artificial Sequence
  Synthetic Peptide
QVPLVQQQQFLG

SEQ ID NO: 7385 - protein, 16 aa, Artificial Sequence
  Synthetic Peptide
QVPLVQQQQFLGQQQP

SEQ ID NO: 7386 - protein, 20 aa, Artificial Sequence
  Synthetic Peptide
QVPLVQQQQFLGQQQPFPPQ

SEQ ID NO: 7387 - protein, 20 aa, Artificial Sequence
  Synthetic Peptide
SQQPYLQLQPFPQPQLPYSQ

SEQ ID NO: 7388 - protein, 16 aa, Artificial Sequence
  Synthetic Peptide
VQQQQFLGQQQPFPPQ

SEQ ID NO: 7389 - protein, 20 aa, Artificial Sequence
  Synthetic Peptide
VRVPVPQLQPQNPSQQQPQE

SEQ ID NO: 7390 - protein, 17 aa, Artificial Sequence
  Synthetic Peptide
YIPPYCTIAPFGIFGIN

SEQ ID NO: 7391 - protein, 21 aa, Artificial Sequence
  Synthetic Peptide
YPSSQVSFQQPLQQYPLGQGS

SEQ ID NO: 7392 - protein, 21 aa, Artificial Sequence
  Synthetic Peptide
YQGSVQPQQLPQFEEIRNLAL

SEQ ID NO: 7393 - protein, 22 aa, Artificial Sequence
  Synthetic Peptide
EKVPVSEVMGTTLAEMSTPEAT

SEQ ID NO: 7394 - protein, 19 aa, Artificial Sequence
  Synthetic Peptide
IYRRRLMKQDFSVPQLPHS

SEQ ID NO: 7395 - protein, 21 aa, Artificial Sequence
  Synthetic Peptide
KRCLLHLAVIGALLAVGATKV

SEQ ID NO: 7396 - protein, 22 aa, Artificial Sequence
  Synthetic Peptide
LCQPVLPSPACQLVLHQILKGG

SEQ ID NO: 7397 - protein, 22 aa, Artificial Sequence
  Synthetic Peptide
MTPAEVSIVVLSGTTAAQVTTT

SEQ ID NO: 7398 - protein, 22 aa, Artificial Sequence
  Synthetic Peptide
PGPVTAQVVLQAAIPLTSCGSS

SEQ ID NO: 7399 - protein, 23 aa, Artificial Sequence
  Synthetic Peptide
VSGLSIGTGRAMLGTHTMEVTVY

SEQ ID NO: 7400 - protein, 20 aa, Artificial Sequence
  Synthetic Peptide
VYVWKTTWGQYWQVLGGPVS

SEQ ID NO: 7401 - protein, 14 aa, Artificial Sequence
  Synthetic Peptide
WNRQLYPEWTEAQR

SEQ ID NO: 7402 - protein, 15 aa, Artificial Sequence
  Synthetic Peptide
AKRKTVTAMDVVYAL

SEQ ID NO: 7403 - protein, 24 aa, Artificial Sequence
  Synthetic Peptide
KRHRKVLRDNIQGITKPAIRRLAR

SEQ ID NO: 7404 - protein, 15 aa, Artificial Sequence
  Synthetic Peptide
KTVTAMDVVYALKRQ

SEQ ID NO: 7405 - protein, 15 aa, Artificial Sequence
  Synthetic Peptide
LRDNIQGITKPAIRR

SEQ ID NO: 7406 - protein, 15 aa, Artificial Sequence
  Synthetic Peptide
NIQGITKPAIRRLAR

SEQ ID NO: 7407 - protein, 24 aa, Artificial Sequence
  Synthetic Peptide
TYTEHAKRKTVTAMDVVYALKRQG

SEQ ID NO: 7408 - protein, 11 aa, Artificial Sequence
  Synthetic Peptide
KYVKQNTLKAT

SEQ ID NO: 7409 - protein, 13 aa, Artificial Sequence
  Synthetic Peptide
PKYVKQNTLKLAT

SEQ ID NO: 7410 - protein, 16 aa, Artificial Sequence
  Synthetic Peptide
AHAAHAAHAAHAAHAA

SEQ ID NO: 7411 - protein, 13 aa, Artificial Sequence
  Synthetic Peptide
PRYVRQNTLRATC

SEQ ID NO: 7412 - protein, 12 aa, Artificial Sequence
  Synthetic Peptide
CPKYVRSAKLRM

SEQ ID NO: 7413 - protein, 10 aa, Artificial Sequence
  Synthetic Peptide
GACPKYVKQN

SEQ ID NO: 7414 - protein, 12 aa, Artificial Sequence
  Synthetic Peptide
GACPKYVKQNTL

SEQ ID NO: 7415 - protein, 13 aa, Artificial Sequence
  Synthetic Peptide
GACPKYVKQNTLK

SEQ ID NO: 7416 - protein, 14 aa, Artificial Sequence
  Synthetic Peptide
GACPKYVKQNTLKL

SEQ ID NO: 7417 - protein, 12 aa, Artificial Sequence
  Synthetic Peptide
HNTNGVTAASSH

SEQ ID NO: 7418 - protein, 12 aa, Artificial Sequence
  Synthetic Peptide
KQNTLKLATGMR

SEQ ID NO: 7419 - protein, 18 aa, Artificial Sequence
  Synthetic Peptide
LAKQNTLAKQNTLAKQNT

SEQ ID NO: 7420 - protein, 10 aa, Artificial Sequence
  Synthetic Peptide
NTLKLATGMR

SEQ ID NO: 7421 - protein, 11 aa, Artificial Sequence
  Synthetic Peptide
PYVKQNTLKAT

SEQ ID NO: 7422 - protein, 13 aa, Artificial Sequence
  Synthetic Peptide
PFFVKQNILKLAT

SEQ ID NO: 7423 - protein, 13 aa, Artificial Sequence
  Synthetic Peptide
PFFVKQNTLKLAT

SEQ ID NO: 7424 - protein, 13 aa, Artificial Sequence
  Synthetic Peptide
PFIVKQNTLKLAT

SEQ ID NO: 7425 - protein, 13 aa, Artificial Sequence
  Synthetic Peptide
PFYVKQNTLKLAT

SEQ ID NO: 7426 - protein, 13 aa, Artificial Sequence
  Synthetic Peptide
PIFVKQNILKLAT

SEQ ID NO: 7427 - protein, 13 aa, Artificial Sequence
  Synthetic Peptide
PIFVKQNTLKLAT

SEQ ID NO: 7428 - protein, 13 aa, Artificial Sequence
  Synthetic Peptide
PIIVKQNTLKLAT

SEQ ID NO: 7429 - protein, 13 aa, Artificial Sequence
  Synthetic Peptide
PIYVKQNTLKLAT

SEQ ID NO: 7430 - protein, 11 aa, Artificial Sequence
  Synthetic Peptide
PKVKQNTLKAT

SEQ ID NO: 7431 - protein, 11 aa, Artificial Sequence
  Synthetic Peptide
PKVKQNTLKAT

SEQ ID NO: 7432 - protein, 12 aa, Artificial Sequence
  Synthetic Peptide
PKVKQNTLKLAT

SEQ ID NO: 7433 - protein, 13 aa, Artificial Sequence
  Synthetic Peptide
PKAVKQNTLKLAT

SEQ ID NO: 7434 - protein, 13 aa, Artificial Sequence
  Synthetic Peptide
PKEVKQNTLKLAT

SEQ ID NO: 7435 - protein, 13 aa, Artificial Sequence
  Synthetic Peptide
PKFQVETTKKLAT

SEQ ID NO: 7436 - protein, 13 aa, Artificial Sequence
  Synthetic Peptide
PKIVKQNTLKLAT

SEQ ID NO: 7437 - protein, 13 aa, Artificial Sequence
  Synthetic Peptide
PKKVKQNTLKLAT

SEQ ID NO: 7438 - protein, 13 aa, Artificial Sequence
  Synthetic Peptide
PKQVKQNTLKLAT

SEQ ID NO: 7439 - protein, 13 aa, Artificial Sequence
  Synthetic Peptide
PKSVKQNTLKLAT

SEQ ID NO: 7440 - protein, 13 aa, Artificial Sequence
  Synthetic Peptide
PKTVKQNTLKLAT

SEQ ID NO: 7441 - protein, 11 aa, Artificial Sequence
  Synthetic Peptide
PKYKQNTLKAT

SEQ ID NO: 7442 - protein, 12 aa, Artificial Sequence
  Synthetic Peptide
PKYKQNTLKLAT

SEQ ID NO: 7443 - protein, 11 aa, Artificial Sequence
  Synthetic Peptide
PKYVQNTLKAT

SEQ ID NO: 7444 - protein, 11 aa, Artificial Sequence
  Synthetic Peptide
PKYVQNTLKAT

SEQ ID NO: 7445 - protein, 12 aa, Artificial Sequence
  Synthetic Peptide
PKYVQNTLKLAT

SEQ ID NO: 7446 - protein, 11 aa, Artificial Sequence
  Synthetic Peptide
PKYVKNTLKAT

SEQ ID NO: 7447 - protein, 11 aa, Artificial Sequence
  Synthetic Peptide
PKYVKNTLKAT

SEQ ID NO: 7448 - protein, 13 aa, Artificial Sequence
  Synthetic Peptide
PKYVKKNTLKLAT

SEQ ID NO: 7449 - protein, 11 aa, Artificial Sequence
  Synthetic Peptide
PKYVKQTLKAT

SEQ ID NO: 7450 - protein, 11 aa, Artificial Sequence
  Synthetic Peptide
PKYVKQTLKAT

SEQ ID NO: 7451 - protein, 12 aa, Artificial Sequence
  Synthetic Peptide
PKYVKQTLKLAT

SEQ ID NO: 7452 - protein, 11 aa, Artificial Sequence
  Synthetic Peptide
PKYVKQNLKAT

SEQ ID NO: 7453 - protein, 11 aa, Artificial Sequence
  Synthetic Peptide
PKYVKQNLKAT

SEQ ID NO: 7454 - protein, 12 aa, Artificial Sequence
  Synthetic Peptide
PKYVKQNLKLAT

SEQ ID NO: 7455 - protein, 12 aa, Artificial Sequence
  Synthetic Peptide
PKYVKQNLKLAT

SEQ ID NO: 7456 - protein, 12 aa, Artificial Sequence
  Synthetic Peptide
PKYVKQNLKLAT

SEQ ID NO: 7457 - protein, 12 aa, Artificial Sequence
  Synthetic Peptide
PKYVKQNLKLAT

SEQ ID NO: 7458 - protein, 12 aa, Artificial Sequence
  Synthetic Peptide
PKYVKQNLKLAT

SEQ ID NO: 7459 - protein, 12 aa, Artificial Sequence
  Synthetic Peptide
PKYVKQNLKLAT

SEQ ID NO: 7460 - protein, 13 aa, Artificial Sequence
  Synthetic Peptide
PKYVKQNELKLAT

SEQ ID NO: 7461 - protein, 13 aa, Artificial Sequence
  Synthetic Peptide
PKYVKQNHLKLAT

SEQ ID NO: 7462 - protein, 13 aa, Artificial Sequence
  Synthetic Peptide
PKYVKQNILKLAT

SEQ ID NO: 7463 - protein, 13 aa, Artificial Sequence
  Synthetic Peptide
PKYVKQNKLKLAT

SEQ ID NO: 7464 - protein, 13 aa, Artificial Sequence
  Synthetic Peptide
PKYVKQNNLKLAT

SEQ ID NO: 7465 - protein, 13 aa, Artificial Sequence
  Synthetic Peptide
PKYVKQNPLKLAT

SEQ ID NO: 7466 - protein, 13 aa, Artificial Sequence
  Synthetic Peptide
PKYVKQNQLKLAT

SEQ ID NO: 7467 - protein, 11 aa, Artificial Sequence
  Synthetic Peptide
PKYVKQNTKAT

SEQ ID NO: 7468 - protein, 11 aa, Artificial Sequence
  Synthetic Peptide
PKYVKQNTKAT

SEQ ID NO: 7469 - protein, 12 aa, Artificial Sequence
  Synthetic Peptide
PKYVKQNTKLAT

SEQ ID NO: 7470 - protein, 13 aa, Artificial Sequence
  Synthetic Peptide
PKYVKQNTKKLAT

SEQ ID NO: 7471 - protein, 11 aa, Artificial Sequence
  Synthetic Peptide
PKYVKQNTLAT

SEQ ID NO: 7472 - protein, 11 aa, Artificial Sequence
  Synthetic Peptide
PKYVKQNTLAT

SEQ ID NO: 7473 - protein, 12 aa, Artificial Sequence
  Synthetic Peptide
PKYVKQNTLLAT

SEQ ID NO: 7474 - protein, 11 aa, Artificial Sequence
  Synthetic Peptide
PKYVKQNTLKT

SEQ ID NO: 7475 - protein, 12 aa, Artificial Sequence
  Synthetic Peptide
PKYVKQNTLKAT

SEQ ID NO: 7476 - protein, 13 aa, Artificial Sequence
  Synthetic Peptide
PKYVKQNTLKEAT

SEQ ID NO: 7477 - protein, 13 aa, Artificial Sequence
  Synthetic Peptide
PKYVKQNTNKLAT

SEQ ID NO: 7478 - protein, 13 aa, Artificial Sequence
  Synthetic Peptide
PKYVKQNYLKLAT

SEQ ID NO: 7479 - protein, 20 aa, Artificial Sequence
  Synthetic Peptide
RTLYQNVGTYVSVGTSTLNK

SEQ ID NO: 7480 - protein, 13 aa, Artificial Sequence
  Synthetic Peptide
VKQNTLKLATGMR

SEQ ID NO: 7481 - protein, 14 aa, Artificial Sequence
  Synthetic Peptide
YPKFQVETTKKLAT

SEQ ID NO: 7482 - protein, 14 aa, Artificial Sequence
  Synthetic Peptide
YPKFVKLNTKKLAT

SEQ ID NO: 7483 - protein, 14 aa, Artificial Sequence
  Synthetic Peptide
YPKFVKQRTLKLAT

SEQ ID NO: 7484 - protein, 14 aa, Artificial Sequence
  Synthetic Peptide
YPKFVKQRTLKLAT

SEQ ID NO: 7485 - protein, 14 aa, Artificial Sequence
  Synthetic Peptide
YPKFVKRNTLKLAT

SEQ ID NO: 7486 - protein, 14 aa, Artificial Sequence
  Synthetic Peptide
YPKYVKQRTLKLAT

SEQ ID NO: 7487 - protein, 14 aa, Artificial Sequence
  Synthetic Peptide
YPKYVKQRTLKLAT

SEQ ID NO: 7488 - protein, 14 aa, Artificial Sequence
  Synthetic Peptide
YPKYVKRNTLKLAT

SEQ ID NO: 7489 - protein, 14 aa, Artificial Sequence
  Synthetic Peptide
YPSFQVQTTLLLAT

SEQ ID NO: 7490 - protein, 15 aa, Artificial Sequence
  Synthetic Peptide
AAPFTQCGYPALMPL

SEQ ID NO: 7491 - protein, 12 aa, Artificial Sequence
  Synthetic Peptide
AILCWGELMTLA

SEQ ID NO: 7492 - protein, 13 aa, Artificial Sequence
  Synthetic Peptide
ALRQAILCWGELM

SEQ ID NO: 7493 - protein, 16 aa, Artificial Sequence
  Synthetic Peptide
ALRQAILCWGELMTLA

SEQ ID NO: 7494 - protein, 20 aa, Artificial Sequence
  Synthetic Peptide
GYRWMCLRRFIIFLFILLLC

SEQ ID NO: 7495 - protein, 19 aa, Artificial Sequence
  Synthetic Peptide
HHTALRQAILCWGELMTLA

SEQ ID NO: 7496 - protein, 18 aa, Artificial Sequence
  Synthetic Peptide
HTALRQAILCWGELMTLA

SEQ ID NO: 7497 - protein, 11 aa, Artificial Sequence
  Synthetic Peptide
ILCWGELMTLA

SEQ ID NO: 7498 - protein, 10 aa, Artificial Sequence
  Synthetic Peptide
LCWGELMTLA

SEQ ID NO: 7499 - protein, 15 aa, Artificial Sequence
  Synthetic Peptide
LPETTVVRCRGRSPR

SEQ ID NO: 7500 - protein, 15 aa, Artificial Sequence
  Synthetic Peptide
LRQAILCWGELMTLA

SEQ ID NO: 7501 - protein, 16 aa, Artificial Sequence
  Synthetic Peptide
LSTLPETTVVRRRGRS

SEQ ID NO: 7502 - protein, 19 aa, Artificial Sequence
  Synthetic Peptide
MDIDPYKEFGASVELLSFL

SEQ ID NO: 7503 - protein, 25 aa, Artificial Sequence
  Synthetic Peptide
MDIDPYKEFGASVELLSFLPSDFFP

SEQ ID NO: 7504 - protein, 19 aa, Artificial Sequence
  Synthetic Peptide
MDIDPYKEFGATVELLSFL

SEQ ID NO: 7505 - protein, 25 aa, Artificial Sequence
  Synthetic Peptide
MDIDPYKEFGATVELLSFLPSDFFP

SEQ ID NO: 7506 - protein, 25 aa, Artificial Sequence
  Synthetic Peptide
MDIDPYKEFGATVELLSFLPSDFFP

SEQ ID NO: 7507 - protein, 25 aa, Artificial Sequence
  Synthetic Peptide
MDIDPYKEFGATVQLLSFLPSDFFP

SEQ ID NO: 7508 - protein, 11 aa, Artificial Sequence
  Synthetic Peptide
MGLKFRQLLWF

SEQ ID NO: 7509 - protein, 18 aa, Artificial Sequence
  Synthetic Peptide
PFLLAQFTSAICSVVRRA

SEQ ID NO: 7510 - protein, 13 aa, Artificial Sequence
  Synthetic Peptide
PHHTALRQAILCW

SEQ ID NO: 7511 - protein, 14 aa, Artificial Sequence
  Synthetic Peptide
PHHTALRQAILCWG

SEQ ID NO: 7512 - protein, 15 aa, Artificial Sequence
  Synthetic Peptide
PHHTALRQAILCWGE

SEQ ID NO: 7513 - protein, 16 aa, Artificial Sequence
  Synthetic Peptide
PHHTALRQAILCWGEL

SEQ ID NO: 7514 - protein, 17 aa, Artificial Sequence
  Synthetic Peptide
PHHTALRQAILCWGELM

SEQ ID NO: 7515 - protein, 18 aa, Artificial Sequence
  Synthetic Peptide
PHHTALRQAILCWGELMT

SEQ ID NO: 7516 - protein, 19 aa, Artificial Sequence
  Synthetic Peptide
PHHTALRQAILCWGELMTL

SEQ ID NO: 7517 - protein, 27 aa, Artificial Sequence
  Synthetic Peptide
PLGFFPDHQLDPAFGANSNNPDWDFNP

SEQ ID NO: 7518 - protein, 13 aa, Artificial Sequence
  Synthetic Peptide
QAILCWGELMTLA

SEQ ID NO: 7519 - protein, 21 aa, Artificial Sequence
  Synthetic Peptide
RDLLDTASALYRREALESPEH

SEQ ID NO: 7520 - protein, 20 aa, Artificial Sequence
  Synthetic Peptide
RDLVVSYVNTNMGLKFRQLL

SEQ ID NO: 7521 - protein, 14 aa, Artificial Sequence
  Synthetic Peptide
RQAILCWGELMTLA

SEQ ID NO: 7522 - protein, 18 aa, Artificial Sequence
  Synthetic Peptide
RVRGLYFPAGGSSSGTVN

SEQ ID NO: 7523 - protein, 20 aa, Artificial Sequence
  Synthetic Peptide
SLDSWWTSLNFLGGTTVCLG

SEQ ID NO: 7524 - protein, 17 aa, Artificial Sequence
  Synthetic Peptide
TALRQAILCWGELMTLA

SEQ ID NO: 7525 - protein, 15 aa, Artificial Sequence
  Synthetic Peptide
TNMGLKFRQLLWFHI

SEQ ID NO: 7526 - protein, 15 aa, Artificial Sequence
  Synthetic Peptide
TNVGLKFRQLLWFHI

SEQ ID NO: 7527 - protein, 14 aa, Artificial Sequence
  Synthetic Peptide
TTVVRRRGRSPRRR

SEQ ID NO: 7528 - protein, 17 aa, Artificial Sequence
  Synthetic Peptide
VGAGAFGLGFTPPHGGL

SEQ ID NO: 7529 - protein, 12 aa, Artificial Sequence
  Synthetic Peptide
VSFGVWIRTPPA

SEQ ID NO: 7530 - protein, 21 aa, Artificial Sequence
  Synthetic Peptide
YPHHTALRQAILCWGELMTLA

SEQ ID NO: 7531 - protein, 20 aa, Artificial Sequence
  Synthetic Peptide
GPGEGAVQWMNRLIAFASRG

SEQ ID NO: 7532 - protein, 20 aa, Artificial Sequence
  Synthetic Peptide
GRHLIFCHSKRKCDELATKL

SEQ ID NO: 7533 - protein, 20 aa, Artificial Sequence
  Synthetic Peptide
LLFNILGGWVAAQLAAPGAA

SEQ ID NO: 7534 - protein, 16 aa, Artificial Sequence
  Synthetic Peptide
PAILSPGALVVGVVCA

SEQ ID NO: 7535 - protein, 10 aa, Artificial Sequence
  Synthetic Peptide
AFVAWRNRCK

SEQ ID NO: 7536 - protein, 10 aa, Artificial Sequence
  Synthetic Peptide
AWAAWRNRCK

SEQ ID NO: 7537 - protein, 10 aa, Artificial Sequence
  Synthetic Peptide
AWEAWRNRCK

SEQ ID NO: 7538 - protein, 10 aa, Artificial Sequence
  Synthetic Peptide
AWLAWRNRCK

SEQ ID NO: 7539 - protein, 10 aa, Artificial Sequence
  Synthetic Peptide
AWVAARNRCK

SEQ ID NO: 7540 - protein, 10 aa, Artificial Sequence
  Synthetic Peptide
AWVAFRNRCK

SEQ ID NO: 7541 - protein, 10 aa, Artificial Sequence
  Synthetic Peptide
AWVAQRNRCK

SEQ ID NO: 7542 - protein, 10 aa, Artificial Sequence
  Synthetic Peptide
AWVAWANRCK

SEQ ID NO: 7543 - protein, 10 aa, Artificial Sequence
  Synthetic Peptide
AWVAWENRCK

SEQ ID NO: 7544 - protein, 10 aa, Artificial Sequence
  Synthetic Peptide
AWVAWKNRCK

SEQ ID NO: 7545 - protein, 10 aa, Artificial Sequence
  Synthetic Peptide
AWVAWRARCK

SEQ ID NO: 7546 - protein, 10 aa, Artificial Sequence
  Synthetic Peptide
AWVAWRNACK

SEQ ID NO: 7547 - protein, 10 aa, Artificial Sequence
  Synthetic Peptide
AWVAWRNECK

SEQ ID NO: 7548 - protein, 10 aa, Artificial Sequence
  Synthetic Peptide
AWVAWRNKCK

SEQ ID NO: 7549 - protein, 10 aa, Artificial Sequence
  Synthetic Peptide
AWVAWRNRCA

SEQ ID NO: 7550 - protein, 10 aa, Artificial Sequence
  Synthetic Peptide
AWVAWRNRCK

SEQ ID NO: 7551 - protein, 10 aa, Artificial Sequence
  Synthetic Peptide
AWVAWRNRCK

SEQ ID NO: 7552 - protein, 10 aa, Artificial Sequence
  Synthetic Peptide
AWVAWRNRCR

SEQ ID NO: 7553 - protein, 10 aa, Artificial Sequence
  Synthetic Peptide
AWVAWRNREK

SEQ ID NO: 7554 - protein, 10 aa, Artificial Sequence
  Synthetic Peptide
AWVAWRNRKK

SEQ ID NO: 7555 - protein, 10 aa, Artificial Sequence
  Synthetic Peptide
AWVAWRNRQK

SEQ ID NO: 7556 - protein, 10 aa, Artificial Sequence
  Synthetic Peptide
AWVAWRNRVK

SEQ ID NO: 7557 - protein, 10 aa, Artificial Sequence
  Synthetic Peptide
AWVAWRQRCK

SEQ ID NO: 7558 - protein, 10 aa, Artificial Sequence
  Synthetic Peptide
AWVAWRVRCK

SEQ ID NO: 7559 - protein, 10 aa, Artificial Sequence
  Synthetic Peptide
AWVEWRNRCK

SEQ ID NO: 7560 - protein, 10 aa, Artificial Sequence
  Synthetic Peptide
AWVSWRNRCK

SEQ ID NO: 7561 - protein, 10 aa, Artificial Sequence
  Synthetic Peptide
AWVVWRNRCK

SEQ ID NO: 7562 - protein, 10 aa, Artificial Sequence
  Synthetic Peptide
EFVAAKAAQK

SEQ ID NO: 7563 - protein, 10 aa, Artificial Sequence
  Synthetic Peptide
EWVAWRNRCK

SEQ ID NO: 7564 - protein, 22 aa, Artificial Sequence
  Synthetic Peptide
LAAAMKRHGLDNYRGYSLGNWV

SEQ ID NO: 7565 - protein, 18 aa, Artificial Sequence
  Synthetic Peptide
RNRCKGTDVQAWIRGCRL

SEQ ID NO: 7566 - protein, 16 aa, Artificial Sequence
  Synthetic Peptide
SVNCAKKIVSDGNGMN

SEQ ID NO: 7567 - protein, 10 aa, Artificial Sequence
  Synthetic Peptide
SWVAWRNRCK

SEQ ID NO: 7568 - protein, 10 aa, Artificial Sequence
  Synthetic Peptide
VWVAWRNRCK

SEQ ID NO: 7569 - protein, 15 aa, Artificial Sequence
  Synthetic Peptide
WRNAKWRNAKWRNAK

SEQ ID NO: 7570 - protein, 22 aa, Artificial Sequence
  Synthetic Peptide
YRGYSLGNWVCAAKFESNFNTQ

SEQ ID NO: 7571 - protein, 15 aa, Artificial Sequence
  Synthetic Peptide
CWMIDSDCRPRFREL

SEQ ID NO: 7572 - protein, 15 aa, Artificial Sequence
  Synthetic Peptide
CYGLGMDHLREVRAV

SEQ ID NO: 7573 - protein, 15 aa, Artificial Sequence
  Synthetic Peptide
FRELVSDFSRMARDP

SEQ ID NO: 7574 - protein, 15 aa, Artificial Sequence
  Synthetic Peptide
IKWMALDSILRRRFT

SEQ ID NO: 7575 - protein, 15 aa, Artificial Sequence
  Synthetic Peptide
LALIHHDTHLCFVHT

SEQ ID NO: 7576 - protein, 15 aa, Artificial Sequence
  Synthetic Peptide
LTYLPTDASLSFLQD

SEQ ID NO: 7577 - protein, 15 aa, Artificial Sequence
  Synthetic Peptide
QMRILKDTELRKVKV

SEQ ID NO: 7578 - protein, 13 aa, Artificial Sequence
  Synthetic Peptide
SPYVSRLLGICLT

SEQ ID NO: 7579 - protein, 16 aa, Artificial Sequence
  Synthetic Peptide
VPIKWMALESILRRRF

SEQ ID NO: 7580 - protein, 15 aa, Artificial Sequence
  Synthetic Peptide
WDQLFRDPHQALLHT

SEQ ID NO: 7581 - protein, 12 aa, Artificial Sequence
  Synthetic Peptide
DRVHPVHAGPIA

SEQ ID NO: 7582 - protein, 14 aa, Artificial Sequence
  Synthetic Peptide
DRVHPVHAGPIAPG

SEQ ID NO: 7583 - protein, 16 aa, Artificial Sequence
  Synthetic Peptide
DRVHPVHAGPIAPGQM

SEQ ID NO: 7584 - protein, 18 aa, Artificial Sequence
  Synthetic Peptide
DRVHPVHAGPIAPGQMRE

SEQ ID NO: 7585 - protein, 20 aa, Artificial Sequence
  Synthetic Peptide
DRVHPVHAGPIAPGQMREPR

SEQ ID NO: 7586 - protein, 20 aa, Artificial Sequence
  Synthetic Peptide
DTEVHNVWATQACVPTDPNP

SEQ ID NO: 7587 - protein, 15 aa, Artificial Sequence
  Synthetic Peptide
EGLIHSQRRQDILDL

SEQ ID NO: 7588 - protein, 20 aa, Artificial Sequence
  Synthetic Peptide
EPFRDYVDRFYKTLRAEQAS

SEQ ID NO: 7589 - protein, 20 aa, Artificial Sequence
  Synthetic Peptide
IYKRWIILGLNKIVRMYSPV

SEQ ID NO: 7590 - protein, 20 aa, Artificial Sequence
  Synthetic Peptide
PKISFEPIPIHYCAPAGFAI

SEQ ID NO: 7591 - protein, 13 aa, Artificial Sequence
  Synthetic Peptide
TAATNAACAWLEA

SEQ ID NO: 7592 - protein, 20 aa, Artificial Sequence
  Synthetic Peptide
TNNPPIPVGEIYKRWIILGL

SEQ ID NO: 7593 - protein, 20 aa, Artificial Sequence
  Synthetic Peptide
VWGIKQLQARVLAVERYLKD

SEQ ID NO: 7594 - protein, 15 aa, Artificial Sequence
  Synthetic Peptide
AVQMAVFIHNFKRKG

SEQ ID NO: 7595 - protein, 15 aa, Artificial Sequence
  Synthetic Peptide
DQQLLGIWGCSGKLI

SEQ ID NO: 7596 - protein, 15 aa, Artificial Sequence
  Synthetic Peptide
DQSLKPCVKLTPLCV

SEQ ID NO: 7597 - protein, 15 aa, Artificial Sequence
  Synthetic Peptide
EDIISLWDQSLKPCV

SEQ ID NO: 7598 - protein, 16 aa, Artificial Sequence
  Synthetic Peptide
ERFAVNPGLLETSEGC

SEQ ID NO: 7599 - protein, 16 aa, Artificial Sequence
  Synthetic Peptide
GARASVLSGGELDKWE

SEQ ID NO: 7600 - protein, 16 aa, Artificial Sequence
  Synthetic Peptide
GGELDKWEKIRLRPGG

SEQ ID NO: 7601 - protein, 5 aa, Artificial Sequence
  Synthetic Peptide
  VARIANT 1, 2, 3, 4, 5: Xaa = Any Amino Acid
XXXXX

SEQ ID NO: 7602 - protein, 15 aa, Artificial Sequence
  Synthetic Peptide
IGGIGGFIKVRQYDQ

SEQ ID NO: 7603 - protein, 16 aa, Artificial Sequence
  Synthetic Peptide
ILKALGPAATLEEMMT

SEQ ID NO: 7604 - protein, 16 aa, Artificial Sequence
  Synthetic Peptide
INEEAAEWERVHPVHA

SEQ ID NO: 7605 - protein, 15 aa, Artificial Sequence
  Synthetic Peptide
IQKLVGKLNWASQIY

SEQ ID NO: 7606 - protein, 15 aa, Artificial Sequence
  Synthetic Peptide
ISLWDQSLKPCVKLT

SEQ ID NO: 7607 - protein, 16 aa, Artificial Sequence
  Synthetic Peptide
IVWASRELERFAVNPG

SEQ ID NO: 7608 - protein, 16 aa, Artificial Sequence
  Synthetic Peptide
IYKRWIILGLNKIVRN

SEQ ID NO: 7609 - protein, 16 aa, Artificial Sequence
  Synthetic Peptide
KQIINMWQEVGKAMYA

SEQ ID NO: 7610 - protein, 16 aa, Artificial Sequence
  Synthetic Peptide
KVVEEKAFSPEVIPMF

SEQ ID NO: 7611 - protein, 16 aa, Artificial Sequence
  Synthetic Peptide
LGKIWPSYKGRPGNFL

SEQ ID NO: 7612 - protein, 16 aa, Artificial Sequence
  Synthetic Peptide
LKQIVKKLREQFGNNK

SEQ ID NO: 7613 - protein, 15 aa, Artificial Sequence
  Synthetic Peptide
LLGIWGCSGKLICTT

SEQ ID NO: 7614 - protein, 15 aa, Artificial Sequence
  Synthetic Peptide
LSIVNRVRQGYSPLS

SEQ ID NO: 7615 - protein, 16 aa, Artificial Sequence
  Synthetic Peptide
PIVQNLQGQMVHQAIS

SEQ ID NO: 7616 - protein, 16 aa, Artificial Sequence
  Synthetic Peptide
PLGVAPTKAKRRVVQR

SEQ ID NO: 7617 - protein, 16 aa, Artificial Sequence
  Synthetic Peptide
PSLQTGSEELRSLYNT

SEQ ID NO: 7618 - protein, 16 aa, Artificial Sequence
  Synthetic Peptide
QARILAVERYLKDQQL

SEQ ID NO: 7619 - protein, 15 aa, Artificial Sequence
  Synthetic Peptide
QGQWTYQIYQEPFKN

SEQ ID NO: 7620 - protein, 16 aa, Artificial Sequence
  Synthetic Peptide
QKQEPIDKELYPLTSL

SEQ ID NO: 7621 - protein, 15 aa, Artificial Sequence
  Synthetic Peptide
QMAVFIHNFKRKGGI

SEQ ID NO: 7622 - protein, 16 aa, Artificial Sequence
  Synthetic Peptide
RIQRGPGRAFVTIGKL

SEQ ID NO: 7623 - protein, 16 aa, Artificial Sequence
  Synthetic Peptide
RQILGQLQPSLQTGSE

SEQ ID NO: 7624 - protein, 16 aa, Artificial Sequence
  Synthetic Peptide
SLKPCVKLTPLCVTLN

SEQ ID NO: 7625 - protein, 16 aa, Artificial Sequence
  Synthetic Peptide
SLWDQSLKPCVKLTPL

SEQ ID NO: 7626 - protein, 15 aa, Artificial Sequence
  Synthetic Peptide
SQIIEQLIKKEKVYL

SEQ ID NO: 7627 - protein, 16 aa, Artificial Sequence
  Synthetic Peptide
SQNQQEKNEQELLELD

SEQ ID NO: 7628 - protein, 16 aa, Artificial Sequence
  Synthetic Peptide
SSGGDPEIVMHSFNCG

SEQ ID NO: 7629 - protein, 15 aa, Artificial Sequence
  Synthetic Peptide
STKWRKLVDFRELNK

SEQ ID NO: 7630 - protein, 17 aa, Artificial Sequence
  Synthetic Peptide
TITLPCRIKQFINMWQE

SEQ ID NO: 7631 - protein, 15 aa, Artificial Sequence
  Synthetic Peptide
TVYYGVPVWKEATTT

SEQ ID NO: 7632 - protein, 16 aa, Artificial Sequence
  Synthetic Peptide
VKIEPLGVAPTKAKRR

SEQ ID NO: 7633 - protein, 15 aa, Artificial Sequence
  Synthetic Peptide
VLSIVNRVRQGYSPL

SEQ ID NO: 7634 - protein, 15 aa, Artificial Sequence
  Synthetic Peptide
VNIVTDSQYALGIIQ

SEQ ID NO: 7635 - protein, 16 aa, Artificial Sequence
  Synthetic Peptide
WDQSLKPCVKLTPLCV

SEQ ID NO: 7636 - protein, 15 aa, Artificial Sequence
  Synthetic Peptide
WRKLVDFRELNKRTQ

SEQ ID NO: 7637 - protein, 6 aa, Artificial Sequence
  Synthetic Peptide
STRKSP

SEQ ID NO: 7638 - protein, 16 aa, Artificial Sequence
  Synthetic Peptide
APYTSTLLPPELSETP

SEQ ID NO: 7639 - protein, 15 aa, Artificial Sequence
  Synthetic Peptide
FRQLVHFVRDFAQLL

SEQ ID NO: 7640 - protein, 16 aa, Artificial Sequence
  Synthetic Peptide
SLKMADPNRFRGKDLP

SEQ ID NO: 7641 - protein, 16 aa, Artificial Sequence
  Synthetic Peptide
ACRVNHVTLSQPKIVK

SEQ ID NO: 7642 - protein, 16 aa, Artificial Sequence
  Synthetic Peptide
GKKIPKVEMSDMSFSK

SEQ ID NO: 7643 - protein, 16 aa, Artificial Sequence
  Synthetic Peptide
HPAENGKSNFLNCYVS

SEQ ID NO: 7644 - protein, 16 aa, Artificial Sequence
  Synthetic Peptide
HPPHIEIQMLKNGKKI

SEQ ID NO: 7645 - protein, 16 aa, Artificial Sequence
  Synthetic Peptide
IQKTPQIQVYSRHPPE

SEQ ID NO: 7646 - protein, 16 aa, Artificial Sequence
  Synthetic Peptide
IQMLKNGKKIPKVEMS

SEQ ID NO: 7647 - protein, 16 aa, Artificial Sequence
  Synthetic Peptide
IQRTPKIQVYSRHPAE

SEQ ID NO: 7648 - protein, 16 aa, Artificial Sequence
  Synthetic Peptide
IQVYSRHPPENGKPNI

SEQ ID NO: 7649 - protein, 16 aa, Artificial Sequence
  Synthetic Peptide
KPNILNCYVTQFHPPH

SEQ ID NO: 7650 - protein, 16 aa, Artificial Sequence
  Synthetic Peptide
SFSKDWSFYILAHTEF

SEQ ID NO: 7651 - protein, 16 aa, Artificial Sequence
  Synthetic Peptide
SFSYDWSFYLLYYTEF

SEQ ID NO: 7652 - protein, 16 aa, Artificial Sequence
  Synthetic Peptide
SFYLLYYTEFTPTEKD

SEQ ID NO: 7653 - protein, 16 aa, Artificial Sequence
  Synthetic Peptide
TETDTYACRVKHDSMA

SEQ ID NO: 7654 - protein, 16 aa, Artificial Sequence
  Synthetic Peptide
VEMSDMSFSKDWSFYI

SEQ ID NO: 7655 - protein, 21 aa, Artificial Sequence
  Synthetic Peptide
YGSDTITLPCRIKQFINMWQE

SEQ ID NO: 7656 - protein, 15 aa, Artificial Sequence
  Synthetic Peptide
PEFLEQRRAAVDTYC

SEQ ID NO: 7657 - protein, 14 aa, Artificial Sequence
  Synthetic Peptide
MRGSHHHHHHGSVD

SEQ ID NO: 7658 - protein, 20 aa, Artificial Sequence
  Synthetic Peptide
FVNQHLSGSHLVEALYLVSG

SEQ ID NO: 7659 - protein, 15 aa, Artificial Sequence
  Synthetic Peptide
DLVLSIALSVGCTGA

SEQ ID NO: 7660 - protein, 15 aa, Artificial Sequence
  Synthetic Peptide
GQRVPVSHSFPHPLY

SEQ ID NO: 7661 - protein, 15 aa, Artificial Sequence
  Synthetic Peptide
HDLMLLRLSEPAKIT

SEQ ID NO: 7662 - protein, 15 aa, Artificial Sequence
  Synthetic Peptide
HPLYNMSLLKHQSLR

SEQ ID NO: 7663 - protein, 15 aa, Artificial Sequence
  Synthetic Peptide
HPQWVLTAAHCLKKN

SEQ ID NO: 7664 - protein, 15 aa, Artificial Sequence
  Synthetic Peptide
KPAVYTKVVHYRKWI

SEQ ID NO: 7665 - protein, 15 aa, Artificial Sequence
  Synthetic Peptide
LHLLSNDMCARAYSE

SEQ ID NO: 7666 - protein, 15 aa, Artificial Sequence
  Synthetic Peptide
MWDLVLSIALSVGCT

SEQ ID NO: 7667 - protein, 15 aa, Artificial Sequence
  Synthetic Peptide
NGVLQGITSWGPEPC

SEQ ID NO: 7668 - protein, 15 aa, Artificial Sequence
  Synthetic Peptide
NMSLLKHQSLRPDED

SEQ ID NO: 7669 - protein, 15 aa, Artificial Sequence
  Synthetic Peptide
PEEFLRPRSLQCVSL

SEQ ID NO: 7670 - protein, 15 aa, Artificial Sequence
  Synthetic Peptide
PHPLYNMSLLKHQSL

SEQ ID NO: 7671 - protein, 15 aa, Artificial Sequence
  Synthetic Peptide
PRSLQCVSLHLLSND

SEQ ID NO: 7672 - protein, 15 aa, Artificial Sequence
  Synthetic Peptide
QWVLTAAHCLKKNSQ

SEQ ID NO: 7673 - protein, 15 aa, Artificial Sequence
  Synthetic Peptide
RVPVSHSFPHPLYNM

SEQ ID NO: 7674 - protein, 15 aa, Artificial Sequence
  Synthetic Peptide
SHDLMLLRLSEPAKI

SEQ ID NO: 7675 - protein, 15 aa, Artificial Sequence
  Synthetic Peptide
ATGFKQSSKALQRPV

SEQ ID NO: 7676 - protein, 25 aa, Artificial Sequence
  Synthetic Peptide
IVHSATGFKQSSKALQRPVASDFEP

SEQ ID NO: 7677 - protein, 15 aa, Artificial Sequence
  Synthetic Peptide
IKYNGEEYLILSARD

SEQ ID NO: 7678 - protein, 15 aa, Artificial Sequence
  Synthetic Peptide
IYSKYGGTEIKYNGE

SEQ ID NO: 7679 - protein, 12 aa, Artificial Sequence
  Synthetic Peptide
LVIPENAKEKPQ

SEQ ID NO: 7680 - protein, 15 aa, Artificial Sequence
  Synthetic Peptide
LVIPENAKEKPQEGT

SEQ ID NO: 7681 - protein, 15 aa, Artificial Sequence
  Synthetic Peptide
LVIPENAKEKPQEGT

SEQ ID NO: 7682 - protein, 15 aa, Artificial Sequence
  Synthetic Peptide
NGEEYLILSARDVLA

SEQ ID NO: 7683 - protein, 15 aa, Artificial Sequence
  Synthetic Peptide
PSGLVIPENAKEKPQ

SEQ ID NO: 7684 - protein, 15 aa, Artificial Sequence
  Synthetic Peptide
RIPVDVSEGDIVIYS

SEQ ID NO: 7685 - protein, 23 aa, Artificial Sequence
  Synthetic Peptide
RKHRIEDAVRNAKAAVEEGIVAG

SEQ ID NO: 7686 - protein, 15 aa, Artificial Sequence
  Synthetic Peptide
SEGDIVIYSKYGGTE

SEQ ID NO: 7687 - protein, 12 aa, Artificial Sequence
  Synthetic Peptide
TLLQAAPALDKY

SEQ ID NO: 7688 - protein, 15 aa, Artificial Sequence
  Synthetic Peptide
VAKVKIKPLEDKILV

SEQ ID NO: 7689 - protein, 15 aa, Artificial Sequence
  Synthetic Peptide
VKIKPLEDKILVQAG

SEQ ID NO: 7690 - protein, 15 aa, Artificial Sequence
  Synthetic Peptide
VVAVGPGRWDEDGAK

SEQ ID NO: 7691 - protein, 21 aa, Artificial Sequence
  Synthetic Peptide
YEKIGAELVKEVAKKTDDVAG

SEQ ID NO: 7692 - protein, 18 aa, Artificial Sequence
  Synthetic Peptide
EKIWEELSVLEVFEGRED

SEQ ID NO: 7693 - protein, 17 aa, Artificial Sequence [sequence omitted]

SEQ ID NO: 7694 - protein, 15 aa, Artificial Sequence
  Synthetic Peptide
EEKIWEDLSMLEVFE

SEQ ID NO: 7695 - protein, 15 aa, Artificial Sequence
  Synthetic Peptide
FPDLESDFQAAISRK

SEQ ID NO: 7696 - protein, 15 aa, Artificial Sequence
  Synthetic Peptide
LESVLRDCQDFFPVI

SEQ ID NO: 7697 - protein, 15 aa, Artificial Sequence
  Synthetic Peptide
MQDLVQDNYLEYRQV

SEQ ID NO: 7698 - protein, 15 aa, Artificial Sequence
  Synthetic Peptide
PRKLLMEDLVQENYL

SEQ ID NO: 7699 - protein, 15 aa, Artificial Sequence
  Synthetic Peptide
QDLVQEDYLEYRQVP

SEQ ID NO: 7700 - protein, 15 aa, Artificial Sequence
  Synthetic Peptide
QLVFGIDVVEVVPIS

SEQ ID NO: 7701 - protein, 15 aa, Artificial Sequence
  Synthetic Peptide
EEKIWEDLSVLEVFE

SEQ ID NO: 7702 - protein, 15 aa, Artificial Sequence
  Synthetic Peptide
LGSVVGDWQYFFPVI

SEQ ID NO: 7703 - protein, 15 aa, Artificial Sequence
  Synthetic Peptide
QHFVQEDYLEYRQVP

SEQ ID NO: 7704 - protein, 15 aa, Artificial Sequence
  Synthetic Peptide
TQHFVQDNYLEYRQV

SEQ ID NO: 7705 - protein, 24 aa, Artificial Sequence
  Synthetic Peptide
LLKYRAREPVTKAEMLGSVVGNWQ

SEQ ID NO: 7706 - protein, 25 aa, Artificial Sequence
  Synthetic Peptide
MVKISGGPRISYPLLHEWALREGEE

SEQ ID NO: 7707 - protein, 24 aa, Artificial Sequence
  Synthetic Peptide
QVPGSDPACYEFLWGPRALIETSY

SEQ ID NO: 7708 - protein, 19 aa, Artificial Sequence
  Synthetic Peptide
VGNWQYFFPVIFSKASDSL

SEQ ID NO: 7709 - protein, 14 aa, Artificial Sequence
  Synthetic Peptide
YKLNFYFDLLRAKL

SEQ ID NO: 7710 - protein, 14 aa, Artificial Sequence
  Synthetic Peptide
YLDNIKDNVGKMED

SEQ ID NO: 7711 - protein, 14 aa, Artificial Sequence
  Synthetic Peptide
AAGIGILTVILGVL

SEQ ID NO: 7712 - protein, 20 aa, Artificial Sequence
  Synthetic Peptide
ASQKRPSQRHGSKYLATAST

SEQ ID NO: 7713 - protein, 20 aa, Artificial Sequence
  Synthetic Peptide
ASQKRPSQRSKYLATASTMD

SEQ ID NO: 7714 - protein, 15 aa, Artificial Sequence
  Synthetic Peptide
ANPVVHFFKNIVTPR

SEQ ID NO: 7715 - protein, 20 aa, Artificial Sequence
  Synthetic Peptide
ASQKRPSQRHGSKYLATAST

SEQ ID NO: 7716 - protein, 20 aa, Artificial Sequence
  Synthetic Peptide
AYDAQGTLSKIFKLGGRDSR

SEQ ID NO: 7717 - protein, 11 aa, Artificial Sequence
  Synthetic Peptide
DENPVVHFFKN

SEQ ID NO: 7718 - protein, 12 aa, Artificial Sequence
  Synthetic Peptide
DENPVVHFFKNI

SEQ ID NO: 7719 - protein, 13 aa, Artificial Sequence
  Synthetic Peptide
DENPVVHFFKNIV

SEQ ID NO: 7720 - protein, 14 aa, Artificial Sequence
  Synthetic Peptide
DENPVVHFFKNIVT

SEQ ID NO: 7721 - protein, 16 aa, Artificial Sequence
  Synthetic Peptide
DENPVVHFFKNIVTPR

SEQ ID NO: 7722 - protein, 17 aa, Artificial Sequence
  Synthetic Peptide
DENPVVHFFKNIVTPRT

SEQ ID NO: 7723 - protein, 19 aa, Artificial Sequence
  Synthetic Peptide
DENPVVHFFKNIVTPRTPP

SEQ ID NO: 7724 - protein, 20 aa, Artificial Sequence
  Synthetic Peptide
DENPVVHFFKNIVTPRTPPY

SEQ ID NO: 7725 - protein, 20 aa, Artificial Sequence
  Synthetic Peptide
DENPVVHFFRNIVTPRTPPY

SEQ ID NO: 7726 - protein, 15 aa, Artificial Sequence
  Synthetic Peptide
EAPVVHFFKNIVTPR

SEQ ID NO: 7727 - protein, 15 aa, Artificial Sequence
  Synthetic Peptide
ENAVVHFFKNIVTPR

SEQ ID NO: 7728 - protein, 15 aa, Artificial Sequence
  Synthetic Peptide
ENPAVHFFKNIVTPR

SEQ ID NO: 7729 - protein, 15 aa, Artificial Sequence
  Synthetic Peptide
ENPKVHFFKNIVTPR

SEQ ID NO: 7730 - protein, 15 aa, Artificial Sequence
  Synthetic Peptide
ENPVAHFFKNIVTPR

SEQ ID NO: 7731 - protein, 15 aa, Artificial Sequence
  Synthetic Peptide
ENPVKHFFKNIVTPR

SEQ ID NO: 7732 - protein, 15 aa, Artificial Sequence
  Synthetic Peptide
ENPVVAFFKNIVTPR

SEQ ID NO: 7733 - protein, 15 aa, Artificial Sequence
  Synthetic Peptide
ENPVVAFFKNIVTPR

SEQ ID NO: 7734 - protein, 15 aa, Artificial Sequence
  Synthetic Peptide
ENPVVDFFKNIVTPR

SEQ ID NO: 7735 - protein, 15 aa, Artificial Sequence
  Synthetic Peptide
ENPVVFFFKNIVTPR

SEQ ID NO: 7736 - protein, 15 aa, Artificial Sequence
  Synthetic Peptide
ENPVVHAFKNIVTPR

SEQ ID NO: 7737 - protein, 15 aa, Artificial Sequence
  Synthetic Peptide
ENPVVHAFKNIVTPR

SEQ ID NO: 7738 - protein, 15 aa, Artificial Sequence
  Synthetic Peptide
ENPVVHAFRNIVTPR

SEQ ID NO: 7739 - protein, 15 aa, Artificial Sequence
  Synthetic Peptide
ENPVVHDFKNIVTPR

SEQ ID NO: 7740 - protein, 15 aa, Artificial Sequence
  Synthetic Peptide
ENPVVHFAKNIVTPR

SEQ ID NO: 7741 - protein, 15 aa, Artificial Sequence
  Synthetic Peptide
ENPVVHFARNIVTPR

SEQ ID NO: 7742 - protein, 15 aa, Artificial Sequence
  Synthetic Peptide
ENPVVHFFANIVTPR

SEQ ID NO: 7743 - protein, 15 aa, Artificial Sequence
  Synthetic Peptide
ENPVVHFFANIVTPR

SEQ ID NO: 7744 - protein, 17 aa, Artificial Sequence
  Synthetic Peptide
ENPVVHFFANIVTPRTP

SEQ ID NO: 7745 - protein, 15 aa, Artificial Sequence
  Synthetic Peptide
ENPVVHFFDNIVTPR

SEQ ID NO: 7746 - protein, 15 aa, Artificial Sequence
  Synthetic Peptide
ENPVVHFFHNIVTPR

SEQ ID NO: 7747 - protein, 15 aa, Artificial Sequence
  Synthetic Peptide
ENPVVHFFKAIVTPR

SEQ ID NO: 7748 - protein, 17 aa, Artificial Sequence
  Synthetic Peptide
ENPVVHFFKAIVTPRTP

SEQ ID NO: 7749 - protein, 15 aa, Artificial Sequence
  Synthetic Peptide
ENPVVHFFKKIVTPR

SEQ ID NO: 7750 - protein, 15 aa, Artificial Sequence
  Synthetic Peptide
ENPVVHFFKNAVTPR

SEQ ID NO: 7751 - protein, 17 aa, Artificial Sequence
  Synthetic Peptide
ENPVVHFFKNAVTPRTP

SEQ ID NO: 7752 - protein, 15 aa, Artificial Sequence
  Synthetic Peptide
ENPVVHFFKNIATPR

SEQ ID NO: 7753 - protein, 15 aa, Artificial Sequence
  Synthetic Peptide
ENPVVHFFKNIVAPR

SEQ ID NO: 7754 - protein, 17 aa, Artificial Sequence
  Synthetic Peptide
ENPVVHFFKNIVAPRTP

SEQ ID NO: 7755 - protein, 15 aa, Artificial Sequence
  Synthetic Peptide
ENPVVHFFKNIVTAR

SEQ ID NO: 7756 - protein, 15 aa, Artificial Sequence
  Synthetic Peptide
ENPVVHFFKNIVTPA

SEQ ID NO: 7757 - protein, 15 aa, Artificial Sequence
  Synthetic Peptide
ENPVVHFFKNIVTPA

SEQ ID NO: 7758 - protein, 15 aa, Artificial Sequence
  Synthetic Peptide
ENPVVHFFKNIVTPR

SEQ ID NO: 7759 - protein, 17 aa, Artificial Sequence
  Synthetic Peptide
ENPVVHFFKNIVTPRTP

SEQ ID NO: 7760 - protein, 19 aa, Artificial Sequence
  Synthetic Peptide
ENPVVHFFKNIVTPRTPPY

SEQ ID NO: 7761 - protein, 15 aa, Artificial Sequence
  Synthetic Peptide
ENPVVHFFKNKVTPR

SEQ ID NO: 7762 - protein, 15 aa, Artificial Sequence
  Synthetic Peptide
ENPVVHFFLNIVTPR

SEQ ID NO: 7763 - protein, 15 aa, Artificial Sequence
  Synthetic Peptide
ENPVVHFFRNIVTPR

SEQ ID NO: 7764 - protein, 15 aa, Artificial Sequence
  Synthetic Peptide
ENPVVHFKKNIVTPR

SEQ ID NO: 7765 - protein, 15 aa, Artificial Sequence
  Synthetic Peptide
ENPVVHHFKNIVTPR

SEQ ID NO: 7766 - protein, 15 aa, Artificial Sequence
  Synthetic Peptide
ENPVVHHFRNIVTPR

SEQ ID NO: 7767 - protein, 15 aa, Artificial Sequence
  Synthetic Peptide
ENPVVHLFKNIVTPR

SEQ ID NO: 7768 - protein, 15 aa, Artificial Sequence
  Synthetic Peptide
ENPVVHLFRNIVTPR

SEQ ID NO: 7769 - protein, 15 aa, Artificial Sequence
  Synthetic Peptide
ENPVVHWFKNIVTPR

SEQ ID NO: 7770 - protein, 15 aa, Artificial Sequence
  Synthetic Peptide
ENPVVHYFANIVTPR

SEQ ID NO: 7771 - protein, 15 aa, Artificial Sequence
  Synthetic Peptide
ENPVVHYFHNIVTPR

SEQ ID NO: 7772 - protein, 15 aa, Artificial Sequence
  Synthetic Peptide
ENPVVHYFKNIVTPR

SEQ ID NO: 7773 - protein, 15 aa, Artificial Sequence
  Synthetic Peptide
ENPVVHYFLNIVTPR

SEQ ID NO: 7774 - protein, 15 aa, Artificial Sequence
  Synthetic Peptide
ENPVVHYFRNIVTPR

SEQ ID NO: 7775 - protein, 15 aa, Artificial Sequence
  Synthetic Peptide
ENPVVKFFKNIVTPR

SEQ ID NO: 7776 - protein, 16 aa, Artificial Sequence
  Synthetic Peptide
FFKNIVTPFFKNIVTP

SEQ ID NO: 7777 - protein, 20 aa, Artificial Sequence
  Synthetic Peptide
FSWGAEGQRPGFGYGGRASD

SEQ ID NO: 7778 - protein, 20 aa, Artificial Sequence
  Synthetic Peptide
GFGYGGRASDYKSAHKGFKG

SEQ ID NO: 7779 - protein, 20 aa, Artificial Sequence
  Synthetic Peptide
GKGRGLSLSRFSWGAEGQRP

SEQ ID NO: 7780 - protein, 20 aa, Artificial Sequence
  Synthetic Peptide
GSGKDSHHPARTAHYGSLPQ

SEQ ID NO: 7781 - protein, 20 aa, Artificial Sequence
  Synthetic Peptide
HARHGFLPRHRDTGILDSIG

SEQ ID NO: 7782 - protein, 14 aa, Artificial Sequence
  Synthetic Peptide
HFFKNIVTPRTPPY

SEQ ID NO: 7783 - protein, 14 aa, Artificial Sequence
  Synthetic Peptide
HFFKNIVTPRTPPY

SEQ ID NO: 7784 - protein, 18 aa, Artificial Sequence
  Synthetic Peptide
IFKLGGRDSRSGSPMARR

SEQ ID NO: 7785 - protein, 20 aa, Artificial Sequence
  Synthetic Peptide
KRGSGKDSHTRTTHYGSLPQ

SEQ ID NO: 7786 - protein, 20 aa, Artificial Sequence
  Synthetic Peptide
KSQHGRTQDENPVVHFFKNI

SEQ ID NO: 7787 - protein, 12 aa, Artificial Sequence
  Synthetic Peptide
NPVVHFFKNIVT

SEQ ID NO: 7788 - protein, 14 aa, Artificial Sequence
  Synthetic Peptide
NPVVHFFKNIVTPA

SEQ ID NO: 7789 - protein, 14 aa, Artificial Sequence
  Synthetic Peptide
NPVVHFFKNIVTPR

SEQ ID NO: 7790 - protein, 18 aa, Artificial Sequence
  Synthetic Peptide
NPVVHFFKNIVTPRTPPY

SEQ ID NO: 7791 - protein, 11 aa, Artificial Sequence
  Synthetic Peptide
PVVHFFKNIVT

SEQ ID NO: 7792 - protein, 13 aa, Artificial Sequence
  Synthetic Peptide
PVVHFFKNIVTPA

SEQ ID NO: 7793 - protein, 13 aa, Artificial Sequence
  Synthetic Peptide
PVVHFFKNIVTPR

SEQ ID NO: 7794 - protein, 17 aa, Artificial Sequence
  Synthetic Peptide
PVVHFFKNIVTPRTPPY

SEQ ID NO: 7795 - protein, 20 aa, Artificial Sequence
  Synthetic Peptide
QKSHGRTQDENPVVHFFKNI

SEQ ID NO: 7796 - protein, 20 aa, Artificial Sequence
  Synthetic Peptide
RASDYKSAHKGFKGVDAQGT

SEQ ID NO: 7797 - protein, 20 aa, Artificial Sequence
  Synthetic Peptide
RASDYKSAHKGLKGHDAQGT

SEQ ID NO: 7798 - protein, 20 aa, Artificial Sequence
  Synthetic Peptide
RDTGILDSIGRFFGGDRGAP

SEQ ID NO: 7799 - protein, 20 aa, Artificial Sequence
  Synthetic Peptide
RDTGILDSIGRFFSGDRGAP

SEQ ID NO: 7800 - protein, 20 aa, Artificial Sequence
  Synthetic Peptide
RFFGGDRGAPKRGSGKDSHH

SEQ ID NO: 7801 - protein, 20 aa, Artificial Sequence
  Synthetic Peptide
RFFSGDRGAPKRGSGKDSHT

SEQ ID NO: 7802 - protein, 20 aa, Artificial Sequence
  Synthetic Peptide
RTAHYGSLPQKSHGRTQDEN

SEQ ID NO: 7803 - protein, 20 aa, Artificial Sequence
  Synthetic Peptide
VDAQGTLSKIFKLGGRDSRS

SEQ ID NO: 7804 - protein, 20 aa, Artificial Sequence
  Synthetic Peptide
VDAQGTLSKIFKLGGRDSRS

SEQ ID NO: 7805 - protein, 20 aa, Artificial Sequence
  Synthetic Peptide
VDAQGTLSKLFKLGGRDSRS

SEQ ID NO: 7806 - protein, 20 aa, Artificial Sequence
  Synthetic Peptide
VDAQGTLSRIFKLGGRDSRS

SEQ ID NO: 7807 - protein, 15 aa, Artificial Sequence
  Synthetic Peptide
VHFFKNIVTPRTPPY

SEQ ID NO: 7808 - protein, 20 aa, Artificial Sequence
  Synthetic Peptide
VTPRTPPPSQGKGRGLSLSR

SEQ ID NO: 7809 - protein, 16 aa, Artificial Sequence
  Synthetic Peptide
VVHFFKNIVTPRTPPY

SEQ ID NO: 7810 - protein, 20 aa, Artificial Sequence
  Synthetic Peptide
YKSAHKGFKGAYDAQGTLSK

SEQ ID NO: 7811 - protein, 20 aa, Artificial Sequence
  Synthetic Peptide
YKSAHKGFKGVDAQGTLSKI

SEQ ID NO: 7812 - protein, 16 aa, Artificial Sequence
  Synthetic Peptide
ANERADLIAYLKQATK

SEQ ID NO: 7813 - protein, 13 aa, Artificial Sequence
  Synthetic Peptide
EFVVEFDLPGIKA

SEQ ID NO: 7814 - protein, 10 aa, Artificial Sequence
  Synthetic Peptide
VITAFNEGLK

SEQ ID NO: 7815 - protein, 14 aa, Artificial Sequence
  Synthetic Peptide
YEFVVEFDLPGIKA

SEQ ID NO: 7816 - protein, 15 aa, Artificial Sequence
  Synthetic Peptide
IAFNSGLEPGVVAEK

SEQ ID NO: 7817 - protein, 15 aa, Artificial Sequence
  Synthetic Peptide
LLPLLEKVIGAGKPL

SEQ ID NO: 7818 - protein, 12 aa, Artificial Sequence
  Synthetic Peptide
YKTIAYDEEARR

SEQ ID NO: 7819 - protein, 22 aa, Artificial Sequence
  Synthetic Peptide
TWQRDGEDQTQDTELVETRPAG

SEQ ID NO: 7820 - protein, 21 aa, Artificial Sequence
  Synthetic Peptide
VDDTLFVRFDSDAASPREEPR

SEQ ID NO: 7821 - protein, 21 aa, Artificial Sequence
  Synthetic Peptide
VDDTLFVRFDSDATSPRKEPR

SEQ ID NO: 7822 - protein, 21 aa, Artificial Sequence
  Synthetic Peptide
VDDTQFVRFDSDAASPREEPR

SEQ ID NO: 7823 - protein, 21 aa, Artificial Sequence
  Synthetic Peptide
VDDTQFVRFDSDAASPRMAPR

SEQ ID NO: 7824 - protein, 21 aa, Artificial Sequence
  Synthetic Peptide
VDDTQFVRFDSDAASPRTEPR

SEQ ID NO: 7825 - protein, 16 aa, Artificial Sequence
  Synthetic Peptide
AHAAHAAHAAHAAHAA

SEQ ID NO: 7826 - protein, 14 aa, Artificial Sequence
  Synthetic Peptide
AVHAAHAEINEAGR

SEQ ID NO: 7827 - protein, 12 aa, Artificial Sequence
  Synthetic Peptide
HIATNAVLFFGR

SEQ ID NO: 7828 - protein, 14 aa, Artificial Sequence
  Synthetic Peptide
ISQAAHAAHAEINE

SEQ ID NO: 7829 - protein, 14 aa, Artificial Sequence
  Synthetic Peptide
ISQADHAAHAEINE

SEQ ID NO: 7830 - protein, 14 aa, Artificial Sequence
  Synthetic Peptide
ISQAVEAAHAEINE

SEQ ID NO: 7831 - protein, 14 aa, Artificial Sequence
  Synthetic Peptide
ISQAVHAAHAEDNE

SEQ ID NO: 7832 - protein, 14 aa, Artificial Sequence
  Synthetic Peptide
ISQAVHAAHAEIIE

SEQ ID NO: 7833 - protein, 14 aa, Artificial Sequence
  Synthetic Peptide
ISQAVHAAHAQINE

SEQ ID NO: 7834 - protein, 14 aa, Artificial Sequence
  Synthetic Peptide
ISQAVHAALAEINE

SEQ ID NO: 7835 - protein, 14 aa, Artificial Sequence
  Synthetic Peptide
ISQAVHAANAEINE

SEQ ID NO: 7836 - protein, 14 aa, Artificial Sequence
  Synthetic Peptide
ISQAVHAARAEINE

SEQ ID NO: 7837 - protein, 15 aa, Artificial Sequence
  Synthetic Peptide
LKISQAVHAAHAEIN

SEQ ID NO: 7838 - protein, 20 aa, Artificial Sequence
  Synthetic Peptide
MVYLGAKDSTRTQINKVVRF

SEQ ID NO: 7839 - protein, 15 aa, Artificial Sequence
  Synthetic Peptide
NVMEERKIKVYLPRM

SEQ ID NO: 7840 - protein, 15 aa, Artificial Sequence
  Synthetic Peptide
VHAAHAEINVHAAHA

SEQ ID NO: 7841 - protein, 15 aa, Artificial Sequence
  Synthetic Peptide
VHAAHAVHAAHAEIN

SEQ ID NO: 7842 - protein, 15 aa, Artificial Sequence
  Synthetic Peptide
VHAAHAVHAAHAVHA

SEQ ID NO: 7843 - protein, 14 aa, Artificial Sequence
  Synthetic Peptide
YTYTVHAAHAYTYT

SEQ ID NO: 7844 - protein, 14 aa, Artificial Sequence
  Synthetic Peptide
YTYTVHAAHAYTYT

SEQ ID NO: 7845 - protein, 15 aa, Artificial Sequence
  Synthetic Peptide
LIRVEGDLRVEYLDD

SEQ ID NO: 7846 - protein, 15 aa, Artificial Sequence
  Synthetic Peptide
QHLIRVDGNLRVEYL

SEQ ID NO: 7847 - protein, 15 aa, Artificial Sequence
  Synthetic Peptide
RFEMFRDLNEALELK

SEQ ID NO: 7848 - protein, 15 aa, Artificial Sequence
  Synthetic Peptide
AAPLLLARAASLSLG

SEQ ID NO: 7849 - protein, 15 aa, Artificial Sequence
  Synthetic Peptide
AKELKFVTLVFRHGD

SEQ ID NO: 7850 - protein, 15 aa, Artificial Sequence
  Synthetic Peptide
ALDVYNGLLPPYASC

SEQ ID NO: 7851 - protein, 15 aa, Artificial Sequence
  Synthetic Peptide
APLLLARAASLSLGF

SEQ ID NO: 7852 - protein, 15 aa, Artificial Sequence
  Synthetic Peptide
DRSVLAKELKFVTLV

SEQ ID NO: 7853 - protein, 15 aa, Artificial Sequence
  Synthetic Peptide
DRTLMSAMTNLAALF

SEQ ID NO: 7854 - protein, 15 aa, Artificial Sequence
  Synthetic Peptide
DTTVSGLQMALDVYN

SEQ ID NO: 7855 - protein, 15 aa, Artificial Sequence
  Synthetic Peptide
FAELVGPVIPQDWST

SEQ ID NO: 7856 - protein, 15 aa, Artificial Sequence
  Synthetic Peptide
FGQLTQLGMEQHYEL

SEQ ID NO: 7857 - protein, 15 aa, Artificial Sequence
  Synthetic Peptide
GGVLVNEILNHMKRA

SEQ ID NO: 7858 - protein, 15 aa, Artificial Sequence
  Synthetic Peptide
GPVIPQDWSTECMTT

SEQ ID NO: 7859 - protein, 15 aa, Artificial Sequence
  Synthetic Peptide
GVSIWNPILLWQPIP

SEQ ID NO: 7860 - protein, 15 aa, Artificial Sequence
  Synthetic Peptide
ILLWQPIPVHTVPLS

SEQ ID NO: 7861 - protein, 15 aa, Artificial Sequence
  Synthetic Peptide
IPSYKKLIMYSAHDT

SEQ ID NO: 7862 - protein, 15 aa, Artificial Sequence
  Synthetic Peptide
KSRLQGGVLVNEILN

SEQ ID NO: 7863 - protein, 15 aa, Artificial Sequence
  Synthetic Peptide
LDVYNGLLPPYASCH

SEQ ID NO: 7864 - protein, 15 aa, Artificial Sequence
  Synthetic Peptide
LIMYSAHDTTVSGLQ

SEQ ID NO: 7865 - protein, 15 aa, Artificial Sequence
  Synthetic Peptide
LLFFWLDRSVLAKEL

SEQ ID NO: 7866 - protein, 15 aa, Artificial Sequence
  Synthetic Peptide
LPSWATEDTMTKLRE

SEQ ID NO: 7867 - protein, 15 aa, Artificial Sequence
  Synthetic Peptide
LRELSELSLLSLYGI

SEQ ID NO: 7868 - protein, 15 aa, Artificial Sequence
  Synthetic Peptide
LSELSLLSLYGIHKQ

SEQ ID NO: 7869 - protein, 15 aa, Artificial Sequence
  Synthetic Peptide
LSGLHGQDLFGIWSK

SEQ ID NO: 7870 - protein, 15 aa, Artificial Sequence
  Synthetic Peptide
LSLLSLYGIHKQKEK

SEQ ID NO: 7871 - protein, 15 aa, Artificial Sequence
  Synthetic Peptide
LTELYFEKGEYFVEM

SEQ ID NO: 7872 - protein, 15 aa, Artificial Sequence
  Synthetic Peptide
MSAMTNLAALFPPEG

SEQ ID NO: 7873 - protein, 15 aa, Artificial Sequence
  Synthetic Peptide
MTNLAALFPPEGVSI

SEQ ID NO: 7874 - protein, 15 aa, Artificial Sequence
  Synthetic Peptide
NPILLWQPIPVHTVP

SEQ ID NO: 7875 - protein, 15 aa, Artificial Sequence
  Synthetic Peptide
PEGVSIWNPILLWQP

SEQ ID NO: 7876 - protein, 15 aa, Artificial Sequence
  Synthetic Peptide
PILLWQPIPVHTVPL

SEQ ID NO: 7877 - protein, 15 aa, Artificial Sequence
  Synthetic Peptide
PLLLARAASLSLGFL

SEQ ID NO: 7878 - protein, 15 aa, Artificial Sequence
  Synthetic Peptide
RSPIDTFPTDPIKES

SEQ ID NO: 7879 - protein, 15 aa, Artificial Sequence
  Synthetic Peptide
SLSLGFLFLLFFWLD

SEQ ID NO: 7880 - protein, 15 aa, Artificial Sequence
  Synthetic Peptide
TVPLSEDQLLYLPFR

SEQ ID NO: 7881 - protein, 15 aa, Artificial Sequence
  Synthetic Peptide
WNPILLWQPIPVHTV

SEQ ID NO: 7882 - protein, 15 aa, Artificial Sequence
  Synthetic Peptide
WQPIPVHTVPLSEDQ

SEQ ID NO: 7883 - protein, 15 aa, Artificial Sequence
  Synthetic Peptide
YDPLYCESVHNFTLP

SEQ ID NO: 7884 - protein, 15 aa, Artificial Sequence
  Synthetic Peptide
YKKLIMYSAHDTTVS

SEQ ID NO: 7885 - protein, 15 aa, Artificial Sequence
  Synthetic Peptide
YNGLLPPYASCHLTE

SEQ ID NO: 7886 - protein, 15 aa, Artificial Sequence
  Synthetic Peptide
AGGIAGGLALLACAG

SEQ ID NO: 7887 - protein, 15 aa, Artificial Sequence
  Synthetic Peptide
ATSVLAGLLGNVSTV

SEQ ID NO: 7888 - protein, 15 aa, Artificial Sequence
  Synthetic Peptide
AVPLAMKLIQQLNLN

SEQ ID NO: 7889 - protein, 18 aa, Artificial Sequence
  Synthetic Peptide
EWSPCSVTCGNGIQVRIK

SEQ ID NO: 7890 - protein, 15 aa, Artificial Sequence
  Synthetic Peptide
FLALFFIIFNKESLA

SEQ ID NO: 7891 - protein, 20 aa, Artificial Sequence
  Synthetic Peptide
IEQYLKKIKNSISTEWSPCS

SEQ ID NO: 7892 - protein, 15 aa, Artificial Sequence
  Synthetic Peptide
IFHINGKIIKNSEKD

SEQ ID NO: 7893 - protein, 15 aa, Artificial Sequence
  Synthetic Peptide
KHILYISFYFILVNL

SEQ ID NO: 7894 - protein, 15 aa, Artificial Sequence
  Synthetic Peptide
LIDVHDLISDMIKKE

SEQ ID NO: 7895 - protein, 20 aa, Artificial Sequence
  Synthetic Peptide
NAREIIRLHSDASKNKEKAL

SEQ ID NO: 7896 - protein, 15 aa, Artificial Sequence
  Synthetic Peptide
NHAVPLAMKLIQQLN

SEQ ID NO: 7897 - protein, 15 aa, Artificial Sequence
  Synthetic Peptide
TVLLGGVGLVLYNTE

SEQ ID NO: 7898 - protein, 15 aa, Artificial Sequence
  Synthetic Peptide
VDLYLLMDCSGSIRR

SEQ ID NO: 7899 - protein, 15 aa, Artificial Sequence
  Synthetic Peptide
VKNVSQTNFKSLLRN

SEQ ID NO: 7900 - protein, 15 aa, Artificial Sequence
  Synthetic Peptide
VVILTDGIPDSIQDS

SEQ ID NO: 7901 - protein, 20 aa, Artificial Sequence
  Synthetic Peptide
YADSAWENVKNVIGPFMKAV

SEQ ID NO: 7902 - protein, 13 aa, Artificial Sequence
  Synthetic Peptide
ADLIAYLKQATAK

SEQ ID NO: 7903 - protein, 12 aa, Artificial Sequence
  Synthetic Peptide
DLIAYLKQATAK

SEQ ID NO: 7904 - protein, 15 aa, Artificial Sequence
  Synthetic Peptide
ERADLIAYLKQATAK

SEQ ID NO: 7905 - protein, 10 aa, Artificial Sequence
  Synthetic Peptide
IAYLKQATAK

SEQ ID NO: 7906 - protein, 16 aa, Artificial Sequence
  Synthetic Peptide
KAERADLIAYLKQATA

SEQ ID NO: 7907 - protein, 11 aa, Artificial Sequence
  Synthetic Peptide
LIAYLKQATAK

SEQ ID NO: 7908 - protein, 18 aa, Artificial Sequence
  Synthetic Peptide
AATYNFAVLKLMGRGTKF

SEQ ID NO: 7909 - protein, 20 aa, Artificial Sequence
  Synthetic Peptide
FLYGALLLAEGFYTTGAVRQ

SEQ ID NO: 7910 - protein, 20 aa, Artificial Sequence
  Synthetic Peptide
FLYGALLLAEGFYTTGAVRQ

SEQ ID NO: 7911 - protein, 14 aa, Artificial Sequence
  Synthetic Peptide
FNTWTTCQSIAFPS

SEQ ID NO: 7912 - protein, 20 aa, Artificial Sequence
  Synthetic Peptide
LCADARMYGVLPWNAFPGKV

SEQ ID NO: 7913 - protein, 20 aa, Artificial Sequence
  Synthetic Peptide
LTGTEKLIETYFSKNYQDYE

SEQ ID NO: 7914 - protein, 20 aa, Artificial Sequence
  Synthetic Peptide
QKGRGYRGQHQAHSLERVCH

SEQ ID NO: 7915 - protein, 20 aa, Artificial Sequence
  Synthetic Peptide
SAVPVYIYFNTWTTCQSIAF

SEQ ID NO: 7916 - protein, 20 aa, Artificial Sequence
  Synthetic Peptide
SAVPVYIYFNTWTTCQSIAF

SEQ ID NO: 7917 - protein, 20 aa, Artificial Sequence
  Synthetic Peptide
TAEFQMTFHLFIAAFVGAAA

SEQ ID NO: 7918 - protein, 20 aa, Artificial Sequence
  Synthetic Peptide
WTTCQSIAFPSKTSASIGSL

SEQ ID NO: 7919 - protein, 15 aa, Artificial Sequence
  Synthetic Peptide
AHCIRNKSVILLGRH

SEQ ID NO: 7920 - protein, 15 aa, Artificial Sequence
  Synthetic Peptide
CAQVHPQKVTKFMLC

SEQ ID NO: 7921 - protein, 15 aa, Artificial Sequence
  Synthetic Peptide
GGPLVCNGVLQGITS

SEQ ID NO: 7922 - protein, 15 aa, Artificial Sequence
  Synthetic Peptide
GPLVCNGVLQGITSW

SEQ ID NO: 7923 - protein, 15 aa, Artificial Sequence
  Synthetic Peptide
GQVFQVSHSFPHPLY

SEQ ID NO: 7924 - protein, 15 aa, Artificial Sequence
  Synthetic Peptide
GRAVCGGVLVHPQWV

SEQ ID NO: 7925 - protein, 15 aa, Artificial Sequence
  Synthetic Peptide
GVLVHPQWVLTAAHC

SEQ ID NO: 7926 - protein, 15 aa, Artificial Sequence
  Synthetic Peptide
HDLMLLRLSEPAELT

SEQ ID NO: 7927 - protein, 15 aa, Artificial Sequence
  Synthetic Peptide
HPQWVLTAAHCIRNK

SEQ ID NO: 7928 - protein, 15 aa, Artificial Sequence
  Synthetic Peptide
HSLFHPEDTGQVFQV

SEQ ID NO: 7929 - protein, 15 aa, Artificial Sequence
  Synthetic Peptide
LHVISNDVCAQVHPQ

SEQ ID NO: 7930 - protein, 15 aa, Artificial Sequence
  Synthetic Peptide
NGVLQGITSWGSEPC

SEQ ID NO: 7931 - protein, 15 aa, Artificial Sequence
  Synthetic Peptide
PHPLYDMSLLKNRFL

SEQ ID NO: 7932 - protein, 15 aa, Artificial Sequence
  Synthetic Peptide
QWVLTAAHCIRNKSV

SEQ ID NO: 7933 - protein, 15 aa, Artificial Sequence
  Synthetic Peptide
RPSLYTKVVHYRKWI

SEQ ID NO: 7934 - protein, 15 aa, Artificial Sequence
  Synthetic Peptide
SHDLMLLRLSEPAEL

SEQ ID NO: 7935 - protein, 15 aa, Artificial Sequence
  Synthetic Peptide
SQPWQVLVASRGRAV

SEQ ID NO: 7936 - protein, 15 aa, Artificial Sequence
  Synthetic Peptide
SVILLGRHSLFHPED

SEQ ID NO: 7937 - protein, 15 aa, Artificial Sequence
  Synthetic Peptide
SVTWIGAAPLILSRI

SEQ ID NO: 7938 - protein, 15 aa, Artificial Sequence
  Synthetic Peptide
TDAVKVMDLPTQEPA

SEQ ID NO: 7939 - protein, 15 aa, Artificial Sequence
  Synthetic Peptide
TLSVTWIGAAPLILS

SEQ ID NO: 7940 - protein, 15 aa, Artificial Sequence
  Synthetic Peptide
VFQVSHSFPHPLYDM

SEQ ID NO: 7941 - protein, 15 aa, Artificial Sequence
  Synthetic Peptide
VILLGRHSLFHPEDT

SEQ ID NO: 7942 - protein, 15 aa, Artificial Sequence
  Synthetic Peptide
VTWIGAAPLILSRIV

SEQ ID NO: 7943 - protein, 15 aa, Artificial Sequence
  Synthetic Peptide
ADKIYSISMKHPQEM

SEQ ID NO: 7944 - protein, 15 aa, Artificial Sequence
  Synthetic Peptide
AEAVGLPSIPVHPIG

SEQ ID NO: 7945 - protein, 15 aa, Artificial Sequence
  Synthetic Peptide
AVGLPSIPVHPIGYY

SEQ ID NO: 7946 - protein, 15 aa, Artificial Sequence
  Synthetic Peptide
CTPLMYSLVHNLTKE

SEQ ID NO: 7947 - protein, 15 aa, Artificial Sequence
  Synthetic Peptide
DFEVFFQRLGIASGR

SEQ ID NO: 7948 - protein, 15 aa, Artificial Sequence
  Synthetic Peptide
DPMFKYHLTVAQVRG

SEQ ID NO: 7949 - protein, 15 aa, Artificial Sequence
  Synthetic Peptide
DQLMFLERAFIDPLG

SEQ ID NO: 7950 - protein, 15 aa, Artificial Sequence
  Synthetic Peptide
DSSIEGNYTLRVDCT

SEQ ID NO: 7951 - protein, 15 aa, Artificial Sequence
  Synthetic Peptide
EDFFKLERDMKINCS

SEQ ID NO: 7952 - protein, 15 aa, Artificial Sequence
  Synthetic Peptide
ERGVAYINADSSIEG

SEQ ID NO: 7953 - protein, 15 aa, Artificial Sequence
  Synthetic Peptide
EVFFQRLGIASGRAR

SEQ ID NO: 7954 - protein, 15 aa, Artificial Sequence
  Synthetic Peptide
EYAYRRGIAEAVGLP

SEQ ID NO: 7955 - protein, 15 aa, Artificial Sequence
  Synthetic Peptide
FFKLERDMKINCSGK

SEQ ID NO: 7956 - protein, 15 aa, Artificial Sequence
  Synthetic Peptide
GAAVVHEIVRSFGTL

SEQ ID NO: 7957 - protein, 15 aa, Artificial Sequence
  Synthetic Peptide
GKVFRGNKVKNAQLA

SEQ ID NO: 7958 - protein, 15 aa, Artificial Sequence
  Synthetic Peptide
GMVFELANSIVLPFD

SEQ ID NO: 7959 - protein, 15 aa, Artificial Sequence
  Synthetic Peptide
GNEIFNTSLFEPPPP

SEQ ID NO: 7960 - protein, 15 aa, Artificial Sequence
  Synthetic Peptide
GNKVKNAQLAGAKGV

SEQ ID NO: 7961 - protein, 15 aa, Artificial Sequence
  Synthetic Peptide
GVAYINADSSIEGNY

SEQ ID NO: 7962 - protein, 15 aa, Artificial Sequence
  Synthetic Peptide
GVILYSDPADYFAPG

SEQ ID NO: 7963 - protein, 15 aa, Artificial Sequence
  Synthetic Peptide
IGYYDAQKLLEKMGG

SEQ ID NO: 7964 - protein, 15 aa, Artificial Sequence
  Synthetic Peptide
IKKFLYNFTQIPHLA

SEQ ID NO: 7965 - protein, 15 aa, Artificial Sequence
  Synthetic Peptide
ISIINEDGNEIFNTS

SEQ ID NO: 7966 - protein, 15 aa, Artificial Sequence
  Synthetic Peptide
IYSISMKHPQEMKTY

SEQ ID NO: 7967 - protein, 15 aa, Artificial Sequence
  Synthetic Peptide
KFLYNFTQIPHLAGT

SEQ ID NO: 7968 - protein, 15 aa, Artificial Sequence
  Synthetic Peptide
KYHLTVAQVRGGMVF

SEQ ID NO: 7969 - protein, 15 aa, Artificial Sequence
  Synthetic Peptide
LAHYDVLLSYPNKTH

SEQ ID NO: 7970 - protein, 15 aa, Artificial Sequence
  Synthetic Peptide
LDELKAENIKKFLYN

SEQ ID NO: 7971 - protein, 15 aa, Artificial Sequence
  Synthetic Peptide
LGFLFGWFIKSSNEA

SEQ ID NO: 7972 - protein, 15 aa, Artificial Sequence
  Synthetic Peptide
LRMMNDQLMFLERAF

SEQ ID NO: 7973 - protein, 15 aa, Artificial Sequence
  Synthetic Peptide
MFKYHLTVAQVRGGM

SEQ ID NO: 7974 - protein, 15 aa, Artificial Sequence
  Synthetic Peptide
NSRLLQERGVAYINA

SEQ ID NO: 7975 - protein, 15 aa, Artificial Sequence
  Synthetic Peptide
NYTLRVDCTPLMYSL

SEQ ID NO: 7976 - protein, 15 aa, Artificial Sequence
  Synthetic Peptide
PQEMKTYSVSFDSLF

SEQ ID NO: 7977 - protein, 15 aa, Artificial Sequence
  Synthetic Peptide
PRWLCAGALVLAGGF

SEQ ID NO: 7978 - protein, 15 aa, Artificial Sequence
  Synthetic Peptide
QIYVAAFTVQAAAET

SEQ ID NO: 7979 - protein, 15 aa, Artificial Sequence
  Synthetic Peptide
RGGMVFELANSIVLP

SEQ ID NO: 7980 - protein, 15 aa, Artificial Sequence
  Synthetic Peptide
RHVIYAPSSHNKYAG

SEQ ID NO: 7981 - protein, 15 aa, Artificial Sequence
  Synthetic Peptide
RQIYVAAFTVQAAAE

SEQ ID NO: 7982 - protein, 15 aa, Artificial Sequence
  Synthetic Peptide
TGNFSTQKVKMHIHS

SEQ ID NO: 7983 - protein, 15 aa, Artificial Sequence
  Synthetic Peptide
TNKFSGYPLYHSVYE

SEQ ID NO: 7984 - protein, 15 aa, Artificial Sequence
  Synthetic Peptide
TRIYNVIGTLRGAVE

SEQ ID NO: 7985 - protein, 15 aa, Artificial Sequence
  Synthetic Peptide
TYSVSFDSLFSAVKN

SEQ ID NO: 7986 - protein, 15 aa, Artificial Sequence
  Synthetic Peptide
VAAFTVQAAAETLSE

SEQ ID NO: 7987 - protein, 15 aa, Artificial Sequence
  Synthetic Peptide
VAQVRGGMVFELANS

SEQ ID NO: 7988 - protein, 15 aa, Artificial Sequence
  Synthetic Peptide
VAYINADSSIEGNYT

SEQ ID NO: 7989 - protein, 15 aa, Artificial Sequence
  Synthetic Peptide
VFELANSIVLPFDCR

SEQ ID NO: 7990 - protein, 15 aa, Artificial Sequence
  Synthetic Peptide
VLRMMNDQLMFLERA

SEQ ID NO: 7991 - protein, 15 aa, Artificial Sequence
  Synthetic Peptide
WKEFGLDSVELAHYD

SEQ ID NO: 7992 - protein, 15 aa, Artificial Sequence
  Synthetic Peptide
YDPMFKYHLTVAQVR

SEQ ID NO: 7993 - protein, 15 aa, Artificial Sequence
  Synthetic Peptide
YISIINEDGNEIFNT

SEQ ID NO: 7994 - protein, 15 aa, Artificial Sequence
  Synthetic Peptide
YRHVIYAPSSHNKYA

SEQ ID NO: 7995 - protein, 20 aa, Artificial Sequence
  Synthetic Peptide
VDAQGTLSRLFKLGGRDSRS

SEQ ID NO: 7996 - protein, 19 aa, Artificial Sequence
  Synthetic Peptide
KVNNQVVSLKPEIIVDQEY

SEQ ID NO: 7997 - protein, 6 aa, Artificial Sequence
  Synthetic Peptide
STRKSP

SEQ ID NO: 7998 - protein, 6 aa, Artificial Sequence
  Synthetic Peptide
STRKSP

SEQ ID NO: 7999 - protein, 6 aa, Artificial Sequence
  Synthetic Peptide
STRKSP

SEQ ID NO: 8000 - protein, 6 aa, Artificial Sequence
  Synthetic Peptide
STRKSP

SEQ ID NO: 8001 - protein, 6 aa, Artificial Sequence
  Synthetic Peptide
STRKSP

SEQ ID NO: 8002 - protein, 16 aa, Artificial Sequence
  Synthetic Peptide
DKLKQQRDTLSTQKET

SEQ ID NO: 8003 - protein, 15 aa, Artificial Sequence
  Synthetic Peptide
EQKSKQNIGALKQEL

SEQ ID NO: 8004 - protein, 20 aa, Artificial Sequence
  Synthetic Peptide
SGGTNYAQKFQGRVTMTRDT

SEQ ID NO: 8005 - protein, 19 aa, Artificial Sequence
  Synthetic Peptide
ELSRLSDDTAVYYCARAPG

SEQ ID NO: 8006 - protein, 20 aa, Artificial Sequence
  Synthetic Peptide
ELSRLTSDDTAVYYCAIAPG

SEQ ID NO: 8007 - protein, 17 aa, Artificial Sequence
  Synthetic Peptide
TISCSGSSSNIGSNTVN

SEQ ID NO: 8008 - protein, 11 aa, Artificial Sequence
  Synthetic Peptide
APYHFDLSGHA

SEQ ID NO: 8009 - protein, 12 aa, Artificial Sequence
  Synthetic Peptide
APYHFDLSGHAF

SEQ ID NO: 8010 - protein, 14 aa, Artificial Sequence
  Synthetic Peptide
APYHFDLSGHAFGS

SEQ ID NO: 8011 - protein, 16 aa, Artificial Sequence
  Synthetic Peptide
APYHFDLSGHAFGSMA

SEQ ID NO: 8012 - protein, 18 aa, Artificial Sequence
  Synthetic Peptide
APYHFDLSGHAFGSMAKK

SEQ ID NO: 8013 - protein, 20 aa, Artificial Sequence
  Synthetic Peptide
APYHFDLSGHAFGSMAKKGE

SEQ ID NO: 8014 - protein, 20 aa, Artificial Sequence
  Synthetic Peptide
CGYKDVDKAPFNGMTGCGNT

SEQ ID NO: 8015 - protein, 9 aa, Artificial Sequence
  Synthetic Peptide
DLSGHAFGS

SEQ ID NO: 8016 - protein, 17 aa, Artificial Sequence
  Synthetic Peptide
EDVIPEGWKADTSYSAK

SEQ ID NO: 8017 - protein, 20 aa, Artificial Sequence
  Synthetic Peptide
ELQFRRVKCKYPDDTKPTFH

SEQ ID NO: 8018 - protein, 20 aa, Artificial Sequence
  Synthetic Peptide
EQNVRSAGELELQFRRVKCK

SEQ ID NO: 8019 - protein, 20 aa, Artificial Sequence
  Synthetic Peptide
ESWGAVWRIDTPDKLTGPFT

SEQ ID NO: 8020 - protein, 16 aa, Artificial Sequence
  Synthetic Peptide
FDLSGHAFGSMAKKGE

SEQ ID NO: 8021 - protein, 21 aa, Artificial Sequence
  Synthetic Peptide
GDVVAVVDIKEKGKDKWIELK

SEQ ID NO: 8022 - protein, 15 aa, Artificial Sequence
  Synthetic Peptide
GEKRAYAASDPGRYC

SEQ ID NO: 8023 - protein, 20 aa, Artificial Sequence
  Synthetic Peptide
KGKDKWIELKESWGAVWRID

SEQ ID NO: 8024 - protein, 14 aa, Artificial Sequence
  Synthetic Peptide
LSGHAFGSMAKKGE

SEQ ID NO: 8025 - protein, 20 aa, Artificial Sequence
  Synthetic Peptide
SEVEDVIPEGWKADTSYSAK

SEQ ID NO: 8026 - protein, 14 aa, Artificial Sequence
  Synthetic Peptide
VAYESSEIASKKAG

SEQ ID NO: 8027 - protein, 20 aa, Artificial Sequence
  Synthetic Peptide
VEKGSNPNYLAILVKYVDGD

SEQ ID NO: 8028 - protein, 12 aa, Artificial Sequence
  Synthetic Peptide
YHFDLSGHAFGS

SEQ ID NO: 8029 - protein, 18 aa, Artificial Sequence
  Synthetic Peptide
YHFDLSGHAFGSMAKKGE

SEQ ID NO: 8030 - protein, 20 aa, Artificial Sequence
  Synthetic Peptide
YPDDTKPTFHVEKGSNPNYL

SEQ ID NO: 8031 - protein, 17 aa, Artificial Sequence
  Synthetic Peptide
KSDNQIKAVPASQALVA

SEQ ID NO: 8032 - protein, 13 aa, Artificial Sequence
  Synthetic Peptide
PKSDNQIKAVPAS

SEQ ID NO: 8033 - protein, 15 aa, Artificial Sequence
  Synthetic Peptide
PKSDNQIKAVPASQA

SEQ ID NO: 8034 - protein, 15 aa, Artificial Sequence
  Synthetic Peptide
VRPKSDNQIKAVPAS

SEQ ID NO: 8035 - protein, 14 aa, Artificial Sequence
  Synthetic Peptide
FRKDIAAKYKELGY

SEQ ID NO: 8036 - protein, 15 aa, Artificial Sequence
  Synthetic Peptide
LFRKDIAAKYKELGY

SEQ ID NO: 8037 - protein, 13 aa, Artificial Sequence
  Synthetic Peptide
NKALELFRKDIAA

SEQ ID NO: 8038 - protein, 14 aa, Artificial Sequence
  Synthetic Peptide
NKALELFRKDIAAK

SEQ ID NO: 8039 - protein, 15 aa, Artificial Sequence
  Synthetic Peptide
NKALELFRKDIAAKY

SEQ ID NO: 8040 - protein, 22 aa, Artificial Sequence
  Synthetic Peptide
NKALELFRKDIAAKYKELGYQG

SEQ ID NO: 8041 - protein, 13 aa, Artificial Sequence
  Synthetic Peptide
RKDIAAKYKELGY

SEQ ID NO: 8042 - protein, 20 aa, Artificial Sequence
  Synthetic Peptide
FTKKMVENAKKIEVEFDKGQ

SEQ ID NO: 8043 - protein, 11 aa, Artificial Sequence
  Synthetic Peptide
GLAKVAYVYKP

SEQ ID NO: 8044 - protein, 20 aa, Artificial Sequence
  Synthetic Peptide
HEQHLRKSEAQAKKEKLNIW

SEQ ID NO: 8045 - protein, 11 aa, Artificial Sequence
  Synthetic Peptide
LVRQGLAKVAY

SEQ ID NO: 8046 - protein, 20 aa, Artificial Sequence
  Synthetic Peptide
PATLIKAIDGDTVKLMYKGQ

SEQ ID NO: 8047 - protein, 20 aa, Artificial Sequence
  Synthetic Peptide
PMTFRLLLVDTPETKHPKKG

SEQ ID NO: 8048 - protein, 11 aa, Artificial Sequence
  Synthetic Peptide
QGLAKVAYVYK

SEQ ID NO: 8049 - protein, 11 aa, Artificial Sequence
  Synthetic Peptide
RQGLAKVAYVY

SEQ ID NO: 8050 - protein, 20 aa, Artificial Sequence
  Synthetic Peptide
TPETKHPKKGVEKYGPEASA

SEQ ID NO: 8051 - protein, 20 aa, Artificial Sequence
  Synthetic Peptide
VEKYGPEASAFTKKMVENAK

SEQ ID NO: 8052 - protein, 11 aa, Artificial Sequence
  Synthetic Peptide
VRQGLAKVAYV

SEQ ID NO: 8053 - protein, 20 aa, Artificial Sequence
  Synthetic Peptide
YIYADGKMVNEALVRQGLAK

SEQ ID NO: 8054 - protein, 20 aa, Artificial Sequence
  Synthetic Peptide
FTKKMVENAKKIEVEFDKGQ

SEQ ID NO: 8055 - protein, 20 aa, Artificial Sequence
  Synthetic Peptide
HEQHLRKSEAQAKKEKLNIW

SEQ ID NO: 8056 - protein, 20 aa, Artificial Sequence
  Synthetic Peptide
PATLIKAIDGDTVKLMYKGQ

SEQ ID NO: 8057 - protein, 19 aa, Artificial Sequence
  Synthetic Peptide
QAKKEKLNIWSEDNADSGQ

SEQ ID NO: 8058 - protein, 20 aa, Artificial Sequence
  Synthetic Peptide
VEKYGPEASAFTKKMVENAK

SEQ ID NO: 8059 - protein, 20 aa, Artificial Sequence
  Synthetic Peptide
YIYADGKMVNEALVRQGLAK

SEQ ID NO: 8060 - protein, 17 aa, Artificial Sequence
  Synthetic Peptide
YGAVDSILGGVATYGAA

SEQ ID NO: 8061 - protein, 15 aa, Artificial Sequence
  Synthetic Peptide
AGTIAALNNSIGVLG

SEQ ID NO: 8062 - protein, 15 aa, Artificial Sequence
  Synthetic Peptide
GSISYPARYANAMAV

SEQ ID NO: 8063 - protein, 15 aa, Artificial Sequence
  Synthetic Peptide
GTVAALDNSAGVLGV

SEQ ID NO: 8064 - protein, 15 aa, Artificial Sequence
  Synthetic Peptide
GTVAALDNSIGVLGV

SEQ ID NO: 8065 - protein, 15 aa, Artificial Sequence
  Synthetic Peptide
GTVAALNNSAGVLGV

SEQ ID NO: 8066 - protein, 15 aa, Artificial Sequence
  Synthetic Peptide
GTVAALNNSIGVLGV

SEQ ID NO: 8067 - protein, 15 aa, Artificial Sequence
  Synthetic Peptide
IAALNNSIGVLGVAP

SEQ ID NO: 8068 - protein, 15 aa, Artificial Sequence
  Synthetic Peptide
NGIEWAIANNMDVAN

SEQ ID NO: 8069 - protein, 15 aa, Artificial Sequence
  Synthetic Peptide
NGIEWAIANNMDVIN

SEQ ID NO: 8070 - protein, 15 aa, Artificial Sequence
  Synthetic Peptide
SYPARYANAMAVGAT

SEQ ID NO: 8071 - protein, 15 aa, Artificial Sequence
  Synthetic Peptide
TGSGVKVAVLDTGIS

SEQ ID NO: 8072 - protein, 13 aa, Artificial Sequence
  Synthetic Peptide
ANSKFIGITELKK

SEQ ID NO: 8073 - protein, 15 aa, Artificial Sequence
  Synthetic Peptide
IKANSKFIGITELKK

SEQ ID NO: 8074 - protein, 10 aa, Artificial Sequence
  Synthetic Peptide
ILMQYIKANS

SEQ ID NO: 8075 - protein, 14 aa, Artificial Sequence
  Synthetic Peptide
QAIKANSKFIGITE

SEQ ID NO: 8076 - protein, 14 aa, Artificial Sequence
  Synthetic Peptide
QEIKANSKFIGITE

SEQ ID NO: 8077 - protein, 14 aa, Artificial Sequence
  Synthetic Peptide
QSIKANSKFIGITE

SEQ ID NO: 8078 - protein, 14 aa, Artificial Sequence
  Synthetic Peptide
QYIKANQKFIGITE

SEQ ID NO: 8079 - protein, 14 aa, Artificial Sequence
  Synthetic Peptide
QYIKANSKFKGITE

SEQ ID NO: 8080 - protein, 14 aa, Artificial Sequence
  Synthetic Peptide
QYIKKNSKFIGITE

SEQ ID NO: 8081 - protein, 14 aa, Artificial Sequence
  Synthetic Peptide
QYIKSNSKFIGITE

SEQ ID NO: 8082 - protein, 14 aa, Artificial Sequence
  Synthetic Peptide
QYIRANSKFIGITE

SEQ ID NO: 8083 - protein, 11 aa, Artificial Sequence
  Synthetic Peptide
SKFIGITELKK

SEQ ID NO: 8084 - protein, 14 aa, Artificial Sequence
  Synthetic Peptide
YNGQIGNDPNRDIL

SEQ ID NO: 8085 - protein, 18 aa, Artificial Sequence
  Synthetic Peptide
DTPYLDITYHFVMQRLPL

SEQ ID NO: 8086 - protein, 15 aa, Artificial Sequence
  Synthetic Peptide
GELIGILNAAKVPAD

SEQ ID NO: 8087 - protein, 17 aa, Artificial Sequence
  Synthetic Peptide
ALHIYMDGTMSQVQGSA

SEQ ID NO: 8088 - protein, 17 aa, Artificial Sequence
  Synthetic Peptide
ALHIYMNGTMSQVQGSA

SEQ ID NO: 8089 - protein, 15 aa, Artificial Sequence
  Synthetic Peptide
DQSYLQDSDPDSFQD

SEQ ID NO: 8090 - protein, 15 aa, Artificial Sequence
  Synthetic Peptide
DYSFLQDSDPDSFQD

SEQ ID NO: 8091 - protein, 15 aa, Artificial Sequence
  Synthetic Peptide
DYSYFQDSDPDSFQD

SEQ ID NO: 8092 - protein, 15 aa, Artificial Sequence
  Synthetic Peptide
DYSYLQDSDPDSFQD

SEQ ID NO: 8093 - protein, 15 aa, Artificial Sequence
  Synthetic Peptide
DYSYLQDSVPDSFQD

SEQ ID NO: 8094 - protein, 15 aa, Artificial Sequence
  Synthetic Peptide
DYSYQQDSDPDSFQD

SEQ ID NO: 8095 - protein, 21 aa, Artificial Sequence [sequence omitted]

SEQ ID NO: 8096 - protein, 13 aa, Artificial Sequence
  Synthetic Peptide
ILLSNAPLGPQFP

SEQ ID NO: 8097 - protein, 14 aa, Artificial Sequence
  Synthetic Peptide
NILLSNAPLGPQFP

SEQ ID NO: 8098 - protein, 15 aa, Artificial Sequence
  Synthetic Peptide
QNFLLSNAPLGPQFP

SEQ ID NO: 8099 - protein, 15 aa, Artificial Sequence
  Synthetic Peptide
QNIFLSNAPLGPQFP

SEQ ID NO: 8100 - protein, 15 aa, Artificial Sequence
  Synthetic Peptide
QNILLSNAPQGPQFP

SEQ ID NO: 8101 - protein, 15 aa, Artificial Sequence
  Synthetic Peptide
QNILLSNAQLGPQFP

SEQ ID NO: 8102 - protein, 15 aa, Artificial Sequence
  Synthetic Peptide
QNILLSNAVLGPQFP

SEQ ID NO: 8103 - protein, 15 aa, Artificial Sequence
  Synthetic Peptide
QNILLSNQPLGPQFP

SEQ ID NO: 8104 - protein, 15 aa, Artificial Sequence
  Synthetic Peptide
QNILLSNVPLGPQFP

SEQ ID NO: 8105 - protein, 15 aa, Artificial Sequence [sequence omitted]

SEQ ID NO: 8106 - protein, 15 aa, Artificial Sequence [sequence omitted]

SEQ ID NO: 8107 - protein, 15 aa, Artificial Sequence
  Synthetic Peptide
QNIQLSNAPLGPQFP

SEQ ID NO: 8108 - protein, 15 aa, Artificial Sequence
  Synthetic Peptide
QNIVLSNAPLGPQFP

SEQ ID NO: 8109 - protein, 15 aa, Artificial Sequence
  Synthetic Peptide
QNVLLSNAPLGPQFP

SEQ ID NO: 8110 - protein, 13 aa, Artificial Sequence
  Synthetic Peptide
SYLQDSDPDSFQD

SEQ ID NO: 8111 - protein, 13 aa, Artificial Sequence
  Synthetic Peptide
SYLQDSVPDSFQD

SEQ ID NO: 8112 - protein, 16 aa, Artificial Sequence
  Synthetic Peptide
WPSVFYNRTCQCSGNF

SEQ ID NO: 8113 - protein, 20 aa, Artificial Sequence
  Synthetic Peptide
YGQMKNGSTPMFNDINIYDL

SEQ ID NO: 8114 - protein, 12 aa, Artificial Sequence
  Synthetic Peptide
YLQDSDPDSFQD

SEQ ID NO: 8115 - protein, 14 aa, Artificial Sequence
  Synthetic Peptide
YSYLQDSDPDSFQD

SEQ ID NO: 8116 - protein, 3 aa, Artificial Sequence
  Synthetic Peptide
AKA

SEQ ID NO: 8117 - protein, 9 aa, Artificial Sequence
  Synthetic Peptide
AFAAAAAAA

SEQ ID NO: 8118 - protein, 9 aa, Artificial Sequence
  Synthetic Peptide
AFAAAALAA

SEQ ID NO: 8119 - protein, 10 aa, Artificial Sequence
  Synthetic Peptide
AFAAAATAAA

SEQ ID NO: 8120 - protein, 10 aa, Artificial Sequence
  Synthetic Peptide
AFAAAATLAA

SEQ ID NO: 8121 - protein, 11 aa, Artificial Sequence
  Synthetic Peptide
  VARIANT 2: Xaa = Any Amino Acid
AXKQNTLKLAT

SEQ ID NO: 8122 - protein, 10 aa, Artificial Sequence
  Synthetic Peptide
AAFAAAAAAA

SEQ ID NO: 8123 - protein, 10 aa, Artificial Sequence
  Synthetic Peptide
AAFAAAALAA

SEQ ID NO: 8124 - protein, 11 aa, Artificial Sequence
  Synthetic Peptide
AAFAAAATAAA

SEQ ID NO: 8125 - protein, 11 aa, Artificial Sequence
  Synthetic Peptide
AAFAAAATLAA

SEQ ID NO: 8126 - protein, 17 aa, Artificial Sequence
  Synthetic Peptide
AHAAHAAHAAHAAHAAY

SEQ ID NO: 8127 - protein, 13 aa, Artificial Sequence
  Synthetic Peptide
EVIPMFSALSEGA

SEQ ID NO: 8128 - protein, 15 aa, Artificial Sequence
  Synthetic Peptide
EVWREEAYHAADIKD

SEQ ID NO: 8129 - protein, 16 aa, Artificial Sequence
  Synthetic Peptide
EVWREEAYHAADIKDY

SEQ ID NO: 8130 - protein, 12 aa, Artificial Sequence
  Synthetic Peptide
KYVKQNTLKLAT

SEQ ID NO: 8131 - protein, 12 aa, Artificial Sequence
  Synthetic Peptide
KYVKQNTLKLAT

SEQ ID NO: 8132 - protein, 13 aa, Artificial Sequence
  Synthetic Peptide
LNKIVRMYSPTSI

SEQ ID NO: 8133 - protein, 13 aa, Artificial Sequence
  Synthetic Peptide
NKIVRMYSPTSIL

SEQ ID NO: 8134 - protein, 11 aa, Artificial Sequence
  Synthetic Peptide
  VARIANT 2: Xaa = Any Amino Acid
PXKQNTLKLAT

SEQ ID NO: 8135 - protein, 11 aa, Artificial Sequence
  Synthetic Peptide
  VARIANT 2: Xaa = Any Amino Acid
PXKQNTLKLAT

SEQ ID NO: 8136 - protein, 13 aa, Artificial Sequence
  Synthetic Peptide
PEVIPMFSALSEG

SEQ ID NO: 8137 - protein, 13 aa, Artificial Sequence
  Synthetic Peptide
PIVQNIQGQMVHQ

SEQ ID NO: 8138 - protein, 11 aa, Artificial Sequence
  Synthetic Peptide
  VARIANT 5: Xaa = Any Amino Acid
PKFVXTLKLAT

SEQ ID NO: 8139 - protein, 11 aa, Artificial Sequence
  Synthetic Peptide
  VARIANT 10: Xaa = Any Amino Acid
PKFVKQNTLXT

SEQ ID NO: 8140 - protein, 10 aa, Artificial Sequence
  Synthetic Peptide
  VARIANT 6: Xaa = Any Amino Acid
PKFVQXKLAT

SEQ ID NO: 8141 - protein, 13 aa, Artificial Sequence
  Synthetic Peptide
QEQIGWMTNNPPI

SEQ ID NO: 8142 - protein, 17 aa, Artificial Sequence
  Synthetic Peptide
TFGLQLELTEGMRFDKG

SEQ ID NO: 8143 - protein, 11 aa, Artificial Sequence
  Synthetic Peptide
TYQRTRALVTG

SEQ ID NO: 8144 - protein, 13 aa, Artificial Sequence
  Synthetic Peptide
VQNIQGQMVHQAI

SEQ ID NO: 8145 - protein, 15 aa, Artificial Sequence
  Synthetic Peptide
YIDVWLGGLAENFLP

SEQ ID NO: 8146 - protein, 19 aa, Artificial Sequence
  Synthetic Peptide
YKKSIQFHWKNSNQIKILG

SEQ ID NO: 8147 - protein, 13 aa, Artificial Sequence
  Synthetic Peptide
YKLNDRADSRRSL

SEQ ID NO: 8148 - protein, 18 aa, Artificial Sequence
  Synthetic Peptide
YKPVSQLRLATPLLLRPL

SEQ ID NO: 8149 - protein, 18 aa, Artificial Sequence
  Synthetic Peptide
YLDPLIRGLLARPAKLQV

SEQ ID NO: 8150 - protein, 25 aa, Artificial Sequence
  Synthetic Peptide
YLPKPPKPVSKLRLATPLLLQALPL

SEQ ID NO: 8151 - protein, 10 aa, Artificial Sequence
  Synthetic Peptide
AAAKTAAAFA

SEQ ID NO: 8152 - protein, 10 aa, Artificial Sequence
  Synthetic Peptide
AAAKTAAAFA

SEQ ID NO: 8153 - protein, 9 aa, Artificial Sequence
  Synthetic Peptide
RQTTLKAAA

SEQ ID NO: 8154 - protein, 9 aa, Artificial Sequence
  Synthetic Peptide
RQTTLKAAA

SEQ ID NO: 8155 - protein, 10 aa, Artificial Sequence
  Synthetic Peptide
AAAKTAAAFA

SEQ ID NO: 8156 - protein, 10 aa, Artificial Sequence
  Synthetic Peptide
ARQTTLKAAA

SEQ ID NO: 8157 - protein, 8 aa, Artificial Sequence
  Synthetic Peptide
AAAATKAA

SEQ ID NO: 8158 - protein, 8 aa, Artificial Sequence
  Synthetic Peptide
AAAATKAA

SEQ ID NO: 8159 - protein, 8 aa, Artificial Sequence
  Synthetic Peptide
AAAATKAA

SEQ ID NO: 8160 - protein, 10 aa, Artificial Sequence
  Synthetic Peptide
AAAATKAAAA

SEQ ID NO: 8161 - protein, 8 aa, Artificial Sequence
  Synthetic Peptide
AAAKTAAA

SEQ ID NO: 8162 - protein, 10 aa, Artificial Sequence
  Synthetic Peptide
AAAKTAAAFA

SEQ ID NO: 8163 - protein, 9 aa, Artificial Sequence
  Synthetic Peptide
AAAKTAAAF

SEQ ID NO: 8164 - protein, 9 aa, Artificial Sequence
  Synthetic Peptide
AAKTAAAFA

SEQ ID NO: 8165 - protein, 10 aa, Artificial Sequence
  Synthetic Peptide
AAAKTAAAFA

SEQ ID NO: 8166 - protein, 14 aa, Artificial Sequence
  Synthetic Peptide
YARFQSQTTLKAKT

SEQ ID NO: 8167 - protein, 13 aa, Artificial Sequence
  Synthetic Peptide
AADFFFFFFFFDA

SEQ ID NO: 8168 - protein, 13 aa, Artificial Sequence
  Synthetic Peptide
AAFGIDIFGFKIA

SEQ ID NO: 8169 - protein, 10 aa, Artificial Sequence
  Synthetic Peptide
AAAKTAAAFA

SEQ ID NO: 8170 - protein, 10 aa, Artificial Sequence
  Synthetic Peptide
AAAATKAAAA

SEQ ID NO: 8171 - protein, 10 aa, Artificial Sequence
  Synthetic Peptide
AAAKTAAAFA

SEQ ID NO: 8172 - protein, 10 aa, Artificial Sequence
  Synthetic Peptide
AAAATKAAAA

SEQ ID NO: 8173 - protein, 10 aa, Artificial Sequence
  Synthetic Peptide
AAAKTAAAFA

SEQ ID NO: 8174 - protein, 10 aa, Artificial Sequence
  Synthetic Peptide
AAAKTAAAFA

SEQ ID NO: 8175 - protein, 10 aa, Artificial Sequence
  Synthetic Peptide
AAAATKAAAA

SEQ ID NO: 8176 - protein, 8 aa, Artificial Sequence
  Synthetic Peptide
AAAKTAAA

SEQ ID NO: 8177 - protein, 8 aa, Artificial Sequence
  Synthetic Peptide
AAAKTAAA

SEQ ID NO: 8178 - protein, 8 aa, Artificial Sequence
  Synthetic Peptide
AAAKTAAA

SEQ ID NO: 8179 - protein, 10 aa, Artificial Sequence
  Synthetic Peptide
AAAKTAAAAA

SEQ ID NO: 8180 - protein, 10 aa, Artificial Sequence
  Synthetic Peptide
AAAKTAAAFA

SEQ ID NO: 8181 - protein, 9 aa, Artificial Sequence
  Synthetic Peptide
AAKTAAAFA

SEQ ID NO: 8182 - protein, 10 aa, Artificial Sequence
  Synthetic Peptide
AAAATKAAAA

SEQ ID NO: 8183 - protein, 10 aa, Artificial Sequence
  Synthetic Peptide
AAAKTAAAFA

SEQ ID NO: 8184 - protein, 10 aa, Artificial Sequence
  Synthetic Peptide
AAAATKAAAA

SEQ ID NO: 8185 - protein, 10 aa, Artificial Sequence
  Synthetic Peptide
AAAKTAAAFA

SEQ ID NO: 8186 - protein, 10 aa, Artificial Sequence
  Synthetic Peptide
AAAKTAAAFA

SEQ ID NO: 8187 - protein, 10 aa, Artificial Sequence
  Synthetic Peptide
AAAATKAAAA

SEQ ID NO: 8188 - protein, 10 aa, Artificial Sequence
  Synthetic Peptide
AAAKTAAAFA

SEQ ID NO: 8189 - protein, 10 aa, Artificial Sequence
  Synthetic Peptide
AAAATKAAAA

SEQ ID NO: 8190 - protein, 10 aa, Artificial Sequence
  Synthetic Peptide
AAAKTAAAFA

SEQ ID NO: 8191 - protein, 10 aa, Artificial Sequence
  Synthetic Peptide
AAAKTAAAFA

SEQ ID NO: 8192 - protein, 13 aa, Artificial Sequence
  Synthetic Peptide
PKFVKQNTLKLAT

SEQ ID NO: 8193 - protein, 12 aa, Artificial Sequence
  Synthetic Peptide
AAYAAAAAAKAA

SEQ ID NO: 8194 - protein, 10 aa, Artificial Sequence
  Synthetic Peptide
FAAAAAAKAA

SEQ ID NO: 8195 - protein, 10 aa, Artificial Sequence
  Synthetic Peptide
QSQTTLKAKT

SEQ ID NO: 8196 - protein, 14 aa, Artificial Sequence
  Synthetic Peptide
YAAFQRQTTLKAAA

SEQ ID NO: 8197 - protein, 10 aa, Artificial Sequence
  Synthetic Peptide
AAAKTAAAFA

SEQ ID NO: 8198 - protein, 30 aa, Artificial Sequence
  Synthetic Peptide
KSSQYIKANSKFIGITEAAAFLPSDFFPSV

SEQ ID NO: 8199 - protein, 11 aa, Artificial Sequence
  Synthetic Peptide
AAAAKTAAAAA

SEQ ID NO: 8200 - protein, 10 aa, Artificial Sequence
  Synthetic Peptide
AAAAKTAAAA

SEQ ID NO: 8201 - protein, 11 aa, Artificial Sequence
  Synthetic Peptide
AAAAKTAAAFA

SEQ ID NO: 8202 - protein, 9 aa, Artificial Sequence
  Synthetic Peptide
AAAAKTAAA

SEQ ID NO: 8203 - protein, 9 aa, Artificial Sequence
  Synthetic Peptide
AAAAKTAAA

SEQ ID NO: 8204 - protein, 8 aa, Artificial Sequence
  Synthetic Peptide
AAAAKTAA

SEQ ID NO: 8205 - protein, 8 aa, Artificial Sequence
  Synthetic Peptide
AAAAKTAA

SEQ ID NO: 8206 - protein, 12 aa, Artificial Sequence
  Synthetic Peptide
AAAAAAAAKAAA

SEQ ID NO: 8207 - protein, 12 aa, Artificial Sequence
  Synthetic Peptide
AAAAAAAAKAAA

SEQ ID NO: 8208 - protein, 10 aa, Artificial Sequence
  Synthetic Peptide
AAAATKAAAA

SEQ ID NO: 8209 - protein, 11 aa, Artificial Sequence
  Synthetic Peptide
AAAAAAKAAAA

SEQ ID NO: 8210 - protein, 12 aa, Artificial Sequence
  Synthetic Peptide
AAAAAAAAKAAA

SEQ ID NO: 8211 - protein, 12 aa, Artificial Sequence
  Synthetic Peptide
AAAAAAPKAAAA

SEQ ID NO: 8212 - protein, 12 aa, Artificial Sequence
  Synthetic Peptide
AAAAAATEKAAA

SEQ ID NO: 8213 - protein, 12 aa, Artificial Sequence
  Synthetic Peptide
AAAAAATFKAAA

SEQ ID NO: 8214 - protein, 12 aa, Artificial Sequence
  Synthetic Peptide
AAAAAATIKAAA

SEQ ID NO: 8215 - protein, 10 aa, Artificial Sequence
  Synthetic Peptide
AAAAAATKAA

SEQ ID NO: 8216 - protein, 10 aa, Artificial Sequence
  Synthetic Peptide
AAAAAATKAA

SEQ ID NO: 8217 - protein, 10 aa, Artificial Sequence
  Synthetic Peptide
AAAAAATKAA

SEQ ID NO: 8218 - protein, 10 aa, Artificial Sequence
  Synthetic Peptide
AAAAAATKAA

SEQ ID NO: 8219 - protein, 10 aa, Artificial Sequence
  Synthetic Peptide
AAAAAATKAA

SEQ ID NO: 8220 - protein, 10 aa, Artificial Sequence
  Synthetic Peptide
AAAAAATKAA

SEQ ID NO: 8221 - protein, 10 aa, Artificial Sequence
  Synthetic Peptide
AAAAAATKAA

SEQ ID NO: 8222 - protein, 10 aa, Artificial Sequence
  Synthetic Peptide
AAAAAATKAA

SEQ ID NO: 8223 - protein, 12 aa, Artificial Sequence
  Synthetic Peptide
AAAAAATKAAAA

SEQ ID NO: 8224 - protein, 12 aa, Artificial Sequence
  Synthetic Peptide
AAAAAATKAAAA

SEQ ID NO: 8225 - protein, 12 aa, Artificial Sequence
  Synthetic Peptide
AAAAAATKKAAA

SEQ ID NO: 8226 - protein, 12 aa, Artificial Sequence
  Synthetic Peptide
AAAAAATLEAAA

SEQ ID NO: 8227 - protein, 12 aa, Artificial Sequence
  Synthetic Peptide
AAAAAATLFAAA

SEQ ID NO: 8228 - protein, 12 aa, Artificial Sequence
  Synthetic Peptide
AAAAAATLKAAA

SEQ ID NO: 8229 - protein, 12 aa, Artificial Sequence
  Synthetic Peptide
AAAAAATLKAEA

SEQ ID NO: 8230 - protein, 12 aa, Artificial Sequence
  Synthetic Peptide
AAAAAATLKAFA

SEQ ID NO: 8231 - protein, 12 aa, Artificial Sequence
  Synthetic Peptide
AAAAAATLKAQA

SEQ ID NO: 8232 - protein, 12 aa, Artificial Sequence
  Synthetic Peptide
AAAAAATLKAVA

SEQ ID NO: 8233 - protein, 12 aa, Artificial Sequence
  Synthetic Peptide
AAAAAATLKEAA

SEQ ID NO: 8234 - protein, 12 aa, Artificial Sequence
  Synthetic Peptide
AAAAAATLKFAA

SEQ ID NO: 8235 - protein, 12 aa, Artificial Sequence
  Synthetic Peptide
AAAAAATLKIAA

SEQ ID NO: 8236 - protein, 12 aa, Artificial Sequence
  Synthetic Peptide
AAAAAATLKKAA

SEQ ID NO: 8237 - protein, 12 aa, Artificial Sequence
  Synthetic Peptide
AAAAAATLKQAA

SEQ ID NO: 8238 - protein, 12 aa, Artificial Sequence
  Synthetic Peptide
AAAAAATLKVAA

SEQ ID NO: 8239 - protein, 12 aa, Artificial Sequence
  Synthetic Peptide
AAAAAATLQAAA

SEQ ID NO: 8240 - protein, 12 aa, Artificial Sequence
  Synthetic Peptide
AAAAAATLRAAA

SEQ ID NO: 8241 - protein, 12 aa, Artificial Sequence
  Synthetic Peptide
AAAAAATQKAAA

SEQ ID NO: 8242 - protein, 12 aa, Artificial Sequence
  Synthetic Peptide
AAAAAATVKAAA

SEQ ID NO: 8243 - protein, 12 aa, Artificial Sequence
  Synthetic Peptide
AAAAAETLKAAA

SEQ ID NO: 8244 - protein, 12 aa, Artificial Sequence
  Synthetic Peptide
AAAAAFTLKAAA

SEQ ID NO: 8245 - protein, 10 aa, Artificial Sequence
  Synthetic Peptide
AAAAAKTAAA

SEQ ID NO: 8246 - protein, 12 aa, Artificial Sequence
  Synthetic Peptide
AAAAAKTAAAAA

SEQ ID NO: 8247 - protein, 12 aa, Artificial Sequence
  Synthetic Peptide
AAAAAKTLKAAA

SEQ ID NO: 8248 - protein, 12 aa, Artificial Sequence
  Synthetic Peptide
AAAAAQTLKAAA

SEQ ID NO: 8249 - protein, 12 aa, Artificial Sequence
  Synthetic Peptide
AAAAATTLKAAA

SEQ ID NO: 8250 - protein, 12 aa, Artificial Sequence
  Synthetic Peptide
AAAAAVTLKAAA

SEQ ID NO: 8251 - protein, 12 aa, Artificial Sequence
  Synthetic Peptide
AAAAEATLKAAA

SEQ ID NO: 8252 - protein, 12 aa, Artificial Sequence
  Synthetic Peptide
AAAAFATLKAAA

SEQ ID NO: 8253 - protein, 12 aa, Artificial Sequence
  Synthetic Peptide
AAAAKATLKAAA

SEQ ID NO: 8254 - protein, 12 aa, Artificial Sequence
  Synthetic Peptide
AAAAQATLKAAA

SEQ ID NO: 8255 - protein, 12 aa, Artificial Sequence
  Synthetic Peptide
AAAAVATLKAAA

SEQ ID NO: 8256 - protein, 12 aa, Artificial Sequence
  Synthetic Peptide
AAAEAATLKAAA

SEQ ID NO: 8257 - protein, 12 aa, Artificial Sequence
  Synthetic Peptide
AAAFAATLKAAA

SEQ ID NO: 8258 - protein, 12 aa, Artificial Sequence
  Synthetic Peptide
AAAKAATLKAAA

SEQ ID NO: 8259 - protein, 12 aa, Artificial Sequence
  Synthetic Peptide
AAAQAATLKAAA

SEQ ID NO: 8260 - protein, 12 aa, Artificial Sequence
  Synthetic Peptide
AAAVAATLKAAA

SEQ ID NO: 8261 - protein, 12 aa, Artificial Sequence
  Synthetic Peptide
AAEAAATLKAAA

SEQ ID NO: 8262 - protein, 12 aa, Artificial Sequence
  Synthetic Peptide
AAFAAATLKAAA

SEQ ID NO: 8263 - protein, 12 aa, Artificial Sequence
  Synthetic Peptide
AAIAAATLKAAA

SEQ ID NO: 8264 - protein, 12 aa, Artificial Sequence
  Synthetic Peptide
AAKAAATLKAAA

SEQ ID NO: 8265 - protein, 12 aa, Artificial Sequence
  Synthetic Peptide
AALAAATLKAAA

SEQ ID NO: 8266 - protein, 12 aa, Artificial Sequence
  Synthetic Peptide
AAQAAATLKAAA

SEQ ID NO: 8267 - protein, 12 aa, Artificial Sequence
  Synthetic Peptide
AAVAAATLKAAA

SEQ ID NO: 8268 - protein, 12 aa, Artificial Sequence
  Synthetic Peptide
AAVVAATLKAFA

SEQ ID NO: 8269 - protein, 12 aa, Artificial Sequence
  Synthetic Peptide
AAAAAATKAAAA

SEQ ID NO: 8270 - protein, 11 aa, Artificial Sequence
  Synthetic Peptide
AAAAKTAAAFA

SEQ ID NO: 8271 - protein, 11 aa, Artificial Sequence
  Synthetic Peptide
AAAAKTGGGFG

SEQ ID NO: 8272 - protein, 11 aa, Artificial Sequence
  Synthetic Peptide
AAGGKGGGGFG

SEQ ID NO: 8273 - protein, 11 aa, Artificial Sequence
  Synthetic Peptide
AAGGKTAAAFA

SEQ ID NO: 8274 - protein, 11 aa, Artificial Sequence
  Synthetic Peptide
AAGGKTGGGFG

SEQ ID NO: 8275 - protein, 12 aa, Artificial Sequence
  Synthetic Peptide
AAAAAAAAKAAA

SEQ ID NO: 8276 - protein, 12 aa, Artificial Sequence
  Synthetic Peptide
AAAAAAAAKAAA

SEQ ID NO: 8277 - protein, 12 aa, Artificial Sequence
  Synthetic Peptide
AAAAAAAAKAAA

SEQ ID NO: 8278 - protein, 12 aa, Artificial Sequence
  Synthetic Peptide
AAAAAAAAKAAA

SEQ ID NO: 8279 - protein, 12 aa, Artificial Sequence
  Synthetic Peptide
AAAAAAAAKAAA

SEQ ID NO: 8280 - protein, 12 aa, Artificial Sequence
  Synthetic Peptide
AAAAAAAAKAAA

SEQ ID NO: 8281 - protein, 12 aa, Artificial Sequence
  Synthetic Peptide
AAAAAAAAKAAA

SEQ ID NO: 8282 - protein, 12 aa, Artificial Sequence
  Synthetic Peptide
AAAAAAAAKAAA

SEQ ID NO: 8283 - protein, 13 aa, Artificial Sequence
  Synthetic Peptide
AAAAKAATLKAAA

SEQ ID NO: 8284 - protein, 14 aa, Artificial Sequence
  Synthetic Peptide
AAAFAAAKTAAAFA

SEQ ID NO: 8285 - protein, 12 aa, Artificial Sequence
  Synthetic Peptide
AAAKAAAAAAAA

SEQ ID NO: 8286 - protein, 13 aa, Artificial Sequence
  Synthetic Peptide
AAAKAAAAAAFAA

SEQ ID NO: 8287 - protein, 13 aa, Artificial Sequence
  Synthetic Peptide
AAAKAAAAAAYAA

SEQ ID NO: 8288 - protein, 13 aa, Artificial Sequence
  Synthetic Peptide
AAAKAAAAAAYAA

SEQ ID NO: 8289 - protein, 13 aa, Artificial Sequence
  Synthetic Peptide
AAAKAAAAAFAAA

SEQ ID NO: 8290 - protein, 12 aa, Artificial Sequence
  Synthetic Peptide
AAAKATAAAAAA

SEQ ID NO: 8291 - protein, 13 aa, Artificial Sequence
  Synthetic Peptide
AADFGIFIDFIIA

SEQ ID NO: 8292 - protein, 13 aa, Artificial Sequence
  Synthetic Peptide
AAEAAAAAAKAAA

SEQ ID NO: 8293 - protein, 13 aa, Artificial Sequence
  Synthetic Peptide
AAFAAAAAAKAAA

SEQ ID NO: 8294 - protein, 13 aa, Artificial Sequence
  Synthetic Peptide
AAFAAAAAARLFA

SEQ ID NO: 8295 - protein, 13 aa, Artificial Sequence
  Synthetic Peptide
AAFAAAABKAAAA

SEQ ID NO: 8296 - protein, 13 aa, Artificial Sequence
  Synthetic Peptide
AAFAAAATAKAAA

SEQ ID NO: 8297 - protein, 13 aa, Artificial Sequence
  Synthetic Peptide
AAFAAAATAKAAA

SEQ ID NO: 8298 - protein, 13 aa, Artificial Sequence
  Synthetic Peptide
AAFAAAATLKAAA

SEQ ID NO: 8299 - protein, 13 aa, Artificial Sequence
  Synthetic Peptide
AAFAAAATLKAAA

SEQ ID NO: 8300 - protein, 13 aa, Artificial Sequence
  Synthetic Peptide
AAFAAAATLKAKA

SEQ ID NO: 8301 - protein, 13 aa, Artificial Sequence
  Synthetic Peptide
AAFAAAATLKKAA

SEQ ID NO: 8302 - protein, 13 aa, Artificial Sequence
  Synthetic Peptide
AAFAAAKTAAAAA

SEQ ID NO: 8303 - protein, 13 aa, Artificial Sequence
  Synthetic Peptide
AAFAAAKTAAAFA

SEQ ID NO: 8304 - protein, 13 aa, Artificial Sequence
  Synthetic Peptide
AAFAAAKTAAAFA

SEQ ID NO: 8305 - protein, 13 aa, Artificial Sequence
  Synthetic Peptide
AAFAAAKTAAAFA

SEQ ID NO: 8306 - protein, 13 aa, Artificial Sequence
  Synthetic Peptide
AAFAAAKTAAAFE

SEQ ID NO: 8307 - protein, 13 aa, Artificial Sequence
  Synthetic Peptide
AAFAAAKTAAAKA

SEQ ID NO: 8308 - protein, 13 aa, Artificial Sequence
  Synthetic Peptide
AAFAAAKTLAAAA

SEQ ID NO: 8309 - protein, 13 aa, Artificial Sequence
  Synthetic Peptide
AAFAAAKTLKAAA

SEQ ID NO: 8310 - protein, 13 aa, Artificial Sequence
  Synthetic Peptide
AAFAAKATLKAAA

SEQ ID NO: 8311 - protein, 13 aa, Artificial Sequence
  Synthetic Peptide
AAFAANKNAAFAA

SEQ ID NO: 8312 - protein, 13 aa, Artificial Sequence
  Synthetic Peptide
AAFAAQKQAAFAA

SEQ ID NO: 8313 - protein, 13 aa, Artificial Sequence
  Synthetic Peptide
AAFAATKTAAFAA

SEQ ID NO: 8314 - protein, 13 aa, Artificial Sequence
  Synthetic Peptide
AAFAKAATAKAAA

SEQ ID NO: 8315 - protein, 13 aa, Artificial Sequence
  Synthetic Peptide
AAFAKAATLKAAA

SEQ ID NO: 8316 - protein, 13 aa, Artificial Sequence
  Synthetic Peptide
AAFAKAATLKAKA

SEQ ID NO: 8317 - protein, 13 aa, Artificial Sequence
  Synthetic Peptide
AAFAKAATLKKAA

SEQ ID NO: 8318 - protein, 13 aa, Artificial Sequence
  Synthetic Peptide
AAFAKAKTLKAAA

SEQ ID NO: 8319 - protein, 13 aa, Artificial Sequence
  Synthetic Peptide
AAFAKKATLKAAA

SEQ ID NO: 8320 - protein, 13 aa, Artificial Sequence
  Synthetic Peptide
AAFFGIFKIGKFA

SEQ ID NO: 8321 - protein, 13 aa, Artificial Sequence
  Synthetic Peptide
AAFGIKIFGFKIA

SEQ ID NO: 8322 - protein, 13 aa, Artificial Sequence
  Synthetic Peptide
AAFKKAATLKAAA

SEQ ID NO: 8323 - protein, 13 aa, Artificial Sequence
  Synthetic Peptide
AAFPPPPTLKAAA

SEQ ID NO: 8324 - protein, 13 aa, Artificial Sequence
  Synthetic Peptide
AAFVSQTTLKAAA

SEQ ID NO: 8325 - protein, 13 aa, Artificial Sequence
  Synthetic Peptide
AAHAAAAAAKAAA

SEQ ID NO: 8326 - protein, 13 aa, Artificial Sequence
  Synthetic Peptide
AAIGFFFFKKGIA

SEQ ID NO: 8327 - protein, 13 aa, Artificial Sequence
  Synthetic Peptide
AAIGGIFIFKKDA

SEQ ID NO: 8328 - protein, 13 aa, Artificial Sequence
  Synthetic Peptide
AALAAAAAAKAAA

SEQ ID NO: 8329 - protein, 13 aa, Artificial Sequence
  Synthetic Peptide
AALKATAAAAYAA

SEQ ID NO: 8330 - protein, 13 aa, Artificial Sequence
  Synthetic Peptide
AAWAAAAAAKAAA

SEQ ID NO: 8331 - protein, 11 aa, Artificial Sequence
  Synthetic Peptide
AAYAAAAKAAA

SEQ ID NO: 8332 - protein, 11 aa, Artificial Sequence
  Synthetic Peptide
AAYAAAAKAAA

SEQ ID NO: 8333 - protein, 12 aa, Artificial Sequence
  Synthetic Peptide
AAYAAAAAKAAA

SEQ ID NO: 8334 - protein, 12 aa, Artificial Sequence
  Synthetic Peptide
AAYAAAAAKAAA

SEQ ID NO: 8335 - protein, 12 aa, Artificial Sequence
  Synthetic Peptide
AAYAAAAAKAAA

SEQ ID NO: 8336 - protein, 12 aa, Artificial Sequence
  Synthetic Peptide
AAYAAAAAKAAA

SEQ ID NO: 8337 - protein, 12 aa, Artificial Sequence
  Synthetic Peptide
AAYAAAAAKAAA

SEQ ID NO: 8338 - protein, 12 aa, Artificial Sequence
  Synthetic Peptide
AAYAAAAAKAAA

SEQ ID NO: 8339 - protein, 13 aa, Artificial Sequence
  Synthetic Peptide
AAYAAAAAAKAAA

SEQ ID NO: 8340 - protein, 13 aa, Artificial Sequence
  Synthetic Peptide
AAYAAAAPAKAAA

SEQ ID NO: 8341 - protein, 13 aa, Artificial Sequence
  Synthetic Peptide
AAYAAAATAAAKA

SEQ ID NO: 8342 - protein, 13 aa, Artificial Sequence
  Synthetic Peptide
AAYAAAATAKAAA

SEQ ID NO: 8343 - protein, 13 aa, Artificial Sequence
  Synthetic Peptide
AAYAAAAYAAAKA

SEQ ID NO: 8344 - protein, 11 aa, Artificial Sequence
  Synthetic Peptide
AAYAAAAKAAA

SEQ ID NO: 8345 - protein, 13 aa, Artificial Sequence
  Synthetic Peptide
AAYAKAATLKAAA

SEQ ID NO: 8346 - protein, 12 aa, Artificial Sequence
  Synthetic Peptide
AAAAAATLKAAA

SEQ ID NO: 8347 - protein, 12 aa, Artificial Sequence
  Synthetic Peptide
AAAAAKTAAAAA

SEQ ID NO: 8348 - protein, 12 aa, Artificial Sequence
  Synthetic Peptide
AAAKAAAAAAAA

SEQ ID NO: 8349 - protein, 13 aa, Artificial Sequence
  Synthetic Peptide
AAAKAAAAAAYAA

SEQ ID NO: 8350 - protein, 13 aa, Artificial Sequence
  Synthetic Peptide
AAAKAAAAAAYAA

SEQ ID NO: 8351 - protein, 13 aa, Artificial Sequence
  Synthetic Peptide
AAFAAAATAKAAA

SEQ ID NO: 8352 - protein, 13 aa, Artificial Sequence
  Synthetic Peptide
AAFAAAATLKAAA

SEQ ID NO: 8353 - protein, 13 aa, Artificial Sequence
  Synthetic Peptide
AAFAAAKTAAAAA

SEQ ID NO: 8354 - protein, 13 aa, Artificial Sequence
  Synthetic Peptide
AAFAAAKTAAAFA

SEQ ID NO: 8355 - protein, 13 aa, Artificial Sequence
  Synthetic Peptide
AAFAAAKTLAAAA

SEQ ID NO: 8356 - protein, 13 aa, Artificial Sequence
  Synthetic Peptide
AAFAANKNAAFAA

SEQ ID NO: 8357 - protein, 13 aa, Artificial Sequence
  Synthetic Peptide
AAFAAQKQAAFAA

SEQ ID NO: 8358 - protein, 13 aa, Artificial Sequence
  Synthetic Peptide
AAFAATKTAAFAA

SEQ ID NO: 8359 - protein, 13 aa, Artificial Sequence
  Synthetic Peptide
YAALFLSAARKRA

SEQ ID NO: 8360 - protein, 13 aa, Artificial Sequence
  Synthetic Peptide
YAAAAAATLKAAA

SEQ ID NO: 8361 - protein, 13 aa, Artificial Sequence
  Synthetic Peptide
YAAAAAKTAAAAA

SEQ ID NO: 8362 - protein, 14 aa, Artificial Sequence
  Synthetic Peptide
YAAFAAAATAKAAA

SEQ ID NO: 8363 - protein, 14 aa, Artificial Sequence
  Synthetic Peptide
YAAFAAAATLKAAA

SEQ ID NO: 8364 - protein, 14 aa, Artificial Sequence
  Synthetic Peptide
YAAFAAAKTAAAAA

SEQ ID NO: 8365 - protein, 14 aa, Artificial Sequence
  Synthetic Peptide
YAAFAAAKTAAAFA

SEQ ID NO: 8366 - protein, 14 aa, Artificial Sequence
  Synthetic Peptide
YAAFAAAKTLAAAA

SEQ ID NO: 8367 - protein, 14 aa, Artificial Sequence
  Synthetic Peptide
YARFLALTTLRARA

SEQ ID NO: 8368 - protein, 12 aa, Artificial Sequence
  Synthetic Peptide
AEAAAATLKAAA

SEQ ID NO: 8369 - protein, 13 aa, Artificial Sequence
  Synthetic Peptide
AEFAAAKTLAAFA

SEQ ID NO: 8370 - protein, 12 aa, Artificial Sequence
  Synthetic Peptide
AFAAAATLKAAA

SEQ ID NO: 8371 - protein, 9 aa, Artificial Sequence
  Synthetic Peptide
AFAAAKTAA

SEQ ID NO: 8372 - protein, 11 aa, Artificial Sequence
  Synthetic Peptide
AFAAAKTAAAA

SEQ ID NO: 8373 - protein, 10 aa, Artificial Sequence
  Synthetic Peptide
AFAAAKTAAA

SEQ ID NO: 8374 - protein, 14 aa, Artificial Sequence
  Synthetic Peptide
AFLRAAAAAAFAAY

SEQ ID NO: 8375 - protein, 12 aa, Artificial Sequence
  Synthetic Peptide
AKAAAATLKAAA

SEQ ID NO: 8376 - protein, 12 aa, Artificial Sequence
  Synthetic Peptide
AKVAAATLKAAA

SEQ ID NO: 8377 - protein, 12 aa, Artificial Sequence
  Synthetic Peptide
AKVAAHTLKAAA

SEQ ID NO: 8378 - protein, 12 aa, Artificial Sequence
  Synthetic Peptide
AKVAAKTLKAAA

SEQ ID NO: 8379 - protein, 12 aa, Artificial Sequence
  Synthetic Peptide
AKVAANTLKAAA

SEQ ID NO: 8380 - protein, 12 aa, Artificial Sequence
  Synthetic Peptide
AKVAANTLKAAA

SEQ ID NO: 8381 - protein, 12 aa, Artificial Sequence
  Synthetic Peptide
AKVAAWTLKAAA

SEQ ID NO: 8382 - protein, 12 aa, Artificial Sequence
  Synthetic Peptide
AKVAAWTLKAAA

SEQ ID NO: 8383 - protein, 12 aa, Artificial Sequence
  Synthetic Peptide
AKVAAYTLKAAA

SEQ ID NO: 8384 - protein, 12 aa, Artificial Sequence
  Synthetic Peptide
AKVAAYTLKAAA

SEQ ID NO: 8385 - protein, 12 aa, Artificial Sequence
  Synthetic Peptide
AKVKAHTLKAAA

SEQ ID NO: 8386 - protein, 12 aa, Artificial Sequence
  Synthetic Peptide
AKVKAHTLKAAA

SEQ ID NO: 8387 - protein, 12 aa, Artificial Sequence
  Synthetic Peptide
AKVKANTLKAAA

SEQ ID NO: 8388 - protein, 12 aa, Artificial Sequence
  Synthetic Peptide
AKVKANTLKAAA

SEQ ID NO: 8389 - protein, 12 aa, Artificial Sequence
  Synthetic Peptide
AKVKAWTLKAAA

SEQ ID NO: 8390 - protein, 12 aa, Artificial Sequence
  Synthetic Peptide
AKVKAWTLKAAA

SEQ ID NO: 8391 - protein, 12 aa, Artificial Sequence
  Synthetic Peptide
AKVWANTLKAAA

SEQ ID NO: 8392 - protein, 12 aa, Artificial Sequence
  Synthetic Peptide
AKVWANTLKAAA

SEQ ID NO: 8393 - protein, 12 aa, Artificial Sequence
  Synthetic Peptide
AKVWAYTLKAAA

SEQ ID NO: 8394 - protein, 12 aa, Artificial Sequence
  Synthetic Peptide
AKVWAYTLKAAA

SEQ ID NO: 8395 - protein, 12 aa, Artificial Sequence
  Synthetic Peptide
AKVYAWTLKAAA

SEQ ID NO: 8396 - protein, 12 aa, Artificial Sequence
  Synthetic Peptide
AKVYAWTLKAAA

SEQ ID NO: 8397 - protein, 16 aa, Artificial Sequence
  Synthetic Peptide
AKAAKAAKAAKAAKAA

SEQ ID NO: 8398 - protein, 13 aa, Artificial Sequence
  Synthetic Peptide
AKFAAAATLKAAA

SEQ ID NO: 8399 - protein, 13 aa, Artificial Sequence
  Synthetic Peptide
AKFAAAKTAAAKA

SEQ ID NO: 8400 - protein, 13 aa, Artificial Sequence
  Synthetic Peptide
AKFAAALTLAAPA

SEQ ID NO: 8401 - protein, 13 aa, Artificial Sequence
  Synthetic Peptide
AKFAAALTLAQAA

SEQ ID NO: 8402 - protein, 13 aa, Artificial Sequence
  Synthetic Peptide
AKFIAADTLKAAA

SEQ ID NO: 8403 - protein, 13 aa, Artificial Sequence
  Synthetic Peptide
AKFIAAWTLKAAA

SEQ ID NO: 8404 - protein, 13 aa, Artificial Sequence
  Synthetic Peptide
AKFVAAWTLKAAA

SEQ ID NO: 8405 - protein, 13 aa, Artificial Sequence
  Synthetic Peptide
AKFVAAWTLKAAA

SEQ ID NO: 8406 - protein, 13 aa, Artificial Sequence
  Synthetic Peptide
AKFVAAYTLKAAA

SEQ ID NO: 8407 - protein, 13 aa, Artificial Sequence
  Synthetic Peptide
AKFVADWTLKAAA

SEQ ID NO: 8408 - protein, 13 aa, Artificial Sequence
  Synthetic Peptide
AKFVIAWTLKAAA

SEQ ID NO: 8409 - protein, 13 aa, Artificial Sequence
  Synthetic Peptide
AKFVWANTLKAAA

SEQ ID NO: 8410 - protein, 13 aa, Artificial Sequence
  Synthetic Peptide
AKFVYANTLKAAA

SEQ ID NO: 8411 - protein, 13 aa, Artificial Sequence
  Synthetic Peptide
AKIVAAWTLKAAA

SEQ ID NO: 8412 - protein, 13 aa, Artificial Sequence
  Synthetic Peptide
AKIVADWTLKAAA

SEQ ID NO: 8413 - protein, 13 aa, Artificial Sequence
  Synthetic Peptide
AKLVAAWTLKAAA

SEQ ID NO: 8414 - protein, 13 aa, Artificial Sequence
  Synthetic Peptide
AKMVAAWTLKAAA

SEQ ID NO: 8415 - protein, 13 aa, Artificial Sequence
  Synthetic Peptide
AKMVADWTLKAAA

SEQ ID NO: 8416 - protein, 12 aa, Artificial Sequence
  Synthetic Peptide
AQAAAATLKAAA

SEQ ID NO: 8417 - protein, 12 aa, Artificial Sequence
  Synthetic Peptide
ARVRANTLKAAA

SEQ ID NO: 8418 - protein, 11 aa, Artificial Sequence
  Synthetic Peptide
ARRQTTLKAAA

SEQ ID NO: 8419 - protein, 13 aa, Artificial Sequence
  Synthetic Peptide
ARFQRQTTLKAAA

SEQ ID NO: 8420 - protein, 13 aa, Artificial Sequence
  Synthetic Peptide
ARFQRQTTLKAAA

SEQ ID NO: 8421 - protein, 13 aa, Artificial Sequence
  Synthetic Peptide
ARRLKARRLKAIY

SEQ ID NO: 8422 - protein, 12 aa, Artificial Sequence
  Synthetic Peptide
AVAAAATLKAAA

SEQ ID NO: 8423 - protein, 12 aa, Artificial Sequence
  Synthetic Peptide
AVAVAATLKAFA

SEQ ID NO: 8424 - protein, 12 aa, Artificial Sequence
  Synthetic Peptide
AVVFAATLKAFA

SEQ ID NO: 8425 - protein, 12 aa, Artificial Sequence
  Synthetic Peptide
AVVVAATLKAAA

SEQ ID NO: 8426 - protein, 12 aa, Artificial Sequence
  Synthetic Peptide
AVVVAATLKAFA

SEQ ID NO: 8427 - protein, 21 aa, Artificial Sequence
  Synthetic Peptide
AWRNRAKAWRNRAKAWRNRAK

SEQ ID NO: 8428 - protein, 17 aa, Artificial Sequence
  Synthetic Peptide
AWRNRAKAWRNRAKGTD

SEQ ID NO: 8429 - protein, 10 aa, Artificial Sequence
  Synthetic Peptide
AYAAAAKAAA

SEQ ID NO: 8430 - protein, 13 aa, Artificial Sequence
  Synthetic Peptide
AYZAYAYTLKAAA

SEQ ID NO: 8431 - protein, 15 aa, Artificial Sequence
  Synthetic Peptide
BCAYZAYAYTLKAAA

SEQ ID NO: 8432 - protein, 14 aa, Artificial Sequence
  Synthetic Peptide
  VARIANT 3, 6, 8: Xaa = Any Amino Acid
BCXFAXAXTLKAAA

SEQ ID NO: 8433 - protein, 19 aa, Artificial Sequence
  Synthetic Peptide
DDYVKQYTKQYTKQNTLKK

SEQ ID NO: 8434 - protein, 19 aa, Artificial Sequence
  Synthetic Peptide
DDYVKQYTKQYTKQNTLKK

SEQ ID NO: 8435 - protein, 14 aa, Artificial Sequence
  Synthetic Peptide
EFAAATKAAAFAAY

SEQ ID NO: 8436 - protein, 11 aa, Artificial Sequence
  Synthetic Peptide
GGGGKGGGGFG

SEQ ID NO: 8437 - protein, 9 aa, Artificial Sequence
  Synthetic Peptide
YAAAAKAAA

SEQ ID NO: 8438 - protein, 17 aa, Artificial Sequence
  Synthetic Peptide
KNRAKNRAKNRAKNRAK

SEQ ID NO: 8439 - protein, 15 aa, Artificial Sequence
  Synthetic Peptide
KRLKRLKRLKRLKRL

SEQ ID NO: 8440 - protein, 15 aa, Artificial Sequence
  Synthetic Peptide
KSSAKVAAWTLKAAA

SEQ ID NO: 8441 - protein, 13 aa, Artificial Sequence
  Synthetic Peptide
PKYDKQGGLKIAT

SEQ ID NO: 8442 - protein, 13 aa, Artificial Sequence
  Synthetic Peptide
PKYFKQFRLKIAT

SEQ ID NO: 8443 - protein, 13 aa, Artificial Sequence
  Synthetic Peptide
PKYFKQIGLKRAT

SEQ ID NO: 8444 - protein, 13 aa, Artificial Sequence
  Synthetic Peptide
PKYGKQRFLKIAT

SEQ ID NO: 8445 - protein, 13 aa, Artificial Sequence
  Synthetic Peptide
PKYIKQDGLKGAT

SEQ ID NO: 8446 - protein, 13 aa, Artificial Sequence
  Synthetic Peptide
PKYIKQFFLKRAT

SEQ ID NO: 8447 - protein, 13 aa, Artificial Sequence
  Synthetic Peptide
PKYIKQIILKIAT

SEQ ID NO: 8448 - protein, 13 aa, Artificial Sequence
  Synthetic Peptide
PKYRKQFILKGAT

SEQ ID NO: 8449 - protein, 13 aa, Artificial Sequence
  Synthetic Peptide
PNYAAAAAAKAAA

SEQ ID NO: 8450 - protein, 12 aa, Artificial Sequence
  Synthetic Peptide
PNYAAAAAAKAA

SEQ ID NO: 8451 - protein, 12 aa, Artificial Sequence
  Synthetic Peptide
RFQRQTTLKAAA

SEQ ID NO: 8452 - protein, 15 aa, Artificial Sequence
  Synthetic Peptide
TAIKKLTTQRQFRAY

SEQ ID NO: 8453 - protein, 14 aa, Artificial Sequence
  Synthetic Peptide
TKQKLTTQSQFRAY

SEQ ID NO: 8454 - protein, 12 aa, Artificial Sequence
  Synthetic Peptide
  VARIANT 1, 4, 6: Xaa = Any Amino Acid
XFAXAXTLKAAA

SEQ ID NO: 8455 - protein, 13 aa, Artificial Sequence
  Synthetic Peptide
YAFAAAKTAAAFA

SEQ ID NO: 8456 - protein, 11 aa, Artificial Sequence
  Synthetic Peptide
YAFQQTTLAAA

SEQ ID NO: 8457 - protein, 13 aa, Artificial Sequence
  Synthetic Peptide
YAALFLSAARKRA

SEQ ID NO: 8458 - protein, 12 aa, Artificial Sequence
  Synthetic Peptide
YAAAAAAKAAAA

SEQ ID NO: 8459 - protein, 13 aa, Artificial Sequence
  Synthetic Peptide
YAAAAAAPKAAAA

SEQ ID NO: 8460 - protein, 13 aa, Artificial Sequence
  Synthetic Peptide
YAAAAAATKAAAA

SEQ ID NO: 8461 - protein, 13 aa, Artificial Sequence
  Synthetic Peptide
YAAAAAATLKAAA

SEQ ID NO: 8462 - protein, 13 aa, Artificial Sequence
  Synthetic Peptide
YAAAAAKTAAAAA

SEQ ID NO: 8463 - protein, 13 aa, Artificial Sequence
  Synthetic Peptide
YAAAVAATLKAAA

SEQ ID NO: 8464 - protein, 13 aa, Artificial Sequence
  Synthetic Peptide
YAAAAAATKAAAA

SEQ ID NO: 8465 - protein, 13 aa, Artificial Sequence
  Synthetic Peptide
YAAAAAKTAAAFA

SEQ ID NO: 8466 - protein, 14 aa, Artificial Sequence
  Synthetic Peptide
YAAAKAAAAAAFAA

SEQ ID NO: 8467 - protein, 13 aa, Artificial Sequence
  Synthetic Peptide
YAAFAAATAAAFA

SEQ ID NO: 8468 - protein, 13 aa, Artificial Sequence
  Synthetic Peptide
YAAFAAATAAAFA

SEQ ID NO: 8469 - protein, 13 aa, Artificial Sequence
  Synthetic Peptide
YAAFAAAAKAAAA

SEQ ID NO: 8470 - protein, 14 aa, Artificial Sequence
  Synthetic Peptide
YAAFAAAAAAKAAA

SEQ ID NO: 8471 - protein, 14 aa, Artificial Sequence
  Synthetic Peptide
YAAFAAAAAARLFA

SEQ ID NO: 8472 - protein, 14 aa, Artificial Sequence
  Synthetic Peptide
YAAFAAAAAQRLFA

SEQ ID NO: 8473 - protein, 14 aa, Artificial Sequence
  Synthetic Peptide
YAAFAAAATAKAAA

SEQ ID NO: 8474 - protein, 14 aa, Artificial Sequence
  Synthetic Peptide
YAAFAAAATLKAAA

SEQ ID NO: 8475 - protein, 14 aa, Artificial Sequence
  Synthetic Peptide
YAAFAAAKTAAAAA

SEQ ID NO: 8476 - protein, 14 aa, Artificial Sequence
  Synthetic Peptide
YAAFAAAKTAAAAA

SEQ ID NO: 8477 - protein, 14 aa, Artificial Sequence
  Synthetic Peptide
YAAFAAAKTAAAAA

SEQ ID NO: 8478 - protein, 14 aa, Artificial Sequence
  Synthetic Peptide
YAAFAAAKTAAAFA

SEQ ID NO: 8479 - protein, 14 aa, Artificial Sequence
  Synthetic Peptide
YAAFAAAKTAAAFA

SEQ ID NO: 8480 - protein, 14 aa, Artificial Sequence
  Synthetic Peptide
YAAFAAAKTAAAFA

SEQ ID NO: 8481 - protein, 14 aa, Artificial Sequence
  Synthetic Peptide
YAAFAAAKTAAAFE

SEQ ID NO: 8482 - protein, 14 aa, Artificial Sequence
  Synthetic Peptide
YAAFAAAKTLAAAA

SEQ ID NO: 8483 - protein, 14 aa, Artificial Sequence
  Synthetic Peptide
YAAFQRQTTLKAAA

SEQ ID NO: 8484 - protein, 14 aa, Artificial Sequence
  Synthetic Peptide
YAAFQSQTTLKAAA

SEQ ID NO: 8485 - protein, 14 aa, Artificial Sequence
  Synthetic Peptide
YAAFVRQTTLKAAA

SEQ ID NO: 8486 - protein, 14 aa, Artificial Sequence
  Synthetic Peptide
YAAFVSQTTLKAAA

SEQ ID NO: 8487 - protein, 14 aa, Artificial Sequence
  Synthetic Peptide
YAEFAAAKTLAAFA

SEQ ID NO: 8488 - protein, 13 aa, Artificial Sequence
  Synthetic Peptide
YAKQRQTTLKAAA

SEQ ID NO: 8489 - protein, 13 aa, Artificial Sequence
  Synthetic Peptide
YAKFAAAKTAAAA

SEQ ID NO: 8490 - protein, 14 aa, Artificial Sequence
  Synthetic Peptide
YAKFKSTTKKRIKS

SEQ ID NO: 8491 - protein, 14 aa, Artificial Sequence
  Synthetic Peptide
YAKFVAAWTLKAAA

SEQ ID NO: 8492 - protein, 13 aa, Artificial Sequence
  Synthetic Peptide
YARQSQTTLKAKT

SEQ ID NO: 8493 - protein, 13 aa, Artificial Sequence
  Synthetic Peptide
YARQKQTTLKAAA

SEQ ID NO: 8494 - protein, 13 aa, Artificial Sequence
  Synthetic Peptide
YARQRQTTLKAAA

SEQ ID NO: 8495 - protein, 13 aa, Artificial Sequence
  Synthetic Peptide
YARQRQTTLKAAA

SEQ ID NO: 8496 - protein, 13 aa, Artificial Sequence
  Synthetic Peptide
YARASQTTLKAKT

SEQ ID NO: 8497 - protein, 13 aa, Artificial Sequence
  Synthetic Peptide
YARASQTTLKAKT

SEQ ID NO: 8498 - protein, 12 aa, Artificial Sequence
  Synthetic Peptide
YARRQTTLKAAA

SEQ ID NO: 8499 - protein, 12 aa, Artificial Sequence
  Synthetic Peptide
YARRQTTLKAAA

SEQ ID NO: 8500 - protein, 12 aa, Artificial Sequence
  Synthetic Peptide
YARSQTTLKAKT

SEQ ID NO: 8501 - protein, 12 aa, Artificial Sequence
  Synthetic Peptide
YARSQTTLKAKT

SEQ ID NO: 8502 - protein, 13 aa, Artificial Sequence
  Synthetic Peptide
YARASQTTLKAKT

SEQ ID NO: 8503 - protein, 13 aa, Artificial Sequence
  Synthetic Peptide
YARQSQTTLKAKT

SEQ ID NO: 8504 - protein, 14 aa, Artificial Sequence
  Synthetic Peptide
YAREQSQTTLKAKT

SEQ ID NO: 8505 - protein, 14 aa, Artificial Sequence
  Synthetic Peptide
YARFGGQTTLKAKT

SEQ ID NO: 8506 - protein, 14 aa, Artificial Sequence
  Synthetic Peptide
YARFLALTTLRARA

SEQ ID NO: 8507 - protein, 14 aa, Artificial Sequence
  Synthetic Peptide
YARFLALTTLRARA

SEQ ID NO: 8508 - protein, 13 aa, Artificial Sequence
  Synthetic Peptide
YARFQSQTLKAKT

SEQ ID NO: 8509 - protein, 14 aa, Artificial Sequence
  Synthetic Peptide
YARFQSQTELKAKT

SEQ ID NO: 8510 - protein, 13 aa, Artificial Sequence
  Synthetic Peptide
YARFQSQTTLAKT

SEQ ID NO: 8511 - protein, 14 aa, Artificial Sequence
  Synthetic Peptide
YARFQSQTTLKEKT

SEQ ID NO: 8512 - protein, 15 aa, Artificial Sequence
  Synthetic Peptide
YARRLKAIFARRLKA

SEQ ID NO: 8513 - protein, 14 aa, Artificial Sequence
  Synthetic Peptide
YASFQSQTTLKAAA

SEQ ID NO: 8514 - protein, 14 aa, Artificial Sequence
  Synthetic Peptide
YASFVSQTTLKAAA

SEQ ID NO: 8515 - protein, 30 aa, Artificial Sequence
  Synthetic Peptide
YKKSIQFHWKNSNQIKILGNQGSFLTKGPS

SEQ ID NO: 8516 - protein, 14 aa, Artificial Sequence
  Synthetic Peptide
YPKFVKQNTLKAAT

SEQ ID NO: 8517 - protein, 15 aa, Artificial Sequence
  Synthetic Peptide
YQFIKANSKFKGKFK

SEQ ID NO: 8518 - protein, 14 aa, Artificial Sequence
  Synthetic Peptide
YSSFSSSSSSKSSS

SEQ ID NO: 8519 - protein, 14 aa, Artificial Sequence
  Synthetic Peptide
YSSFSSSSSSKSSS

SEQ ID NO: 8520 - protein, 14 aa, Artificial Sequence
  Synthetic Peptide
YSSFSSSSSSSSSS

SEQ ID NO: 8521 - protein, 14 aa, Artificial Sequence
  Synthetic Peptide
YSSFSSSSSSSSSS

SEQ ID NO: 8522 - protein, 18 aa, Artificial Sequence
  Synthetic Peptide
YVKADYVKADYVKADYVK

SEQ ID NO: 8523 - protein, 16 aa, Artificial Sequence
  Synthetic Peptide
YVKQNTLAFVKQNTLA

SEQ ID NO: 8524 - protein, 16 aa, Artificial Sequence
  Synthetic Peptide
YVKQYTKQYTKQNTLK

SEQ ID NO: 8525 - protein, 14 aa, Artificial Sequence
  Synthetic Peptide
ZAAFAAAATLKAAA

SEQ ID NO: 8526 - protein, 14 aa, Artificial Sequence
  Synthetic Peptide
  VARIANT 8: Xaa = Any Amino Acid
ZAAFAAAXTAYAYA

SEQ ID NO: 8527 - protein, 14 aa, Artificial Sequence
  Synthetic Peptide
  VARIANT 6: Xaa = Any Amino Acid
ZAAFAXAATAYAYA

SEQ ID NO: 8528 - protein, 14 aa, Artificial Sequence
  Synthetic Peptide
  VARIANT 6: Xaa = Any Amino Acid
ZAAFAXAATLKAAA

SEQ ID NO: 8529 - protein, 14 aa, Artificial Sequence
  Synthetic Peptide
AAWSERAGEAMVLV

SEQ ID NO: 8530 - protein, 12 aa, Artificial Sequence
  Synthetic Peptide
DNVLDHLTGRSC

SEQ ID NO: 8531 - protein, 15 aa, Artificial Sequence
  Synthetic Peptide
NHDNVLAHLTGRSCQ

SEQ ID NO: 8532 - protein, 15 aa, Artificial Sequence
  Synthetic Peptide
NHDNVLDHLTGRSAQ

SEQ ID NO: 8533 - protein, 15 aa, Artificial Sequence
  Synthetic Peptide
NHDNVLDHLTGRSCA

SEQ ID NO: 8534 - protein, 16 aa, Artificial Sequence
  Synthetic Peptide
HYTVDKSKPKVYQWRD

SEQ ID NO: 8535 - protein, 16 aa, Artificial Sequence
  Synthetic Peptide
INTKCYKLEHPVTGCG

SEQ ID NO: 8536 - protein, 16 aa, Artificial Sequence
  Synthetic Peptide
NELGRFKHTDACCRTH

SEQ ID NO: 8537 - protein, 16 aa, Artificial Sequence
  Synthetic Peptide
NNDFYDNSADTISSYF

SEQ ID NO: 8538 - protein, 14 aa, Artificial Sequence
  Synthetic Peptide
SKPKVYQWFDLRKY

SEQ ID NO: 8539 - protein, 16 aa, Artificial Sequence
  Synthetic Peptide
SSYFVGKMYFNLINTK

SEQ ID NO: 8540 - protein, 24 aa, Artificial Sequence
  Synthetic Peptide
PDTRPAPGSTAPPAHGVTSAPDTR

SEQ ID NO: 8541 - protein, 16 aa, Artificial Sequence
  Synthetic Peptide
ALPVFTWLALYFTSAK

SEQ ID NO: 8542 - protein, 16 aa, Artificial Sequence
  Synthetic Peptide
ALYFTSAKIPQEWKPA

SEQ ID NO: 8543 - protein, 16 aa, Artificial Sequence
  Synthetic Peptide
FATSFLIPLTSQFFLP

SEQ ID NO: 8544 - protein, 16 aa, Artificial Sequence
  Synthetic Peptide
GLFCRWSYTEIEKIDI

SEQ ID NO: 8545 - protein, 16 aa, Artificial Sequence
  Synthetic Peptide
GLFSRWSYTEIEKIDI

SEQ ID NO: 8546 - protein, 16 aa, Artificial Sequence
  Synthetic Peptide
IGGAMLSLTVFEFTKY

SEQ ID NO: 8547 - protein, 16 aa, Artificial Sequence
  Synthetic Peptide
IKLPIILAFATSFLIP

SEQ ID NO: 8548 - protein, 16 aa, Artificial Sequence
  Synthetic Peptide
IMEVLFLSWLFPRFKF

SEQ ID NO: 8549 - protein, 16 aa, Artificial Sequence
  Synthetic Peptide
LTNNDQVSGINEEDEE

SEQ ID NO: 8550 - protein, 17 aa, Artificial Sequence
  Synthetic Peptide
MMASSILRSKIIQKPYQ

SEQ ID NO: 8551 - protein, 16 aa, Artificial Sequence
  Synthetic Peptide
PSLHSGSSIMEVLFLS

SEQ ID NO: 8552 - protein, 16 aa, Artificial Sequence
  Synthetic Peptide
SSIIFGAFPSLHSGSS

SEQ ID NO: 8553 - protein, 16 aa, Artificial Sequence
  Synthetic Peptide
VSILFFVFVVFPASFF

SEQ ID NO: 8554 - protein, 15 aa, Artificial Sequence
  Synthetic Peptide
IAKITPDNNGTYACF

SEQ ID NO: 8555 - protein, 15 aa, Artificial Sequence
  Synthetic Peptide
IPNITVDNSGSYTCQ

SEQ ID NO: 8556 - protein, 15 aa, Artificial Sequence
  Synthetic Peptide
IQNIIQDDTGFYTLH

SEQ ID NO: 8557 - protein, 15 aa, Artificial Sequence
  Synthetic Peptide
LFNVTRDDARAYVCG

SEQ ID NO: 8558 - protein, 15 aa, Artificial Sequence
  Synthetic Peptide
LFNVTRDDTASYKCE

SEQ ID NO: 8559 - protein, 15 aa, Artificial Sequence
  Synthetic Peptide
LLSVTRDDVGPYECG

SEQ ID NO: 8560 - protein, 15 aa, Artificial Sequence
  Synthetic Peptide
LWWVNNESLPVSPRL

SEQ ID NO: 8561 - protein, 15 aa, Artificial Sequence
  Synthetic Peptide
LWWVNNESLPVSPRL

SEQ ID NO: 8562 - protein, 15 aa, Artificial Sequence
  Synthetic Peptide
QELFIPDITVNNSGS

SEQ ID NO: 8563 - protein, 15 aa, Artificial Sequence
  Synthetic Peptide
QELFISDITEKNSGL

SEQ ID NO: 8564 - protein, 15 aa, Artificial Sequence
  Synthetic Peptide
REIIYPDASLLIQNI

SEQ ID NO: 8565 - protein, 15 aa, Artificial Sequence
  Synthetic Peptide
SCHAASDPPAQYSWF

SEQ ID NO: 8566 - protein, 15 aa, Artificial Sequence
  Synthetic Peptide
TITVYADPPKPFITS

SEQ ID NO: 8567 - protein, 15 aa, Artificial Sequence
  Synthetic Peptide
VLLLVHDLPQHLFGY

SEQ ID NO: 8568 - protein, 15 aa, Artificial Sequence
  Synthetic Peptide
YACFVSDLATGRNNS

SEQ ID NO: 8569 - protein, 25 aa, Artificial Sequence
  Synthetic Peptide
PTTTPITTTTTVTPTPTPTGTQTYC

SEQ ID NO: 8570 - protein, 11 aa, Artificial Sequence
  Synthetic Peptide
YIAFLKQATAK

SEQ ID NO: 8571 - protein, 10 aa, Artificial Sequence
  Synthetic Peptide
FLRRIRPKLK

SEQ ID NO: 8572 - protein, 11 aa, Artificial Sequence
  Synthetic Peptide
GFLRRIRPKLK

SEQ ID NO: 8573 - protein, 9 aa, Artificial Sequence
  Synthetic Peptide
LRRIRPKLK

SEQ ID NO: 8574 - protein, 13 aa, Artificial Sequence
  Synthetic Peptide
YGGFLRRIRPKLK

SEQ ID NO: 8575 - protein, 15 aa, Artificial Sequence
  Synthetic Peptide
DDNGPQDPDNTDDNG

SEQ ID NO: 8576 - protein, 13 aa, Artificial Sequence
  Synthetic Peptide
PYYTGEHAKAIGN

SEQ ID NO: 8577 - protein, 20 aa, Artificial Sequence
  Synthetic Peptide
FPQPQLPYSQPQPFRPQQPY

SEQ ID NO: 8578 - protein, 16 aa, Artificial Sequence
  Synthetic Peptide
IPPYCTIAPFGIFGIN

SEQ ID NO: 8579 - protein, 16 aa, Artificial Sequence
  Synthetic Peptide
IRNLALQTLPAMCNVY

SEQ ID NO: 8580 - protein, 20 aa, Artificial Sequence
  Synthetic Peptide
LGQQQPFPPQQPYPQPQPFP

SEQ ID NO: 8581 - protein, 20 aa, Artificial Sequence
  Synthetic Peptide
LHQQQKQQQQPSSQVSFQQP

SEQ ID NO: 8582 - protein, 20 aa, Artificial Sequence
  Synthetic Peptide
LLQELCCQHLWQIPEQSQCQ

SEQ ID NO: 8583 - protein, 20 aa, Artificial Sequence
  Synthetic Peptide
LQQHNIAHGRSQVLQQSTYQ

SEQ ID NO: 8584 - protein, 12 aa, Artificial Sequence
  Synthetic Peptide
PQPFRPQQPYPQ

SEQ ID NO: 8585 - protein, 16 aa, Artificial Sequence
  Synthetic Peptide
PQPFRPQQPYPQPQPQ

SEQ ID NO: 8586 - protein, 20 aa, Artificial Sequence
  Synthetic Peptide
PQPFRPQQPYPQPQPQYSQP

SEQ ID NO: 8587 - protein, 20 aa, Artificial Sequence
  Synthetic Peptide
PQPQPQYSQPQQPISQQQQQ

SEQ ID NO: 8588 - protein, 20 aa, Artificial Sequence
  Synthetic Peptide
PSSQVSFQQPLQQYPLGQGS

SEQ ID NO: 8589 - protein, 12 aa, Artificial Sequence
  Synthetic Peptide
QFEEIRNLALQT

SEQ ID NO: 8590 - protein, 16 aa, Artificial Sequence
  Synthetic Peptide
QFEEIRNLALQTLPAM

SEQ ID NO: 8591 - protein, 20 aa, Artificial Sequence
  Synthetic Peptide
QFEEIRNLALQTLPAMCNVY

SEQ ID NO: 8592 - protein, 12 aa, Artificial Sequence
  Synthetic Peptide
QFLGQQQPFPPQ

SEQ ID NO: 8593 - protein, 20 aa, Artificial Sequence
  Synthetic Peptide
QGSVQPQQLPQFEEIRNLAL

SEQ ID NO: 8594 - protein, 20 aa, Artificial Sequence
  Synthetic Peptide
QNPSQQQPQEQVPLVQQQQF

SEQ ID NO: 8595 - protein, 20 aa, Artificial Sequence
  Synthetic Peptide
QPYPQPQPFPSQQPYLQLQP

SEQ ID NO: 8596 - protein, 20 aa, Artificial Sequence
  Synthetic Peptide
QQLIFCMDVVLQQHNIAHGR

SEQ ID NO: 8597 - protein, 12 aa, Artificial Sequence
  Synthetic Peptide
QVPLVQQQQFLG

SEQ ID NO: 8598 - protein, 16 aa, Artificial Sequence
  Synthetic Peptide
QVPLVQQQQFLGQQQP

SEQ ID NO: 8599 - protein, 20 aa, Artificial Sequence
  Synthetic Peptide
QVPLVQQQQFLGQQQPFPPQ

SEQ ID NO: 8600 - protein, 20 aa, Artificial Sequence
  Synthetic Peptide
SQQPYLQLQPFPQPQLPYSQ

SEQ ID NO: 8601 - protein, 16 aa, Artificial Sequence
  Synthetic Peptide
VQQQQFLGQQQPFPPQ

SEQ ID NO: 8602 - protein, 20 aa, Artificial Sequence
  Synthetic Peptide
VRVPVPQLQPQNPSQQQPQE

SEQ ID NO: 8603 - protein, 17 aa, Artificial Sequence
  Synthetic Peptide
YIPPYCTIAPFGIFGIN

SEQ ID NO: 8604 - protein, 21 aa, Artificial Sequence
  Synthetic Peptide
YPSSQVSFQQPLQQYPLGQGS

SEQ ID NO: 8605 - protein, 21 aa, Artificial Sequence
  Synthetic Peptide
YQGSVQPQQLPQFEEIRNLAL

SEQ ID NO: 8606 - protein, 22 aa, Artificial Sequence
  Synthetic Peptide
EKVPVSEVMGTTLAEMSTPEAT

SEQ ID NO: 8607 - protein, 19 aa, Artificial Sequence
  Synthetic Peptide
IYRRRLMKQDFSVPQLPHS

SEQ ID NO: 8608 - protein, 21 aa, Artificial Sequence
  Synthetic Peptide
KRCLLHLAVIGALLAVGATKV

SEQ ID NO: 8609 - protein, 22 aa, Artificial Sequence
  Synthetic Peptide
LCQPVLPSPACQLVLHQILKGG

SEQ ID NO: 8610 - protein, 22 aa, Artificial Sequence
  Synthetic Peptide
MTPAEVSIVVLSGTTAAQVTTT

SEQ ID NO: 8611 - protein, 22 aa, Artificial Sequence
  Synthetic Peptide
PGPVTAQVVLQAAIPLTSCGSS

SEQ ID NO: 8612 - protein, 23 aa, Artificial Sequence
  Synthetic Peptide
VSGLSIGTGRAMLGTHTMEVTVY

SEQ ID NO: 8613 - protein, 20 aa, Artificial Sequence
  Synthetic Peptide
VYVWKTTWGQYWQVLGGPVS

SEQ ID NO: 8614 - protein, 14 aa, Artificial Sequence
  Synthetic Peptide
WNRQLYPEWTEAQR

SEQ ID NO: 8615 - protein, 15 aa, Artificial Sequence
  Synthetic Peptide
AKRKTVTAMDVVYAL

SEQ ID NO: 8616 - protein, 24 aa, Artificial Sequence
  Synthetic Peptide
KRHRKVLRDNIQGITKPAIRRLAR

SEQ ID NO: 8617 - protein, 15 aa, Artificial Sequence
  Synthetic Peptide
KTVTAMDVVYALKRQ

SEQ ID NO: 8618 - protein, 15 aa, Artificial Sequence
  Synthetic Peptide
LRDNIQGITKPAIRR

SEQ ID NO: 8619 - protein, 15 aa, Artificial Sequence
  Synthetic Peptide
NIQGITKPAIRRLAR

SEQ ID NO: 8620 - protein, 24 aa, Artificial Sequence
  Synthetic Peptide
TYTEHAKRKTVTAMDVVYALKRQG

SEQ ID NO: 8621 - protein, 11 aa, Artificial Sequence
  Synthetic Peptide
KYVKQNTLKAT

SEQ ID NO: 8622 - protein, 13 aa, Artificial Sequence
  Synthetic Peptide
PKYVKQNTLKLAT

SEQ ID NO: 8623 - protein, 16 aa, Artificial Sequence
  Synthetic Peptide
AHAAHAAHAAHAAHAA

SEQ ID NO: 8624 - protein, 18 aa, Artificial Sequence
  Synthetic Peptide
BITINPRYVRQNTLRATC

SEQ ID NO: 8625 - protein, 12 aa, Artificial Sequence
  Synthetic Peptide
CPKYVRSAKLRM

SEQ ID NO: 8626 - protein, 10 aa, Artificial Sequence
  Synthetic Peptide
GACPKYVKQN

SEQ ID NO: 8627 - protein, 12 aa, Artificial Sequence
  Synthetic Peptide
GACPKYVKQNTL

SEQ ID NO: 8628 - protein, 13 aa, Artificial Sequence
  Synthetic Peptide
GACPKYVKQNTLK

SEQ ID NO: 8629 - protein, 14 aa, Artificial Sequence
  Synthetic Peptide
GACPKYVKQNTLKL

SEQ ID NO: 8630 - protein, 12 aa, Artificial Sequence
  Synthetic Peptide
HNTNGVTAASSH

SEQ ID NO: 8631 - protein, 12 aa, Artificial Sequence
  Synthetic Peptide
KQNTLKLATGMR

SEQ ID NO: 8632 - protein, 18 aa, Artificial Sequence
  Synthetic Peptide
LAKQNTLAKQNTLAKQNT

SEQ ID NO: 8633 - protein, 10 aa, Artificial Sequence
  Synthetic Peptide
NTLKLATGMR

SEQ ID NO: 8634 - protein, 11 aa, Artificial Sequence
  Synthetic Peptide
PYVKQNTLKAT

SEQ ID NO: 8635 - protein, 13 aa, Artificial Sequence
  Synthetic Peptide
PFFVKQNILKLAT

SEQ ID NO: 8636 - protein, 13 aa, Artificial Sequence
  Synthetic Peptide
PFFVKQNTLKLAT

SEQ ID NO: 8637 - protein, 13 aa, Artificial Sequence
  Synthetic Peptide
PFIVKQNTLKLAT

SEQ ID NO: 8638 - protein, 13 aa, Artificial Sequence
  Synthetic Peptide
PFYVKQNTLKLAT

SEQ ID NO: 8639 - protein, 13 aa, Artificial Sequence
  Synthetic Peptide
PIFVKQNILKLAT

SEQ ID NO: 8640 - protein, 13 aa, Artificial Sequence
  Synthetic Peptide
PIFVKQNTLKLAT

SEQ ID NO: 8641 - protein, 13 aa, Artificial Sequence
  Synthetic Peptide
PIIVKQNTLKLAT

SEQ ID NO: 8642 - protein, 13 aa, Artificial Sequence
  Synthetic Peptide
PIYVKQNTLKLAT

SEQ ID NO: 8643 - protein, 11 aa, Artificial Sequence
  Synthetic Peptide
PKVKQNTLKAT

SEQ ID NO: 8644 - protein, 11 aa, Artificial Sequence
  Synthetic Peptide
PKVKQNTLKAT

SEQ ID NO: 8645 - protein, 12 aa, Artificial Sequence
  Synthetic Peptide
PKVKQNTLKLAT

SEQ ID NO: 8646 - protein, 13 aa, Artificial Sequence
  Synthetic Peptide
PKAVKQNTLKLAT

SEQ ID NO: 8647 - protein, 13 aa, Artificial Sequence
  Synthetic Peptide
PKEVKQNTLKLAT

SEQ ID NO: 8648 - protein, 13 aa, Artificial Sequence
  Synthetic Peptide
PKFQVETTKKLAT

SEQ ID NO: 8649 - protein, 13 aa, Artificial Sequence
  Synthetic Peptide
PKIVKQNTLKLAT

SEQ ID NO: 8650 - protein, 13 aa, Artificial Sequence
  Synthetic Peptide
PKKVKQNTLKLAT

SEQ ID NO: 8651 - protein, 13 aa, Artificial Sequence
  Synthetic Peptide
PKQVKQNTLKLAT

SEQ ID NO: 8652 - protein, 13 aa, Artificial Sequence
  Synthetic Peptide
PKSVKQNTLKLAT

SEQ ID NO: 8653 - protein, 13 aa, Artificial Sequence
  Synthetic Peptide
PKTVKQNTLKLAT

SEQ ID NO: 8654 - protein, 11 aa, Artificial Sequence
  Synthetic Peptide
PKYKQNTLKAT

SEQ ID NO: 8655 - protein, 12 aa, Artificial Sequence
  Synthetic Peptide
PKYKQNTLKLAT

SEQ ID NO: 8656 - protein, 11 aa, Artificial Sequence
  Synthetic Peptide
PKYVQNTLKAT

SEQ ID NO: 8657 - protein, 11 aa, Artificial Sequence
  Synthetic Peptide
PKYVQNTLKAT

SEQ ID NO: 8658 - protein, 12 aa, Artificial Sequence
  Synthetic Peptide
PKYVQNTLKLAT

SEQ ID NO: 8659 - protein, 11 aa, Artificial Sequence
  Synthetic Peptide
PKYVKNTLKAT

SEQ ID NO: 8660 - protein, 11 aa, Artificial Sequence
  Synthetic Peptide
PKYVKNTLKAT

SEQ ID NO: 8661 - protein, 13 aa, Artificial Sequence
  Synthetic Peptide
PKYVKKNTLKLAT

SEQ ID NO: 8662 - protein, 11 aa, Artificial Sequence
  Synthetic Peptide
PKYVKQTLKAT

SEQ ID NO: 8663 - protein, 11 aa, Artificial Sequence
  Synthetic Peptide
PKYVKQTLKAT

SEQ ID NO: 8664 - protein, 12 aa, Artificial Sequence
  Synthetic Peptide
PKYVKQTLKLAT

SEQ ID NO: 8665 - protein, 11 aa, Artificial Sequence
  Synthetic Peptide
PKYVKQNLKAT

SEQ ID NO: 8666 - protein, 11 aa, Artificial Sequence
  Synthetic Peptide
PKYVKQNLKAT

SEQ ID NO: 8667 - protein, 12 aa, Artificial Sequence
  Synthetic Peptide
PKYVKQNLKLAT

SEQ ID NO: 8668 - protein, 12 aa, Artificial Sequence
  Synthetic Peptide
PKYVKQNLKLAT

SEQ ID NO: 8669 - protein, 12 aa, Artificial Sequence
  Synthetic Peptide
PKYVKQNLKLAT

SEQ ID NO: 8670 - protein, 12 aa, Artificial Sequence
  Synthetic Peptide
PKYVKQNLKLAT

SEQ ID NO: 8671 - protein, 12 aa, Artificial Sequence
  Synthetic Peptide
PKYVKQNLKLAT

SEQ ID NO: 8672 - protein, 12 aa, Artificial Sequence
  Synthetic Peptide
PKYVKQNLKLAT

SEQ ID NO: 8673 - protein, 13 aa, Artificial Sequence
  Synthetic Peptide
PKYVKQNELKLAT

SEQ ID NO: 8674 - protein, 13 aa, Artificial Sequence
  Synthetic Peptide
PKYVKQNHLKLAT

SEQ ID NO: 8675 - protein, 13 aa, Artificial Sequence
  Synthetic Peptide
PKYVKQNILKLAT

SEQ ID NO: 8676 - protein, 13 aa, Artificial Sequence
  Synthetic Peptide
PKYVKQNKLKLAT

SEQ ID NO: 8677 - protein, 13 aa, Artificial Sequence
  Synthetic Peptide
PKYVKQNNLKLAT

SEQ ID NO: 8678 - protein, 13 aa, Artificial Sequence
  Synthetic Peptide
PKYVKQNPLKLAT

SEQ ID NO: 8679 - protein, 13 aa, Artificial Sequence
  Synthetic Peptide
PKYVKQNQLKLAT

SEQ ID NO: 8680 - protein, 11 aa, Artificial Sequence
  Synthetic Peptide
PKYVKQNTKAT

SEQ ID NO: 8681 - protein, 11 aa, Artificial Sequence
  Synthetic Peptide
PKYVKQNTKAT

SEQ ID NO: 8682 - protein, 12 aa, Artificial Sequence
  Synthetic Peptide
PKYVKQNTKLAT

SEQ ID NO: 8683 - protein, 13 aa, Artificial Sequence
  Synthetic Peptide
PKYVKQNTKKLAT

SEQ ID NO: 8684 - protein, 11 aa, Artificial Sequence
  Synthetic Peptide
PKYVKQNTLAT

SEQ ID NO: 8685 - protein, 11 aa, Artificial Sequence
  Synthetic Peptide
PKYVKQNTLAT

SEQ ID NO: 8686 - protein, 12 aa, Artificial Sequence
  Synthetic Peptide
PKYVKQNTLLAT

SEQ ID NO: 8687 - protein, 11 aa, Artificial Sequence
  Synthetic Peptide
PKYVKQNTLKT

SEQ ID NO: 8688 - protein, 12 aa, Artificial Sequence
  Synthetic Peptide
PKYVKQNTLKAT

SEQ ID NO: 8689 - protein, 13 aa, Artificial Sequence
  Synthetic Peptide
PKYVKQNTLKEAT

SEQ ID NO: 8690 - protein, 13 aa, Artificial Sequence
  Synthetic Peptide
PKYVKQNTNKLAT

SEQ ID NO: 8691 - protein, 13 aa, Artificial Sequence
  Synthetic Peptide
PKYVKQNYLKLAT

SEQ ID NO: 8692 - protein, 20 aa, Artificial Sequence
  Synthetic Peptide
RTLYQNVGTYVSVGTSTLNK

SEQ ID NO: 8693 - protein, 13 aa, Artificial Sequence
  Synthetic Peptide
VKQNTLKLATGMR

SEQ ID NO: 8694 - protein, 14 aa, Artificial Sequence
  Synthetic Peptide
YPKFQVETTKKLAT

SEQ ID NO: 8695 - protein, 14 aa, Artificial Sequence
  Synthetic Peptide
YPKFVKLNTKKLAT

SEQ ID NO: 8696 - protein, 14 aa, Artificial Sequence
  Synthetic Peptide
YPKFVKQRTLKLAT

SEQ ID NO: 8697 - protein, 14 aa, Artificial Sequence
  Synthetic Peptide
YPKFVKQRTLKLAT

SEQ ID NO: 8698 - protein, 14 aa, Artificial Sequence
  Synthetic Peptide
YPKFVKRNTLKLAT

SEQ ID NO: 8699 - protein, 14 aa, Artificial Sequence
  Synthetic Peptide
YPKYVKQRTLKLAT

SEQ ID NO: 8700 - protein, 14 aa, Artificial Sequence
  Synthetic Peptide
YPKYVKQRTLKLAT

SEQ ID NO: 8701 - protein, 14 aa, Artificial Sequence
  Synthetic Peptide
YPKYVKRNTLKLAT

SEQ ID NO: 8702 - protein, 14 aa, Artificial Sequence
  Synthetic Peptide
YPSFQVQTTLLLAT

SEQ ID NO: 8703 - protein, 15 aa, Artificial Sequence
  Synthetic Peptide
AAPFTQCGYPALMPL

SEQ ID NO: 8704 - protein, 12 aa, Artificial Sequence
  Synthetic Peptide
AILCWGELMTLA

SEQ ID NO: 8705 - protein, 13 aa, Artificial Sequence
  Synthetic Peptide
ALRQAILCWGELM

SEQ ID NO: 8706 - protein, 16 aa, Artificial Sequence
  Synthetic Peptide
ALRQAILCWGELMTLA

SEQ ID NO: 8707 - protein, 20 aa, Artificial Sequence
  Synthetic Peptide
GYRWMCLRRFIIFLFILLLC

SEQ ID NO: 8708 - protein, 19 aa, Artificial Sequence
  Synthetic Peptide
HHTALRQAILCWGELMTLA

SEQ ID NO: 8709 - protein, 18 aa, Artificial Sequence
  Synthetic Peptide
HTALRQAILCWGELMTLA

SEQ ID NO: 8710 - protein, 11 aa, Artificial Sequence
  Synthetic Peptide
ILCWGELMTLA

SEQ ID NO: 8711 - protein, 10 aa, Artificial Sequence
  Synthetic Peptide
LCWGELMTLA

SEQ ID NO: 8712 - protein, 15 aa, Artificial Sequence
  Synthetic Peptide
LPETTVVRCRGRSPR

SEQ ID NO: 8713 - protein, 15 aa, Artificial Sequence
  Synthetic Peptide
LRQAILCWGELMTLA

SEQ ID NO: 8714 - protein, 16 aa, Artificial Sequence
  Synthetic Peptide
LSTLPETTVVRRRGRS

SEQ ID NO: 8715 - protein, 19 aa, Artificial Sequence
  Synthetic Peptide
MDIDPYKEFGASVELLSFL

SEQ ID NO: 8716 - protein, 25 aa, Artificial Sequence
  Synthetic Peptide
MDIDPYKEFGASVELLSFLPSDFFP

SEQ ID NO: 8717 - protein, 19 aa, Artificial Sequence
  Synthetic Peptide
MDIDPYKEFGATVELLSFL

SEQ ID NO: 8718 - protein, 25 aa, Artificial Sequence
  Synthetic Peptide
MDIDPYKEFGATVELLSFLPSDFFP

SEQ ID NO: 8719 - protein, 25 aa, Artificial Sequence
  Synthetic Peptide
MDIDPYKEFGATVELLSFLPSDFFP

SEQ ID NO: 8720 - protein, 25 aa, Artificial Sequence
  Synthetic Peptide
MDIDPYKEFGATVQLLSFLPSDFFP

SEQ ID NO: 8721 - protein, 11 aa, Artificial Sequence
  Synthetic Peptide
MGLKFRQLLWF

SEQ ID NO: 8722 - protein, 18 aa, Artificial Sequence
  Synthetic Peptide
PFLLAQFTSAICSVVRRA

SEQ ID NO: 8723 - protein, 13 aa, Artificial Sequence
  Synthetic Peptide
PHHTALRQAILCW

SEQ ID NO: 8724 - protein, 14 aa, Artificial Sequence
  Synthetic Peptide
PHHTALRQAILCWG

SEQ ID NO: 8725 - protein, 15 aa, Artificial Sequence
  Synthetic Peptide
PHHTALRQAILCWGE

SEQ ID NO: 8726 - protein, 16 aa, Artificial Sequence
  Synthetic Peptide
PHHTALRQAILCWGEL

SEQ ID NO: 8727 - protein, 17 aa, Artificial Sequence
  Synthetic Peptide
PHHTALRQAILCWGELM

SEQ ID NO: 8728 - protein, 18 aa, Artificial Sequence
  Synthetic Peptide
PHHTALRQAILCWGELMT

SEQ ID NO: 8729 - protein, 19 aa, Artificial Sequence
  Synthetic Peptide
PHHTALRQAILCWGELMTL

SEQ ID NO: 8730 - protein, 27 aa, Artificial Sequence
  Synthetic Peptide
PLGFFPDHQLDPAFGANSNNPDWDFNP

SEQ ID NO: 8731 - protein, 13 aa, Artificial Sequence
  Synthetic Peptide
QAILCWGELMTLA

SEQ ID NO: 8732 - protein, 21 aa, Artificial Sequence
  Synthetic Peptide
RDLLDTASALYRREALESPEH

SEQ ID NO: 8733 - protein, 20 aa, Artificial Sequence
  Synthetic Peptide
RDLVVSYVNTNMGLKFRQLL

SEQ ID NO: 8734 - protein, 14 aa, Artificial Sequence
  Synthetic Peptide
RQAILCWGELMTLA

SEQ ID NO: 8735 - protein, 18 aa, Artificial Sequence
  Synthetic Peptide
RVRGLYFPAGGSSSGTVN

SEQ ID NO: 8736 - protein, 20 aa, Artificial Sequence
  Synthetic Peptide
SLDSWWTSLNFLGGTTVCLG

SEQ ID NO: 8737 - protein, 17 aa, Artificial Sequence
  Synthetic Peptide
TALRQAILCWGELMTLA

SEQ ID NO: 8738 - protein, 15 aa, Artificial Sequence
  Synthetic Peptide
TNMGLKFRQLLWFHI

SEQ ID NO: 8739 - protein, 15 aa, Artificial Sequence
  Synthetic Peptide
TNVGLKFRQLLWFHI

SEQ ID NO: 8740 - protein, 14 aa, Artificial Sequence
  Synthetic Peptide
TTVVRRRGRSPRRR

SEQ ID NO: 8741 - protein, 17 aa, Artificial Sequence
  Synthetic Peptide
VGAGAFGLGFTPPHGGL

SEQ ID NO: 8742 - protein, 12 aa, Artificial Sequence
  Synthetic Peptide
VSFGVWIRTPPA

SEQ ID NO: 8743 - protein, 21 aa, Artificial Sequence
  Synthetic Peptide
YPHHTALRQAILCWGELMTLA

SEQ ID NO: 8744 - protein, 20 aa, Artificial Sequence
  Synthetic Peptide
GPGEGAVQWMNRLIAFASRG

SEQ ID NO: 8745 - protein, 20 aa, Artificial Sequence
  Synthetic Peptide
GRHLIFCHSKRKCDELATKL

SEQ ID NO: 8746 - protein, 20 aa, Artificial Sequence
  Synthetic Peptide
LLFNILGGWVAAQLAAPGAA

SEQ ID NO: 8747 - protein, 16 aa, Artificial Sequence
  Synthetic Peptide
PAILSPGALVVGVVCA

SEQ ID NO: 8748 - protein, 10 aa, Artificial Sequence
  Synthetic Peptide
AFVAWRNRCK

SEQ ID NO: 8749 - protein, 10 aa, Artificial Sequence
  Synthetic Peptide
AWAAWRNRCK

SEQ ID NO: 8750 - protein, 10 aa, Artificial Sequence
  Synthetic Peptide
AWEAWRNRCK

SEQ ID NO: 8751 - protein, 10 aa, Artificial Sequence
  Synthetic Peptide
AWLAWRNRCK

SEQ ID NO: 8752 - protein, 10 aa, Artificial Sequence
  Synthetic Peptide
AWVAARNRCK

SEQ ID NO: 8753 - protein, 10 aa, Artificial Sequence
  Synthetic Peptide
AWVAFRNRCK

SEQ ID NO: 8754 - protein, 10 aa, Artificial Sequence
  Synthetic Peptide
AWVAQRNRCK

SEQ ID NO: 8755 - protein, 10 aa, Artificial Sequence
  Synthetic Peptide
AWVAWANRCK

SEQ ID NO: 8756 - protein, 10 aa, Artificial Sequence
  Synthetic Peptide
AWVAWENRCK

SEQ ID NO: 8757 - protein, 10 aa, Artificial Sequence
  Synthetic Peptide
AWVAWKNRCK

SEQ ID NO: 8758 - protein, 10 aa, Artificial Sequence
  Synthetic Peptide
AWVAWRARCK

SEQ ID NO: 8759 - protein, 10 aa, Artificial Sequence
  Synthetic Peptide
AWVAWRNACK

SEQ ID NO: 8760 - protein, 10 aa, Artificial Sequence
  Synthetic Peptide
AWVAWRNECK

SEQ ID NO: 8761 - protein, 10 aa, Artificial Sequence
  Synthetic Peptide
AWVAWRNKCK

SEQ ID NO: 8762 - protein, 10 aa, Artificial Sequence
  Synthetic Peptide
AWVAWRNRCA

SEQ ID NO: 8763 - protein, 10 aa, Artificial Sequence
  Synthetic Peptide
AWVAWRNRCK

SEQ ID NO: 8764 - protein, 10 aa, Artificial Sequence
  Synthetic Peptide
AWVAWRNRCK

SEQ ID NO: 8765 - protein, 10 aa, Artificial Sequence
  Synthetic Peptide
AWVAWRNRCR

SEQ ID NO: 8766 - protein, 10 aa, Artificial Sequence
  Synthetic Peptide
AWVAWRNREK

SEQ ID NO: 8767 - protein, 10 aa, Artificial Sequence
  Synthetic Peptide
AWVAWRNRKK

SEQ ID NO: 8768 - protein, 10 aa, Artificial Sequence
  Synthetic Peptide
AWVAWRNRQK

SEQ ID NO: 8769 - protein, 10 aa, Artificial Sequence
  Synthetic Peptide
AWVAWRNRVK

SEQ ID NO: 8770 - protein, 10 aa, Artificial Sequence
  Synthetic Peptide
AWVAWRQRCK

SEQ ID NO: 8771 - protein, 10 aa, Artificial Sequence
  Synthetic Peptide
AWVAWRVRCK

SEQ ID NO: 8772 - protein, 10 aa, Artificial Sequence
  Synthetic Peptide
AWVEWRNRCK

SEQ ID NO: 8773 - protein, 10 aa, Artificial Sequence
  Synthetic Peptide
AWVSWRNRCK

SEQ ID NO: 8774 - protein, 10 aa, Artificial Sequence
  Synthetic Peptide
AWVVWRNRCK

SEQ ID NO: 8775 - protein, 10 aa, Artificial Sequence
  Synthetic Peptide
EFVAAKAAQK

SEQ ID NO: 8776 - protein, 10 aa, Artificial Sequence
  Synthetic Peptide
EWVAWRNRCK

SEQ ID NO: 8777 - protein, 22 aa, Artificial Sequence
  Synthetic Peptide
LAAAMKRHGLDNYRGYSLGNWV

SEQ ID NO: 8778 - protein, 18 aa, Artificial Sequence
  Synthetic Peptide
RNRCKGTDVQAWIRGCRL

SEQ ID NO: 8779 - protein, 16 aa, Artificial Sequence
  Synthetic Peptide
SVNCAKKIVSDGNGMN

SEQ ID NO: 8780 - protein, 10 aa, Artificial Sequence
  Synthetic Peptide
SWVAWRNRCK

SEQ ID NO: 8781 - protein, 10 aa, Artificial Sequence
  Synthetic Peptide
VWVAWRNRCK

SEQ ID NO: 8782 - protein, 15 aa, Artificial Sequence
  Synthetic Peptide
WRNAKWRNAKWRNAK

SEQ ID NO: 8783 - protein, 22 aa, Artificial Sequence
  Synthetic Peptide
YRGYSLGNWVCAAKFESNFNTQ

SEQ ID NO: 8784 - protein, 15 aa, Artificial Sequence
  Synthetic Peptide
CWMIDSDCRPRFREL

SEQ ID NO: 8785 - protein, 15 aa, Artificial Sequence
  Synthetic Peptide
CYGLGMDHLREVRAV

SEQ ID NO: 8786 - protein, 15 aa, Artificial Sequence
  Synthetic Peptide
FRELVSDFSRMARDP

SEQ ID NO: 8787 - protein, 15 aa, Artificial Sequence
  Synthetic Peptide
IKWMALDSILRRRFT

SEQ ID NO: 8788 - protein, 15 aa, Artificial Sequence
  Synthetic Peptide
LALIHHDTHLCFVHT

SEQ ID NO: 8789 - protein, 15 aa, Artificial Sequence
  Synthetic Peptide
LTYLPTDASLSFLQD

SEQ ID NO: 8790 - protein, 15 aa, Artificial Sequence
  Synthetic Peptide
QMRILKDTELRKVKV

SEQ ID NO: 8791 - protein, 13 aa, Artificial Sequence
  Synthetic Peptide
SPYVSRLLGICLT

SEQ ID NO: 8792 - protein, 16 aa, Artificial Sequence
  Synthetic Peptide
VPIKWMALESILRRRF

SEQ ID NO: 8793 - protein, 15 aa, Artificial Sequence
  Synthetic Peptide
WDQLFRDPHQALLHT

SEQ ID NO: 8794 - protein, 12 aa, Artificial Sequence
  Synthetic Peptide
DRVHPVHAGPIA

SEQ ID NO: 8795 - protein, 14 aa, Artificial Sequence
  Synthetic Peptide
DRVHPVHAGPIAPG

SEQ ID NO: 8796 - protein, 16 aa, Artificial Sequence
  Synthetic Peptide
DRVHPVHAGPIAPGQM

SEQ ID NO: 8797 - protein, 18 aa, Artificial Sequence
  Synthetic Peptide
DRVHPVHAGPIAPGQMRE

SEQ ID NO: 8798 - protein, 20 aa, Artificial Sequence
  Synthetic Peptide
DRVHPVHAGPIAPGQMREPR

SEQ ID NO: 8799 - protein, 20 aa, Artificial Sequence
  Synthetic Peptide
DTEVHNVWATQACVPTDPNP

SEQ ID NO: 8800 - protein, 15 aa, Artificial Sequence
  Synthetic Peptide
EGLIHSQRRQDILDL

SEQ ID NO: 8801 - protein, 20 aa, Artificial Sequence
  Synthetic Peptide
EPFRDYVDRFYKTLRAEQAS

SEQ ID NO: 8802 - protein, 20 aa, Artificial Sequence
  Synthetic Peptide
IYKRWIILGLNKIVRMYSPV

SEQ ID NO: 8803 - protein, 20 aa, Artificial Sequence
  Synthetic Peptide
PKISFEPIPIHYCAPAGFAI

SEQ ID NO: 8804 - protein, 13 aa, Artificial Sequence
  Synthetic Peptide
TAATNAACAWLEA

SEQ ID NO: 8805 - protein, 20 aa, Artificial Sequence
  Synthetic Peptide
TNNPPIPVGEIYKRWIILGL

SEQ ID NO: 8806 - protein, 20 aa, Artificial Sequence
  Synthetic Peptide
VWGIKQLQARVLAVERYLKD

SEQ ID NO: 8807 - protein, 15 aa, Artificial Sequence
  Synthetic Peptide
AVQMAVFIHNFKRKG

SEQ ID NO: 8808 - protein, 15 aa, Artificial Sequence
  Synthetic Peptide
DQQLLGIWGCSGKLI

SEQ ID NO: 8809 - protein, 15 aa, Artificial Sequence
  Synthetic Peptide
DQSLKPCVKLTPLCV

SEQ ID NO: 8810 - protein, 15 aa, Artificial Sequence
  Synthetic Peptide
EDIISLWDQSLKPCV

SEQ ID NO: 8811 - protein, 16 aa, Artificial Sequence
  Synthetic Peptide
ERFAVNPGLLETSEGC

SEQ ID NO: 8812 - protein, 16 aa, Artificial Sequence
  Synthetic Peptide
GARASVLSGGELDKWE

SEQ ID NO: 8813 - protein, 16 aa, Artificial Sequence
  Synthetic Peptide
GGELDKWEKIRLRPGG

SEQ ID NO: 8814 - protein, 5 aa, Artificial Sequence
  Synthetic Peptide
  VARIANT 1, 2, 3, 4, 5: Xaa = Any Amino Acid
XXXXX

SEQ ID NO: 8815 - protein, 15 aa, Artificial Sequence
  Synthetic Peptide
IGGIGGFIKVRQYDQ

SEQ ID NO: 8816 - protein, 16 aa, Artificial Sequence
  Synthetic Peptide
ILKALGPAATLEEMMT

SEQ ID NO: 8817 - protein, 16 aa, Artificial Sequence
  Synthetic Peptide
INEEAAEWERVHPVHA

SEQ ID NO: 8818 - protein, 15 aa, Artificial Sequence
  Synthetic Peptide
IQKLVGKLNWASQIY

SEQ ID NO: 8819 - protein, 15 aa, Artificial Sequence
  Synthetic Peptide
ISLWDQSLKPCVKLT

SEQ ID NO: 8820 - protein, 16 aa, Artificial Sequence
  Synthetic Peptide
IVWASRELERFAVNPG

SEQ ID NO: 8821 - protein, 16 aa, Artificial Sequence
  Synthetic Peptide
IYKRWIILGLNKIVRN

SEQ ID NO: 8822 - protein, 16 aa, Artificial Sequence
  Synthetic Peptide
KQIINMWQEVGKAMYA

SEQ ID NO: 8823 - protein, 16 aa, Artificial Sequence
  Synthetic Peptide
KVVEEKAFSPEVIPMF

SEQ ID NO: 8824 - protein, 16 aa, Artificial Sequence
  Synthetic Peptide
LGKIWPSYKGRPGNFL

SEQ ID NO: 8825 - protein, 16 aa, Artificial Sequence
  Synthetic Peptide
LKQIVKKLREQFGNNK

SEQ ID NO: 8826 - protein, 15 aa, Artificial Sequence
  Synthetic Peptide
LLGIWGCSGKLICTT

SEQ ID NO: 8827 - protein, 15 aa, Artificial Sequence
  Synthetic Peptide
LSIVNRVRQGYSPLS

SEQ ID NO: 8828 - protein, 16 aa, Artificial Sequence
  Synthetic Peptide
PIVQNLQGQMVHQAIS

SEQ ID NO: 8829 - protein, 16 aa, Artificial Sequence
  Synthetic Peptide
PLGVAPTKAKRRVVQR

SEQ ID NO: 8830 - protein, 16 aa, Artificial Sequence
  Synthetic Peptide
PSLQTGSEELRSLYNT

SEQ ID NO: 8831 - protein, 16 aa, Artificial Sequence
  Synthetic Peptide
QARILAVERYLKDQQL

SEQ ID NO: 8832 - protein, 15 aa, Artificial Sequence
  Synthetic Peptide
QGQWTYQIYQEPFKN

SEQ ID NO: 8833 - protein, 16 aa, Artificial Sequence
  Synthetic Peptide
QKQEPIDKELYPLTSL

SEQ ID NO: 8834 - protein, 15 aa, Artificial Sequence
  Synthetic Peptide
QMAVFIHNFKRKGGI

SEQ ID NO: 8835 - protein, 16 aa, Artificial Sequence
  Synthetic Peptide
RIQRGPGRAFVTIGKL

SEQ ID NO: 8836 - protein, 16 aa, Artificial Sequence
  Synthetic Peptide
RQILGQLQPSLQTGSE

SEQ ID NO: 8837 - protein, 16 aa, Artificial Sequence
  Synthetic Peptide
SLKPCVKLTPLCVTLN

SEQ ID NO: 8838 - protein, 16 aa, Artificial Sequence
  Synthetic Peptide
SLWDQSLKPCVKLTPL

SEQ ID NO: 8839 - protein, 15 aa, Artificial Sequence
  Synthetic Peptide
SQIIEQLIKKEKVYL

SEQ ID NO: 8840 - protein, 16 aa, Artificial Sequence
  Synthetic Peptide
SQNQQEKNEQELLELD

SEQ ID NO: 8841 - protein, 16 aa, Artificial Sequence
  Synthetic Peptide
SSGGDPEIVMHSFNCG

SEQ ID NO: 8842 - protein, 15 aa, Artificial Sequence
  Synthetic Peptide
STKWRKLVDFRELNK

SEQ ID NO: 8843 - protein, 17 aa, Artificial Sequence
  Synthetic Peptide
TITLPCRIKQFINMWQE

SEQ ID NO: 8844 - protein, 15 aa, Artificial Sequence
  Synthetic Peptide
TVYYGVPVWKEATTT

SEQ ID NO: 8845 - protein, 16 aa, Artificial Sequence
  Synthetic Peptide
VKIEPLGVAPTKAKRR

SEQ ID NO: 8846 - protein, 15 aa, Artificial Sequence
  Synthetic Peptide
VLSIVNRVRQGYSPL

SEQ ID NO: 8847 - protein, 15 aa, Artificial Sequence
  Synthetic Peptide
VNIVTDSQYALGIIQ

SEQ ID NO: 8848 - protein, 16 aa, Artificial Sequence
  Synthetic Peptide
WDQSLKPCVKLTPLCV

SEQ ID NO: 8849 - protein, 15 aa, Artificial Sequence
  Synthetic Peptide
WRKLVDFRELNKRTQ

SEQ ID NO: 8850 - protein, 6 aa, Artificial Sequence
  Synthetic Peptide
STRKSP

SEQ ID NO: 8851 - protein, 16 aa, Artificial Sequence
  Synthetic Peptide
APYTSTLLPPELSETP

SEQ ID NO: 8852 - protein, 15 aa, Artificial Sequence
  Synthetic Peptide
FRQLVHFVRDFAQLL

SEQ ID NO: 8853 - protein, 16 aa, Artificial Sequence
  Synthetic Peptide
SLKMADPNRFRGKDLP

SEQ ID NO: 8854 - protein, 16 aa, Artificial Sequence
  Synthetic Peptide
ACRVNHVTLSQPKIVK

SEQ ID NO: 8855 - protein, 16 aa, Artificial Sequence
  Synthetic Peptide
GKKIPKVEMSDMSFSK

SEQ ID NO: 8856 - protein, 16 aa, Artificial Sequence
  Synthetic Peptide
HPAENGKSNFLNCYVS

SEQ ID NO: 8857 - protein, 16 aa, Artificial Sequence
  Synthetic Peptide
HPPHIEIQMLKNGKKI

SEQ ID NO: 8858 - protein, 16 aa, Artificial Sequence
  Synthetic Peptide
IQKTPQIQVYSRHPPE

SEQ ID NO: 8859 - protein, 16 aa, Artificial Sequence
  Synthetic Peptide
IQMLKNGKKIPKVEMS

SEQ ID NO: 8860 - protein, 16 aa, Artificial Sequence
  Synthetic Peptide
IQRTPKIQVYSRHPAE

SEQ ID NO: 8861 - protein, 16 aa, Artificial Sequence
  Synthetic Peptide
IQVYSRHPPENGKPNI

SEQ ID NO: 8862 - protein, 16 aa, Artificial Sequence
  Synthetic Peptide
KPNILNCYVTQFHPPH

SEQ ID NO: 8863 - protein, 16 aa, Artificial Sequence
  Synthetic Peptide
SFSKDWSFYILAHTEF

SEQ ID NO: 8864 - protein, 16 aa, Artificial Sequence
  Synthetic Peptide
SFSYDWSFYLLYYTEF

SEQ ID NO: 8865 - protein, 16 aa, Artificial Sequence
  Synthetic Peptide
SFYLLYYTEFTPTEKD

SEQ ID NO: 8866 - protein, 16 aa, Artificial Sequence
  Synthetic Peptide
TETDTYACRVKHDSMA

SEQ ID NO: 8867 - protein, 16 aa, Artificial Sequence
  Synthetic Peptide
VEMSDMSFSKDWSFYI

SEQ ID NO: 8868 - protein, 21 aa, Artificial Sequence
  Synthetic Peptide
YGSDTITLPCRIKQFINMWQE

SEQ ID NO: 8869 - protein, 15 aa, Artificial Sequence
  Synthetic Peptide
PEFLEQRRAAVDTYC

SEQ ID NO: 8870 - protein, 14 aa, Artificial Sequence
  Synthetic Peptide
MRGSHHHHHHGSVD

SEQ ID NO: 8871 - protein, 20 aa, Artificial Sequence
  Synthetic Peptide
FVNQHLSGSHLVEALYLVSG

SEQ ID NO: 8872 - protein, 15 aa, Artificial Sequence
  Synthetic Peptide
DLVLSIALSVGCTGA

SEQ ID NO: 8873 - protein, 15 aa, Artificial Sequence
  Synthetic Peptide
GQRVPVSHSFPHPLY

SEQ ID NO: 8874 - protein, 15 aa, Artificial Sequence
  Synthetic Peptide
HDLMLLRLSEPAKIT

SEQ ID NO: 8875 - protein, 15 aa, Artificial Sequence
  Synthetic Peptide
HPLYNMSLLKHQSLR

SEQ ID NO: 8876 - protein, 15 aa, Artificial Sequence
  Synthetic Peptide
HPQWVLTAAHCLKKN

SEQ ID NO: 8877 - protein, 15 aa, Artificial Sequence
  Synthetic Peptide
KPAVYTKVVHYRKWI

SEQ ID NO: 8878 - protein, 15 aa, Artificial Sequence
  Synthetic Peptide
LHLLSNDMCARAYSE

SEQ ID NO: 8879 - protein, 15 aa, Artificial Sequence
  Synthetic Peptide
MWDLVLSIALSVGCT

SEQ ID NO: 8880 - protein, 15 aa, Artificial Sequence
  Synthetic Peptide
NGVLQGITSWGPEPC

SEQ ID NO: 8881 - protein, 15 aa, Artificial Sequence
  Synthetic Peptide
NMSLLKHQSLRPDED

SEQ ID NO: 8882 - protein, 15 aa, Artificial Sequence
  Synthetic Peptide
PEEFLRPRSLQCVSL

SEQ ID NO: 8883 - protein, 15 aa, Artificial Sequence
  Synthetic Peptide
PHPLYNMSLLKHQSL

SEQ ID NO: 8884 - protein, 15 aa, Artificial Sequence
  Synthetic Peptide
PRSLQCVSLHLLSND

SEQ ID NO: 8885 - protein, 15 aa, Artificial Sequence
  Synthetic Peptide
QWVLTAAHCLKKNSQ

SEQ ID NO: 8886 - protein, 15 aa, Artificial Sequence
  Synthetic Peptide
RVPVSHSFPHPLYNM

SEQ ID NO: 8887 - protein, 15 aa, Artificial Sequence
  Synthetic Peptide
SHDLMLLRLSEPAKI

SEQ ID NO: 8888 - protein, 15 aa, Artificial Sequence
  Synthetic Peptide
ATGFKQSSKALQRPV

SEQ ID NO: 8889 - protein, 25 aa, Artificial Sequence
  Synthetic Peptide
IVHSATGFKQSSKALQRPVASDFEP

SEQ ID NO: 8890 - protein, 15 aa, Artificial Sequence
  Synthetic Peptide
IKYNGEEYLILSARD

SEQ ID NO: 8891 - protein, 15 aa, Artificial Sequence
  Synthetic Peptide
IYSKYGGTEIKYNGE

SEQ ID NO: 8892 - protein, 12 aa, Artificial Sequence
  Synthetic Peptide
LVIPENAKEKPQ

SEQ ID NO: 8893 - protein, 15 aa, Artificial Sequence
  Synthetic Peptide
LVIPENAKEKPQEGT

SEQ ID NO: 8894 - protein, 15 aa, Artificial Sequence
  Synthetic Peptide
LVIPENAKEKPQEGT

SEQ ID NO: 8895 - protein, 15 aa, Artificial Sequence
  Synthetic Peptide
NGEEYLILSARDVLA

SEQ ID NO: 8896 - protein, 15 aa, Artificial Sequence
  Synthetic Peptide
PSGLVIPENAKEKPQ

SEQ ID NO: 8897 - protein, 15 aa, Artificial Sequence
  Synthetic Peptide
RIPVDVSEGDIVIYS

SEQ ID NO: 8898 - protein, 23 aa, Artificial Sequence
  Synthetic Peptide
RKHRIEDAVRNAKAAVEEGIVAG

SEQ ID NO: 8899 - protein, 15 aa, Artificial Sequence
  Synthetic Peptide
SEGDIVIYSKYGGTE

SEQ ID NO: 8900 - protein, 12 aa, Artificial Sequence
  Synthetic Peptide
TLLQAAPALDKY

SEQ ID NO: 8901 - protein, 15 aa, Artificial Sequence
  Synthetic Peptide
VAKVKIKPLEDKILV

SEQ ID NO: 8902 - protein, 15 aa, Artificial Sequence
  Synthetic Peptide
VKIKPLEDKILVQAG

SEQ ID NO: 8903 - protein, 15 aa, Artificial Sequence
  Synthetic Peptide
VVAVGPGRWDEDGAK

SEQ ID NO: 8904 - protein, 21 aa, Artificial Sequence
  Synthetic Peptide
YEKIGAELVKEVAKKTDDVAG

SEQ ID NO: 8905 - protein, 18 aa, Artificial Sequence
  Synthetic Peptide
EKIWEELSVLEVFEGRED

SEQ ID NO: 8906 - protein, 17 aa, Artificial Sequence [sequence omitted]

SEQ ID NO: 8907 - protein, 15 aa, Artificial Sequence
  Synthetic Peptide
EEKIWEDLSMLEVFE

SEQ ID NO: 8908 - protein, 15 aa, Artificial Sequence
  Synthetic Peptide
FPDLESDFQAAISRK

SEQ ID NO: 8909 - protein, 15 aa, Artificial Sequence
  Synthetic Peptide
LESVLRDCQDFFPVI

SEQ ID NO: 8910 - protein, 15 aa, Artificial Sequence
  Synthetic Peptide
MQDLVQDNYLEYRQV

SEQ ID NO: 8911 - protein, 15 aa, Artificial Sequence
  Synthetic Peptide
PRKLLMEDLVQENYL

SEQ ID NO: 8912 - protein, 15 aa, Artificial Sequence
  Synthetic Peptide
QDLVQEDYLEYRQVP

SEQ ID NO: 8913 - protein, 15 aa, Artificial Sequence
  Synthetic Peptide
QLVFGIDVVEVVPIS

SEQ ID NO: 8914 - protein, 15 aa, Artificial Sequence
  Synthetic Peptide
EEKIWEDLSVLEVFE

SEQ ID NO: 8915 - protein, 15 aa, Artificial Sequence
  Synthetic Peptide
LGSVVGDWQYFFPVI

SEQ ID NO: 8916 - protein, 15 aa, Artificial Sequence
  Synthetic Peptide
QHFVQEDYLEYRQVP

SEQ ID NO: 8917 - protein, 15 aa, Artificial Sequence
  Synthetic Peptide
TQHFVQDNYLEYRQV

SEQ ID NO: 8918 - protein, 24 aa, Artificial Sequence
  Synthetic Peptide
LLKYRAREPVTKAEMLGSVVGNWQ

SEQ ID NO: 8919 - protein, 25 aa, Artificial Sequence
  Synthetic Peptide
MVKISGGPRISYPLLHEWALREGEE

SEQ ID NO: 8920 - protein, 24 aa, Artificial Sequence
  Synthetic Peptide
QVPGSDPACYEFLWGPRALIETSY

SEQ ID NO: 8921 - protein, 19 aa, Artificial Sequence
  Synthetic Peptide
VGNWQYFFPVIFSKASDSL

SEQ ID NO: 8922 - protein, 14 aa, Artificial Sequence
  Synthetic Peptide
YKLNFYFDLLRAKL

SEQ ID NO: 8923 - protein, 14 aa, Artificial Sequence
  Synthetic Peptide
YLDNIKDNVGKMED

SEQ ID NO: 8924 - protein, 14 aa, Artificial Sequence
  Synthetic Peptide
AAGIGILTVILGVL

SEQ ID NO: 8925 - protein, 20 aa, Artificial Sequence
  Synthetic Peptide
ASQKRPSQRHGSKYLATAST

SEQ ID NO: 8926 - protein, 20 aa, Artificial Sequence
  Synthetic Peptide
ASQKRPSQRSKYLATASTMD

SEQ ID NO: 8927 - protein, 15 aa, Artificial Sequence
  Synthetic Peptide
ANPVVHFFKNIVTPR

SEQ ID NO: 8928 - protein, 20 aa, Artificial Sequence
  Synthetic Peptide
ASQKRPSQRHGSKYLATAST

SEQ ID NO: 8929 - protein, 20 aa, Artificial Sequence
  Synthetic Peptide
AYDAQGTLSKIFKLGGRDSR

SEQ ID NO: 8930 - protein, 11 aa, Artificial Sequence
  Synthetic Peptide
DENPVVHFFKN

SEQ ID NO: 8931 - protein, 12 aa, Artificial Sequence
  Synthetic Peptide
DENPVVHFFKNI

SEQ ID NO: 8932 - protein, 13 aa, Artificial Sequence
  Synthetic Peptide
DENPVVHFFKNIV

SEQ ID NO: 8933 - protein, 14 aa, Artificial Sequence
  Synthetic Peptide
DENPVVHFFKNIVT

SEQ ID NO: 8934 - protein, 16 aa, Artificial Sequence
  Synthetic Peptide
DENPVVHFFKNIVTPR

SEQ ID NO: 8935 - protein, 17 aa, Artificial Sequence
  Synthetic Peptide
DENPVVHFFKNIVTPRT

SEQ ID NO: 8936 - protein, 19 aa, Artificial Sequence
  Synthetic Peptide
DENPVVHFFKNIVTPRTPP

SEQ ID NO: 8937 - protein, 20 aa, Artificial Sequence
  Synthetic Peptide
DENPVVHFFKNIVTPRTPPY

SEQ ID NO: 8938 - protein, 20 aa, Artificial Sequence
  Synthetic Peptide
DENPVVHFFRNIVTPRTPPY

SEQ ID NO: 8939 - protein, 15 aa, Artificial Sequence
  Synthetic Peptide
EAPVVHFFKNIVTPR

SEQ ID NO: 8940 - protein, 15 aa, Artificial Sequence
  Synthetic Peptide
ENAVVHFFKNIVTPR

SEQ ID NO: 8941 - protein, 15 aa, Artificial Sequence
  Synthetic Peptide
ENPAVHFFKNIVTPR

SEQ ID NO: 8942 - protein, 15 aa, Artificial Sequence
  Synthetic Peptide
ENPKVHFFKNIVTPR

SEQ ID NO: 8943 - protein, 15 aa, Artificial Sequence
  Synthetic Peptide
ENPVAHFFKNIVTPR

SEQ ID NO: 8944 - protein, 15 aa, Artificial Sequence
  Synthetic Peptide
ENPVKHFFKNIVTPR

SEQ ID NO: 8945 - protein, 15 aa, Artificial Sequence
  Synthetic Peptide
ENPVVAFFKNIVTPR

SEQ ID NO: 8946 - protein, 15 aa, Artificial Sequence
  Synthetic Peptide
ENPVVAFFKNIVTPR

SEQ ID NO: 8947 - protein, 15 aa, Artificial Sequence
  Synthetic Peptide
ENPVVDFFKNIVTPR

SEQ ID NO: 8948 - protein, 15 aa, Artificial Sequence
  Synthetic Peptide
ENPVVFFFKNIVTPR

SEQ ID NO: 8949 - protein, 15 aa, Artificial Sequence
  Synthetic Peptide
ENPVVHAFKNIVTPR

SEQ ID NO: 8950 - protein, 15 aa, Artificial Sequence
  Synthetic Peptide
ENPVVHAFKNIVTPR

SEQ ID NO: 8951 - protein, 15 aa, Artificial Sequence
  Synthetic Peptide
ENPVVHAFRNIVTPR

SEQ ID NO: 8952 - protein, 15 aa, Artificial Sequence
  Synthetic Peptide
ENPVVHDFKNIVTPR

SEQ ID NO: 8953 - protein, 15 aa, Artificial Sequence
  Synthetic Peptide
ENPVVHFAKNIVTPR

SEQ ID NO: 8954 - protein, 15 aa, Artificial Sequence
  Synthetic Peptide
ENPVVHFARNIVTPR

SEQ ID NO: 8955 - protein, 15 aa, Artificial Sequence
  Synthetic Peptide
ENPVVHFFANIVTPR

SEQ ID NO: 8956 - protein, 15 aa, Artificial Sequence
  Synthetic Peptide
ENPVVHFFANIVTPR

SEQ ID NO: 8957 - protein, 17 aa, Artificial Sequence
  Synthetic Peptide
ENPVVHFFANIVTPRTP

SEQ ID NO: 8958 - protein, 15 aa, Artificial Sequence
  Synthetic Peptide
ENPVVHFFDNIVTPR

SEQ ID NO: 8959 - protein, 15 aa, Artificial Sequence
  Synthetic Peptide
ENPVVHFFHNIVTPR

SEQ ID NO: 8960 - protein, 15 aa, Artificial Sequence
  Synthetic Peptide
ENPVVHFFKAIVTPR

SEQ ID NO: 8961 - protein, 17 aa, Artificial Sequence
  Synthetic Peptide
ENPVVHFFKAIVTPRTP

SEQ ID NO: 8962 - protein, 15 aa, Artificial Sequence
  Synthetic Peptide
ENPVVHFFKKIVTPR

SEQ ID NO: 8963 - protein, 15 aa, Artificial Sequence
  Synthetic Peptide
ENPVVHFFKNAVTPR

SEQ ID NO: 8964 - protein, 17 aa, Artificial Sequence
  Synthetic Peptide
ENPVVHFFKNAVTPRTP

SEQ ID NO: 8965 - protein, 15 aa, Artificial Sequence
  Synthetic Peptide
ENPVVHFFKNIATPR

SEQ ID NO: 8966 - protein, 15 aa, Artificial Sequence
  Synthetic Peptide
ENPVVHFFKNIVAPR

SEQ ID NO: 8967 - protein, 17 aa, Artificial Sequence
  Synthetic Peptide
ENPVVHFFKNIVAPRTP

SEQ ID NO: 8968 - protein, 15 aa, Artificial Sequence
  Synthetic Peptide
ENPVVHFFKNIVTAR

SEQ ID NO: 8969 - protein, 15 aa, Artificial Sequence
  Synthetic Peptide
ENPVVHFFKNIVTPA

SEQ ID NO: 8970 - protein, 15 aa, Artificial Sequence
  Synthetic Peptide
ENPVVHFFKNIVTPA

SEQ ID NO: 8971 - protein, 15 aa, Artificial Sequence
  Synthetic Peptide
ENPVVHFFKNIVTPR

SEQ ID NO: 8972 - protein, 17 aa, Artificial Sequence
  Synthetic Peptide
ENPVVHFFKNIVTPRTP

SEQ ID NO: 8973 - protein, 19 aa, Artificial Sequence
  Synthetic Peptide
ENPVVHFFKNIVTPRTPPY

SEQ ID NO: 8974 - protein, 15 aa, Artificial Sequence
  Synthetic Peptide
ENPVVHFFKNKVTPR

SEQ ID NO: 8975 - protein, 15 aa, Artificial Sequence
  Synthetic Peptide
ENPVVHFFLNIVTPR

SEQ ID NO: 8976 - protein, 15 aa, Artificial Sequence
  Synthetic Peptide
ENPVVHFFRNIVTPR

SEQ ID NO: 8977 - protein, 15 aa, Artificial Sequence
  Synthetic Peptide
ENPVVHFKKNIVTPR

SEQ ID NO: 8978 - protein, 15 aa, Artificial Sequence
  Synthetic Peptide
ENPVVHHFKNIVTPR

SEQ ID NO: 8979 - protein, 15 aa, Artificial Sequence
  Synthetic Peptide
ENPVVHHFRNIVTPR

SEQ ID NO: 8980 - protein, 15 aa, Artificial Sequence
  Synthetic Peptide
ENPVVHLFKNIVTPR

SEQ ID NO: 8981 - protein, 15 aa, Artificial Sequence
  Synthetic Peptide
ENPVVHLFRNIVTPR

SEQ ID NO: 8982 - protein, 15 aa, Artificial Sequence
  Synthetic Peptide
ENPVVHWFKNIVTPR

SEQ ID NO: 8983 - protein, 15 aa, Artificial Sequence
  Synthetic Peptide
ENPVVHYFANIVTPR

SEQ ID NO: 8984 - protein, 15 aa, Artificial Sequence
  Synthetic Peptide
ENPVVHYFHNIVTPR

SEQ ID NO: 8985 - protein, 15 aa, Artificial Sequence
  Synthetic Peptide
ENPVVHYFKNIVTPR

SEQ ID NO: 8986 - protein, 15 aa, Artificial Sequence
  Synthetic Peptide
ENPVVHYFLNIVTPR

SEQ ID NO: 8987 - protein, 15 aa, Artificial Sequence
  Synthetic Peptide
ENPVVHYFRNIVTPR

SEQ ID NO: 8988 - protein, 15 aa, Artificial Sequence
  Synthetic Peptide
ENPVVKFFKNIVTPR

SEQ ID NO: 8989 - protein, 16 aa, Artificial Sequence
  Synthetic Peptide
FFKNIVTPFFKNIVTP

SEQ ID NO: 8990 - protein, 20 aa, Artificial Sequence
  Synthetic Peptide
FSWGAEGQRPGFGYGGRASD

SEQ ID NO: 8991 - protein, 20 aa, Artificial Sequence
  Synthetic Peptide
GFGYGGRASDYKSAHKGFKG

SEQ ID NO: 8992 - protein, 20 aa, Artificial Sequence
  Synthetic Peptide
GKGRGLSLSRFSWGAEGQRP

SEQ ID NO: 8993 - protein, 20 aa, Artificial Sequence
  Synthetic Peptide
GSGKDSHHPARTAHYGSLPQ

SEQ ID NO: 8994 - protein, 20 aa, Artificial Sequence
  Synthetic Peptide
HARHGFLPRHRDTGILDSIG

SEQ ID NO: 8995 - protein, 14 aa, Artificial Sequence
  Synthetic Peptide
HFFKNIVTPRTPPY

SEQ ID NO: 8996 - protein, 14 aa, Artificial Sequence
  Synthetic Peptide
HFFKNIVTPRTPPY

SEQ ID NO: 8997 - protein, 18 aa, Artificial Sequence
  Synthetic Peptide
IFKLGGRDSRSGSPMARR

SEQ ID NO: 8998 - protein, 20 aa, Artificial Sequence
  Synthetic Peptide
KRGSGKDSHTRTTHYGSLPQ

SEQ ID NO: 8999 - protein, 20 aa, Artificial Sequence
  Synthetic Peptide
KSQHGRTQDENPVVHFFKNI

SEQ ID NO: 9000 - protein, 12 aa, Artificial Sequence
  Synthetic Peptide
NPVVHFFKNIVT

SEQ ID NO: 9001 - protein, 14 aa, Artificial Sequence
  Synthetic Peptide
NPVVHFFKNIVTPA

SEQ ID NO: 9002 - protein, 14 aa, Artificial Sequence
  Synthetic Peptide
NPVVHFFKNIVTPR

SEQ ID NO: 9003 - protein, 18 aa, Artificial Sequence
  Synthetic Peptide
NPVVHFFKNIVTPRTPPY

SEQ ID NO: 9004 - protein, 11 aa, Artificial Sequence
  Synthetic Peptide
PVVHFFKNIVT

SEQ ID NO: 9005 - protein, 13 aa, Artificial Sequence
  Synthetic Peptide
PVVHFFKNIVTPA

SEQ ID NO: 9006 - protein, 13 aa, Artificial Sequence
  Synthetic Peptide
PVVHFFKNIVTPR

SEQ ID NO: 9007 - protein, 17 aa, Artificial Sequence
  Synthetic Peptide
PVVHFFKNIVTPRTPPY

SEQ ID NO: 9008 - protein, 20 aa, Artificial Sequence
  Synthetic Peptide
QKSHGRTQDENPVVHFFKNI

SEQ ID NO: 9009 - protein, 20 aa, Artificial Sequence
  Synthetic Peptide
RASDYKSAHKGFKGVDAQGT

SEQ ID NO: 9010 - protein, 20 aa, Artificial Sequence
  Synthetic Peptide
RASDYKSAHKGLKGHDAQGT

SEQ ID NO: 9011 - protein, 20 aa, Artificial Sequence
  Synthetic Peptide
RDTGILDSIGRFFGGDRGAP

SEQ ID NO: 9012 - protein, 20 aa, Artificial Sequence
  Synthetic Peptide
RDTGILDSIGRFFSGDRGAP

SEQ ID NO: 9013 - protein, 20 aa, Artificial Sequence
  Synthetic Peptide
RFFGGDRGAPKRGSGKDSHH

SEQ ID NO: 9014 - protein, 20 aa, Artificial Sequence
  Synthetic Peptide
RFFSGDRGAPKRGSGKDSHT

SEQ ID NO: 9015 - protein, 20 aa, Artificial Sequence
  Synthetic Peptide
RTAHYGSLPQKSHGRTQDEN

SEQ ID NO: 9016 - protein, 20 aa, Artificial Sequence
  Synthetic Peptide
VDAQGTLSKIFKLGGRDSRS

SEQ ID NO: 9017 - protein, 20 aa, Artificial Sequence
  Synthetic Peptide
VDAQGTLSKIFKLGGRDSRS

SEQ ID NO: 9018 - protein, 20 aa, Artificial Sequence
  Synthetic Peptide
VDAQGTLSKLFKLGGRDSRS

SEQ ID NO: 9019 - protein, 20 aa, Artificial Sequence
  Synthetic Peptide
VDAQGTLSRIFKLGGRDSRS

SEQ ID NO: 9020 - protein, 15 aa, Artificial Sequence
  Synthetic Peptide
VHFFKNIVTPRTPPY

SEQ ID NO: 9021 - protein, 20 aa, Artificial Sequence
  Synthetic Peptide
VTPRTPPPSQGKGRGLSLSR

SEQ ID NO: 9022 - protein, 16 aa, Artificial Sequence
  Synthetic Peptide
VVHFFKNIVTPRTPPY

SEQ ID NO: 9023 - protein, 20 aa, Artificial Sequence
  Synthetic Peptide
YKSAHKGFKGAYDAQGTLSK

SEQ ID NO: 9024 - protein, 20 aa, Artificial Sequence
  Synthetic Peptide
YKSAHKGFKGVDAQGTLSKI

SEQ ID NO: 9025 - protein, 16 aa, Artificial Sequence
  Synthetic Peptide
ANERADLIAYLKQATK

SEQ ID NO: 9026 - protein, 13 aa, Artificial Sequence
  Synthetic Peptide
EFVVEFDLPGIKA

SEQ ID NO: 9027 - protein, 10 aa, Artificial Sequence
  Synthetic Peptide
VITAFNEGLK

SEQ ID NO: 9028 - protein, 14 aa, Artificial Sequence
  Synthetic Peptide
YEFVVEFDLPGIKA

SEQ ID NO: 9029 - protein, 15 aa, Artificial Sequence
  Synthetic Peptide
IAFNSGLEPGVVAEK

SEQ ID NO: 9030 - protein, 15 aa, Artificial Sequence
  Synthetic Peptide
LLPLLEKVIGAGKPL

SEQ ID NO: 9031 - protein, 12 aa, Artificial Sequence
  Synthetic Peptide
YKTIAYDEEARR

SEQ ID NO: 9032 - protein, 22 aa, Artificial Sequence
  Synthetic Peptide
TWQRDGEDQTQDTELVETRPAG

SEQ ID NO: 9033 - protein, 21 aa, Artificial Sequence
  Synthetic Peptide
VDDTLFVRFDSDAASPREEPR

SEQ ID NO: 9034 - protein, 21 aa, Artificial Sequence
  Synthetic Peptide
VDDTLFVRFDSDATSPRKEPR

SEQ ID NO: 9035 - protein, 21 aa, Artificial Sequence
  Synthetic Peptide
VDDTQFVRFDSDAASPREEPR

SEQ ID NO: 9036 - protein, 21 aa, Artificial Sequence
  Synthetic Peptide
VDDTQFVRFDSDAASPRMAPR

SEQ ID NO: 9037 - protein, 21 aa, Artificial Sequence
  Synthetic Peptide
VDDTQFVRFDSDAASPRTEPR

SEQ ID NO: 9038 - protein, 16 aa, Artificial Sequence
  Synthetic Peptide
AHAAHAAHAAHAAHAA

SEQ ID NO: 9039 - protein, 14 aa, Artificial Sequence
  Synthetic Peptide
AVHAAHAEINEAGR

SEQ ID NO: 9040 - protein, 12 aa, Artificial Sequence
  Synthetic Peptide
HIATNAVLFFGR

SEQ ID NO: 9041 - protein, 14 aa, Artificial Sequence
  Synthetic Peptide
ISQAAHAAHAEINE

SEQ ID NO: 9042 - protein, 14 aa, Artificial Sequence
  Synthetic Peptide
ISQADHAAHAEINE

SEQ ID NO: 9043 - protein, 14 aa, Artificial Sequence
  Synthetic Peptide
ISQAVEAAHAEINE

SEQ ID NO: 9044 - protein, 14 aa, Artificial Sequence
  Synthetic Peptide
ISQAVHAAHAEDNE

SEQ ID NO: 9045 - protein, 14 aa, Artificial Sequence
  Synthetic Peptide
ISQAVHAAHAEIIE

SEQ ID NO: 9046 - protein, 14 aa, Artificial Sequence
  Synthetic Peptide
ISQAVHAAHAQINE

SEQ ID NO: 9047 - protein, 14 aa, Artificial Sequence
  Synthetic Peptide
ISQAVHAALAEINE

SEQ ID NO: 9048 - protein, 14 aa, Artificial Sequence
  Synthetic Peptide
ISQAVHAANAEINE

SEQ ID NO: 9049 - protein, 14 aa, Artificial Sequence
  Synthetic Peptide
ISQAVHAARAEINE

SEQ ID NO: 9050 - protein, 15 aa, Artificial Sequence
  Synthetic Peptide
LKISQAVHAAHAEIN

SEQ ID NO: 9051 - protein, 20 aa, Artificial Sequence
  Synthetic Peptide
MVYLGAKDSTRTQINKVVRF

SEQ ID NO: 9052 - protein, 15 aa, Artificial Sequence
  Synthetic Peptide
NVMEERKIKVYLPRM

SEQ ID NO: 9053 - protein, 15 aa, Artificial Sequence
  Synthetic Peptide
VHAAHAEINVHAAHA

SEQ ID NO: 9054 - protein, 15 aa, Artificial Sequence
  Synthetic Peptide
VHAAHAVHAAHAEIN

SEQ ID NO: 9055 - protein, 15 aa, Artificial Sequence
  Synthetic Peptide
VHAAHAVHAAHAVHA

SEQ ID NO: 9056 - protein, 14 aa, Artificial Sequence
  Synthetic Peptide
YTYTVHAAHAYTYT

SEQ ID NO: 9057 - protein, 14 aa, Artificial Sequence
  Synthetic Peptide
YTYTVHAAHAYTYT

SEQ ID NO: 9058 - protein, 15 aa, Artificial Sequence
  Synthetic Peptide
LIRVEGDLRVEYLDD

SEQ ID NO: 9059 - protein, 15 aa, Artificial Sequence
  Synthetic Peptide
QHLIRVDGNLRVEYL

SEQ ID NO: 9060 - protein, 15 aa, Artificial Sequence
  Synthetic Peptide
RFEMFRDLNEALELK

SEQ ID NO: 9061 - protein, 15 aa, Artificial Sequence
  Synthetic Peptide
AAPLLLARAASLSLG

SEQ ID NO: 9062 - protein, 15 aa, Artificial Sequence
  Synthetic Peptide
AKELKFVTLVFRHGD

SEQ ID NO: 9063 - protein, 15 aa, Artificial Sequence
  Synthetic Peptide
ALDVYNGLLPPYASC

SEQ ID NO: 9064 - protein, 15 aa, Artificial Sequence
  Synthetic Peptide
APLLLARAASLSLGF

SEQ ID NO: 9065 - protein, 15 aa, Artificial Sequence
  Synthetic Peptide
DRSVLAKELKFVTLV

SEQ ID NO: 9066 - protein, 15 aa, Artificial Sequence
  Synthetic Peptide
DRTLMSAMTNLAALF

SEQ ID NO: 9067 - protein, 15 aa, Artificial Sequence
  Synthetic Peptide
DTTVSGLQMALDVYN

SEQ ID NO: 9068 - protein, 15 aa, Artificial Sequence
  Synthetic Peptide
FAELVGPVIPQDWST

SEQ ID NO: 9069 - protein, 15 aa, Artificial Sequence
  Synthetic Peptide
FGQLTQLGMEQHYEL

SEQ ID NO: 9070 - protein, 15 aa, Artificial Sequence
  Synthetic Peptide
GGVLVNEILNHMKRA

SEQ ID NO: 9071 - protein, 15 aa, Artificial Sequence
  Synthetic Peptide
GPVIPQDWSTECMTT

SEQ ID NO: 9072 - protein, 15 aa, Artificial Sequence
  Synthetic Peptide
GVSIWNPILLWQPIP

SEQ ID NO: 9073 - protein, 15 aa, Artificial Sequence
  Synthetic Peptide
ILLWQPIPVHTVPLS

SEQ ID NO: 9074 - protein, 15 aa, Artificial Sequence
  Synthetic Peptide
IPSYKKLIMYSAHDT

SEQ ID NO: 9075 - protein, 15 aa, Artificial Sequence
  Synthetic Peptide
KSRLQGGVLVNEILN

SEQ ID NO: 9076 - protein, 15 aa, Artificial Sequence
  Synthetic Peptide
LDVYNGLLPPYASCH

SEQ ID NO: 9077 - protein, 15 aa, Artificial Sequence
  Synthetic Peptide
LIMYSAHDTTVSGLQ

SEQ ID NO: 9078 - protein, 15 aa, Artificial Sequence
  Synthetic Peptide
LLFFWLDRSVLAKEL

SEQ ID NO: 9079 - protein, 15 aa, Artificial Sequence
  Synthetic Peptide
LPSWATEDTMTKLRE

SEQ ID NO: 9080 - protein, 15 aa, Artificial Sequence
  Synthetic Peptide
LRELSELSLLSLYGI

SEQ ID NO: 9081 - protein, 15 aa, Artificial Sequence
  Synthetic Peptide
LSELSLLSLYGIHKQ

SEQ ID NO: 9082 - protein, 15 aa, Artificial Sequence
  Synthetic Peptide
LSGLHGQDLFGIWSK

SEQ ID NO: 9083 - protein, 15 aa, Artificial Sequence
  Synthetic Peptide
LSLLSLYGIHKQKEK

SEQ ID NO: 9084 - protein, 15 aa, Artificial Sequence
  Synthetic Peptide
LTELYFEKGEYFVEM

SEQ ID NO: 9085 - protein, 15 aa, Artificial Sequence
  Synthetic Peptide
MSAMTNLAALFPPEG

SEQ ID NO: 9086 - protein, 15 aa, Artificial Sequence
  Synthetic Peptide
MTNLAALFPPEGVSI

SEQ ID NO: 9087 - protein, 15 aa, Artificial Sequence
  Synthetic Peptide
NPILLWQPIPVHTVP

SEQ ID NO: 9088 - protein, 15 aa, Artificial Sequence
  Synthetic Peptide
PEGVSIWNPILLWQP

SEQ ID NO: 9089 - protein, 15 aa, Artificial Sequence
  Synthetic Peptide
PILLWQPIPVHTVPL

SEQ ID NO: 9090 - protein, 15 aa, Artificial Sequence
  Synthetic Peptide
PLLLARAASLSLGFL

SEQ ID NO: 9091 - protein, 15 aa, Artificial Sequence
  Synthetic Peptide
RSPIDTFPTDPIKES

SEQ ID NO: 9092 - protein, 15 aa, Artificial Sequence
  Synthetic Peptide
SLSLGFLFLLFFWLD

SEQ ID NO: 9093 - protein, 15 aa, Artificial Sequence
  Synthetic Peptide
TVPLSEDQLLYLPFR

SEQ ID NO: 9094 - protein, 15 aa, Artificial Sequence
  Synthetic Peptide
WNPILLWQPIPVHTV

SEQ ID NO: 9095 - protein, 15 aa, Artificial Sequence
  Synthetic Peptide
WQPIPVHTVPLSEDQ

SEQ ID NO: 9096 - protein, 15 aa, Artificial Sequence
  Synthetic Peptide
YDPLYCESVHNFTLP

SEQ ID NO: 9097 - protein, 15 aa, Artificial Sequence
  Synthetic Peptide
YKKLIMYSAHDTTVS

SEQ ID NO: 9098 - protein, 15 aa, Artificial Sequence
  Synthetic Peptide
YNGLLPPYASCHLTE

SEQ ID NO: 9099 - protein, 15 aa, Artificial Sequence
  Synthetic Peptide
AGGIAGGLALLACAG

SEQ ID NO: 9100 - protein, 15 aa, Artificial Sequence
  Synthetic Peptide
ATSVLAGLLGNVSTV

SEQ ID NO: 9101 - protein, 15 aa, Artificial Sequence
  Synthetic Peptide
AVPLAMKLIQQLNLN

SEQ ID NO: 9102 - protein, 18 aa, Artificial Sequence
  Synthetic Peptide
EWSPCSVTCGNGIQVRIK

SEQ ID NO: 9103 - protein, 15 aa, Artificial Sequence
  Synthetic Peptide
FLALFFIIFNKESLA

SEQ ID NO: 9104 - protein, 20 aa, Artificial Sequence
  Synthetic Peptide
IEQYLKKIKNSISTEWSPCS

SEQ ID NO: 9105 - protein, 15 aa, Artificial Sequence
  Synthetic Peptide
IFHINGKIIKNSEKD

SEQ ID NO: 9106 - protein, 15 aa, Artificial Sequence
  Synthetic Peptide
KHILYISFYFILVNL

SEQ ID NO: 9107 - protein, 15 aa, Artificial Sequence
  Synthetic Peptide
LIDVHDLISDMIKKE

SEQ ID NO: 9108 - protein, 20 aa, Artificial Sequence
  Synthetic Peptide
NAREIIRLHSDASKNKEKAL

SEQ ID NO: 9109 - protein, 15 aa, Artificial Sequence
  Synthetic Peptide
NHAVPLAMKLIQQLN

SEQ ID NO: 9110 - protein, 15 aa, Artificial Sequence
  Synthetic Peptide
TVLLGGVGLVLYNTE

SEQ ID NO: 9111 - protein, 15 aa, Artificial Sequence
  Synthetic Peptide
VDLYLLMDCSGSIRR

SEQ ID NO: 9112 - protein, 15 aa, Artificial Sequence
  Synthetic Peptide
VKNVSQTNFKSLLRN

SEQ ID NO: 9113 - protein, 15 aa, Artificial Sequence
  Synthetic Peptide
VVILTDGIPDSIQDS

SEQ ID NO: 9114 - protein, 20 aa, Artificial Sequence
  Synthetic Peptide
YADSAWENVKNVIGPFMKAV

SEQ ID NO: 9115 - protein, 13 aa, Artificial Sequence
  Synthetic Peptide
ADLIAYLKQATAK

SEQ ID NO: 9116 - protein, 12 aa, Artificial Sequence
  Synthetic Peptide
DLIAYLKQATAK

SEQ ID NO: 9117 - protein, 15 aa, Artificial Sequence
  Synthetic Peptide
ERADLIAYLKQATAK

SEQ ID NO: 9118 - protein, 10 aa, Artificial Sequence
  Synthetic Peptide
IAYLKQATAK

SEQ ID NO: 9119 - protein, 16 aa, Artificial Sequence
  Synthetic Peptide
KAERADLIAYLKQATA

SEQ ID NO: 9120 - protein, 11 aa, Artificial Sequence
  Synthetic Peptide
LIAYLKQATAK

SEQ ID NO: 9121 - protein, 18 aa, Artificial Sequence
  Synthetic Peptide
AATYNFAVLKLMGRGTKF

SEQ ID NO: 9122 - protein, 20 aa, Artificial Sequence
  Synthetic Peptide
FLYGALLLAEGFYTTGAVRQ

SEQ ID NO: 9123 - protein, 20 aa, Artificial Sequence
  Synthetic Peptide
FLYGALLLAEGFYTTGAVRQ

SEQ ID NO: 9124 - protein, 14 aa, Artificial Sequence
  Synthetic Peptide
FNTWTTCQSIAFPS

SEQ ID NO: 9125 - protein, 20 aa, Artificial Sequence
  Synthetic Peptide
LCADARMYGVLPWNAFPGKV

SEQ ID NO: 9126 - protein, 20 aa, Artificial Sequence
  Synthetic Peptide
LTGTEKLIETYFSKNYQDYE

SEQ ID NO: 9127 - protein, 20 aa, Artificial Sequence
  Synthetic Peptide
QKGRGYRGQHQAHSLERVCH

SEQ ID NO: 9128 - protein, 20 aa, Artificial Sequence
  Synthetic Peptide
SAVPVYIYFNTWTTCQSIAF

SEQ ID NO: 9129 - protein, 20 aa, Artificial Sequence
  Synthetic Peptide
SAVPVYIYFNTWTTCQSIAF

SEQ ID NO: 9130 - protein, 20 aa, Artificial Sequence
  Synthetic Peptide
TAEFQMTFHLFIAAFVGAAA

SEQ ID NO: 9131 - protein, 20 aa, Artificial Sequence
  Synthetic Peptide
WTTCQSIAFPSKTSASIGSL

SEQ ID NO: 9132 - protein, 15 aa, Artificial Sequence
  Synthetic Peptide
AHCIRNKSVILLGRH

SEQ ID NO: 9133 - protein, 15 aa, Artificial Sequence
  Synthetic Peptide
CAQVHPQKVTKFMLC

SEQ ID NO: 9134 - protein, 15 aa, Artificial Sequence
  Synthetic Peptide
GGPLVCNGVLQGITS

SEQ ID NO: 9135 - protein, 15 aa, Artificial Sequence
  Synthetic Peptide
GPLVCNGVLQGITSW

SEQ ID NO: 9136 - protein, 15 aa, Artificial Sequence
  Synthetic Peptide
GQVFQVSHSFPHPLY

SEQ ID NO: 9137 - protein, 15 aa, Artificial Sequence
  Synthetic Peptide
GRAVCGGVLVHPQWV

SEQ ID NO: 9138 - protein, 15 aa, Artificial Sequence
  Synthetic Peptide
GVLVHPQWVLTAAHC

SEQ ID NO: 9139 - protein, 15 aa, Artificial Sequence
  Synthetic Peptide
HDLMLLRLSEPAELT

SEQ ID NO: 9140 - protein, 15 aa, Artificial Sequence
  Synthetic Peptide
HPQWVLTAAHCIRNK

SEQ ID NO: 9141 - protein, 15 aa, Artificial Sequence
  Synthetic Peptide
HSLFHPEDTGQVFQV

SEQ ID NO: 9142 - protein, 15 aa, Artificial Sequence
  Synthetic Peptide
LHVISNDVCAQVHPQ

SEQ ID NO: 9143 - protein, 15 aa, Artificial Sequence
  Synthetic Peptide
NGVLQGITSWGSEPC

SEQ ID NO: 9144 - protein, 15 aa, Artificial Sequence
  Synthetic Peptide
PHPLYDMSLLKNRFL

SEQ ID NO: 9145 - protein, 15 aa, Artificial Sequence
  Synthetic Peptide
QWVLTAAHCIRNKSV

SEQ ID NO: 9146 - protein, 15 aa, Artificial Sequence
  Synthetic Peptide
RPSLYTKVVHYRKWI

SEQ ID NO: 9147 - protein, 15 aa, Artificial Sequence
  Synthetic Peptide
SHDLMLLRLSEPAEL

SEQ ID NO: 9148 - protein, 15 aa, Artificial Sequence
  Synthetic Peptide
SQPWQVLVASRGRAV

SEQ ID NO: 9149 - protein, 15 aa, Artificial Sequence
  Synthetic Peptide
SVILLGRHSLFHPED

SEQ ID NO: 9150 - protein, 15 aa, Artificial Sequence
  Synthetic Peptide
SVTWIGAAPLILSRI

SEQ ID NO: 9151 - protein, 15 aa, Artificial Sequence
  Synthetic Peptide
TDAVKVMDLPTQEPA

SEQ ID NO: 9152 - protein, 15 aa, Artificial Sequence
  Synthetic Peptide
TLSVTWIGAAPLILS

SEQ ID NO: 9153 - protein, 15 aa, Artificial Sequence
  Synthetic Peptide
VFQVSHSFPHPLYDM

SEQ ID NO: 9154 - protein, 15 aa, Artificial Sequence
  Synthetic Peptide
VILLGRHSLFHPEDT

SEQ ID NO: 9155 - protein, 15 aa, Artificial Sequence
  Synthetic Peptide
VTWIGAAPLILSRIV

SEQ ID NO: 9156 - protein, 15 aa, Artificial Sequence
  Synthetic Peptide
ADKIYSISMKHPQEM

SEQ ID NO: 9157 - protein, 15 aa, Artificial Sequence
  Synthetic Peptide
AEAVGLPSIPVHPIG

SEQ ID NO: 9158 - protein, 15 aa, Artificial Sequence
  Synthetic Peptide
AVGLPSIPVHPIGYY

SEQ ID NO: 9159 - protein, 15 aa, Artificial Sequence
  Synthetic Peptide
CTPLMYSLVHNLTKE

SEQ ID NO: 9160 - protein, 15 aa, Artificial Sequence
  Synthetic Peptide
DFEVFFQRLGIASGR

SEQ ID NO: 9161 - protein, 15 aa, Artificial Sequence
  Synthetic Peptide
DPMFKYHLTVAQVRG

SEQ ID NO: 9162 - protein, 15 aa, Artificial Sequence
  Synthetic Peptide
DQLMFLERAFIDPLG

SEQ ID NO: 9163 - protein, 15 aa, Artificial Sequence
  Synthetic Peptide
DSSIEGNYTLRVDCT

SEQ ID NO: 9164 - protein, 15 aa, Artificial Sequence
  Synthetic Peptide
EDFFKLERDMKINCS

SEQ ID NO: 9165 - protein, 15 aa, Artificial Sequence
  Synthetic Peptide
ERGVAYINADSSIEG

SEQ ID NO: 9166 - protein, 15 aa, Artificial Sequence
  Synthetic Peptide
EVFFQRLGIASGRAR

SEQ ID NO: 9167 - protein, 15 aa, Artificial Sequence
  Synthetic Peptide
EYAYRRGIAEAVGLP

SEQ ID NO: 9168 - protein, 15 aa, Artificial Sequence
  Synthetic Peptide
FFKLERDMKINCSGK

SEQ ID NO: 9169 - protein, 15 aa, Artificial Sequence
  Synthetic Peptide
GAAVVHEIVRSFGTL

SEQ ID NO: 9170 - protein, 15 aa, Artificial Sequence
  Synthetic Peptide
GKVFRGNKVKNAQLA

SEQ ID NO: 9171 - protein, 15 aa, Artificial Sequence
  Synthetic Peptide
GMVFELANSIVLPFD

SEQ ID NO: 9172 - protein, 15 aa, Artificial Sequence
  Synthetic Peptide
GNEIFNTSLFEPPPP

SEQ ID NO: 9173 - protein, 15 aa, Artificial Sequence
  Synthetic Peptide
GNKVKNAQLAGAKGV

SEQ ID NO: 9174 - protein, 15 aa, Artificial Sequence
  Synthetic Peptide
GVAYINADSSIEGNY

SEQ ID NO: 9175 - protein, 15 aa, Artificial Sequence
  Synthetic Peptide
GVILYSDPADYFAPG

SEQ ID NO: 9176 - protein, 15 aa, Artificial Sequence
  Synthetic Peptide
IGYYDAQKLLEKMGG

SEQ ID NO: 9177 - protein, 15 aa, Artificial Sequence
  Synthetic Peptide
IKKFLYNFTQIPHLA

SEQ ID NO: 9178 - protein, 15 aa, Artificial Sequence
  Synthetic Peptide
ISIINEDGNEIFNTS

SEQ ID NO: 9179 - protein, 15 aa, Artificial Sequence
  Synthetic Peptide
IYSISMKHPQEMKTY

SEQ ID NO: 9180 - protein, 15 aa, Artificial Sequence
  Synthetic Peptide
KFLYNFTQIPHLAGT

SEQ ID NO: 9181 - protein, 15 aa, Artificial Sequence
  Synthetic Peptide
KYHLTVAQVRGGMVF

SEQ ID NO: 9182 - protein, 15 aa, Artificial Sequence
  Synthetic Peptide
LAHYDVLLSYPNKTH

SEQ ID NO: 9183 - protein, 15 aa, Artificial Sequence
  Synthetic Peptide
LDELKAENIKKFLYN

SEQ ID NO: 9184 - protein, 15 aa, Artificial Sequence
  Synthetic Peptide
LGFLFGWFIKSSNEA

SEQ ID NO: 9185 - protein, 15 aa, Artificial Sequence
  Synthetic Peptide
LRMMNDQLMFLERAF

SEQ ID NO: 9186 - protein, 15 aa, Artificial Sequence
  Synthetic Peptide
MFKYHLTVAQVRGGM

SEQ ID NO: 9187 - protein, 15 aa, Artificial Sequence
  Synthetic Peptide
NSRLLQERGVAYINA

SEQ ID NO: 9188 - protein, 15 aa, Artificial Sequence
  Synthetic Peptide
NYTLRVDCTPLMYSL

SEQ ID NO: 9189 - protein, 15 aa, Artificial Sequence
  Synthetic Peptide
PQEMKTYSVSFDSLF

SEQ ID NO: 9190 - protein, 15 aa, Artificial Sequence
  Synthetic Peptide
PRWLCAGALVLAGGF

SEQ ID NO: 9191 - protein, 15 aa, Artificial Sequence
  Synthetic Peptide
QIYVAAFTVQAAAET

SEQ ID NO: 9192 - protein, 15 aa, Artificial Sequence
  Synthetic Peptide
RGGMVFELANSIVLP

SEQ ID NO: 9193 - protein, 15 aa, Artificial Sequence
  Synthetic Peptide
RHVIYAPSSHNKYAG

SEQ ID NO: 9194 - protein, 15 aa, Artificial Sequence
  Synthetic Peptide
RQIYVAAFTVQAAAE

SEQ ID NO: 9195 - protein, 15 aa, Artificial Sequence
  Synthetic Peptide
TGNFSTQKVKMHIHS

SEQ ID NO: 9196 - protein, 15 aa, Artificial Sequence
  Synthetic Peptide
TNKFSGYPLYHSVYE

SEQ ID NO: 9197 - protein, 15 aa, Artificial Sequence
  Synthetic Peptide
TRIYNVIGTLRGAVE

SEQ ID NO: 9198 - protein, 15 aa, Artificial Sequence
  Synthetic Peptide
TYSVSFDSLFSAVKN

SEQ ID NO: 9199 - protein, 15 aa, Artificial Sequence
  Synthetic Peptide
VAAFTVQAAAETLSE

SEQ ID NO: 9200 - protein, 15 aa, Artificial Sequence
  Synthetic Peptide
VAQVRGGMVFELANS

SEQ ID NO: 9201 - protein, 15 aa, Artificial Sequence
  Synthetic Peptide
VAYINADSSIEGNYT

SEQ ID NO: 9202 - protein, 15 aa, Artificial Sequence
  Synthetic Peptide
VFELANSIVLPFDCR

SEQ ID NO: 9203 - protein, 15 aa, Artificial Sequence
  Synthetic Peptide
VLRMMNDQLMFLERA

SEQ ID NO: 9204 - protein, 15 aa, Artificial Sequence
  Synthetic Peptide
WKEFGLDSVELAHYD

SEQ ID NO: 9205 - protein, 15 aa, Artificial Sequence
  Synthetic Peptide
YDPMFKYHLTVAQVR

SEQ ID NO: 9206 - protein, 15 aa, Artificial Sequence
  Synthetic Peptide
YISIINEDGNEIFNT

SEQ ID NO: 9207 - protein, 15 aa, Artificial Sequence
  Synthetic Peptide
YRHVIYAPSSHNKYA

SEQ ID NO: 9208 - protein, 20 aa, Artificial Sequence
  Synthetic Peptide
VDAQGTLSRLFKLGGRDSRS

SEQ ID NO: 9209 - protein, 19 aa, Artificial Sequence
  Synthetic Peptide
KVNNQVVSLKPEIIVDQEY

SEQ ID NO: 9210 - protein, 6 aa, Artificial Sequence
  Synthetic Peptide
STRKSP

SEQ ID NO: 9211 - protein, 6 aa, Artificial Sequence
  Synthetic Peptide
STRKSP

SEQ ID NO: 9212 - protein, 6 aa, Artificial Sequence
  Synthetic Peptide
STRKSP

SEQ ID NO: 9213 - protein, 6 aa, Artificial Sequence
  Synthetic Peptide
STRKSP

SEQ ID NO: 9214 - protein, 6 aa, Artificial Sequence
  Synthetic Peptide
STRKSP

SEQ ID NO: 9215 - protein, 16 aa, Artificial Sequence
  Synthetic Peptide
DKLKQQRDTLSTQKET

SEQ ID NO: 9216 - protein, 15 aa, Artificial Sequence
  Synthetic Peptide
EQKSKQNIGALKQEL

SEQ ID NO: 9217 - protein, 20 aa, Artificial Sequence
  Synthetic Peptide
SGGTNYAQKFQGRVTMTRDT

SEQ ID NO: 9218 - protein, 19 aa, Artificial Sequence
  Synthetic Peptide
ELSRLSDDTAVYYCARAPG

SEQ ID NO: 9219 - protein, 20 aa, Artificial Sequence
  Synthetic Peptide
ELSRLTSDDTAVYYCAIAPG

SEQ ID NO: 9220 - protein, 17 aa, Artificial Sequence
  Synthetic Peptide
TISCSGSSSNIGSNTVN

SEQ ID NO: 9221 - protein, 11 aa, Artificial Sequence
  Synthetic Peptide
APYHFDLSGHA

SEQ ID NO: 9222 - protein, 12 aa, Artificial Sequence
  Synthetic Peptide
APYHFDLSGHAF

SEQ ID NO: 9223 - protein, 14 aa, Artificial Sequence
  Synthetic Peptide
APYHFDLSGHAFGS

SEQ ID NO: 9224 - protein, 16 aa, Artificial Sequence
  Synthetic Peptide
APYHFDLSGHAFGSMA

SEQ ID NO: 9225 - protein, 18 aa, Artificial Sequence
  Synthetic Peptide
APYHFDLSGHAFGSMAKK

SEQ ID NO: 9226 - protein, 20 aa, Artificial Sequence
  Synthetic Peptide
APYHFDLSGHAFGSMAKKGE

SEQ ID NO: 9227 - protein, 20 aa, Artificial Sequence
  Synthetic Peptide
CGYKDVDKAPFNGMTGCGNT

SEQ ID NO: 9228 - protein, 9 aa, Artificial Sequence
  Synthetic Peptide
DLSGHAFGS

SEQ ID NO: 9229 - protein, 17 aa, Artificial Sequence
  Synthetic Peptide
EDVIPEGWKADTSYSAK

SEQ ID NO: 9230 - protein, 20 aa, Artificial Sequence
  Synthetic Peptide
ELQFRRVKCKYPDDTKPTFH

SEQ ID NO: 9231 - protein, 20 aa, Artificial Sequence
  Synthetic Peptide
EQNVRSAGELELQFRRVKCK

SEQ ID NO: 9232 - protein, 20 aa, Artificial Sequence
  Synthetic Peptide
ESWGAVWRIDTPDKLTGPFT

SEQ ID NO: 9233 - protein, 16 aa, Artificial Sequence
  Synthetic Peptide
FDLSGHAFGSMAKKGE

SEQ ID NO: 9234 - protein, 21 aa, Artificial Sequence
  Synthetic Peptide
GDVVAVVDIKEKGKDKWIELK

SEQ ID NO: 9235 - protein, 15 aa, Artificial Sequence
  Synthetic Peptide
GEKRAYAASDPGRYC

SEQ ID NO: 9236 - protein, 20 aa, Artificial Sequence
  Synthetic Peptide
KGKDKWIELKESWGAVWRID

SEQ ID NO: 9237 - protein, 14 aa, Artificial Sequence
  Synthetic Peptide
LSGHAFGSMAKKGE

SEQ ID NO: 9238 - protein, 20 aa, Artificial Sequence
  Synthetic Peptide
SEVEDVIPEGWKADTSYSAK

SEQ ID NO: 9239 - protein, 14 aa, Artificial Sequence
  Synthetic Peptide
VAYESSEIASKKAG

SEQ ID NO: 9240 - protein, 20 aa, Artificial Sequence
  Synthetic Peptide
VEKGSNPNYLAILVKYVDGD

SEQ ID NO: 9241 - protein, 12 aa, Artificial Sequence
  Synthetic Peptide
YHFDLSGHAFGS

SEQ ID NO: 9242 - protein, 18 aa, Artificial Sequence
  Synthetic Peptide
YHFDLSGHAFGSMAKKGE

SEQ ID NO: 9243 - protein, 20 aa, Artificial Sequence
  Synthetic Peptide
YPDDTKPTFHVEKGSNPNYL

SEQ ID NO: 9244 - protein, 17 aa, Artificial Sequence
  Synthetic Peptide
KSDNQIKAVPASQALVA

SEQ ID NO: 9245 - protein, 13 aa, Artificial Sequence
  Synthetic Peptide
PKSDNQIKAVPAS

SEQ ID NO: 9246 - protein, 15 aa, Artificial Sequence
  Synthetic Peptide
PKSDNQIKAVPASQA

SEQ ID NO: 9247 - protein, 15 aa, Artificial Sequence
  Synthetic Peptide
VRPKSDNQIKAVPAS

SEQ ID NO: 9248 - protein, 14 aa, Artificial Sequence
  Synthetic Peptide
FRKDIAAKYKELGY

SEQ ID NO: 9249 - protein, 15 aa, Artificial Sequence
  Synthetic Peptide
LFRKDIAAKYKELGY

SEQ ID NO: 9250 - protein, 13 aa, Artificial Sequence
  Synthetic Peptide
NKALELFRKDIAA

SEQ ID NO: 9251 - protein, 14 aa, Artificial Sequence
  Synthetic Peptide
NKALELFRKDIAAK

SEQ ID NO: 9252 - protein, 15 aa, Artificial Sequence
  Synthetic Peptide
NKALELFRKDIAAKY

SEQ ID NO: 9253 - protein, 22 aa, Artificial Sequence
  Synthetic Peptide
NKALELFRKDIAAKYKELGYQG

SEQ ID NO: 9254 - protein, 13 aa, Artificial Sequence
  Synthetic Peptide
RKDIAAKYKELGY

SEQ ID NO: 9255 - protein, 20 aa, Artificial Sequence
  Synthetic Peptide
FTKKMVENAKKIEVEFDKGQ

SEQ ID NO: 9256 - protein, 11 aa, Artificial Sequence
  Synthetic Peptide
GLAKVAYVYKP

SEQ ID NO: 9257 - protein, 20 aa, Artificial Sequence
  Synthetic Peptide
HEQHLRKSEAQAKKEKLNIW

SEQ ID NO: 9258 - protein, 11 aa, Artificial Sequence
  Synthetic Peptide
LVRQGLAKVAY

SEQ ID NO: 9259 - protein, 20 aa, Artificial Sequence
  Synthetic Peptide
PATLIKAIDGDTVKLMYKGQ

SEQ ID NO: 9260 - protein, 20 aa, Artificial Sequence
  Synthetic Peptide
PMTFRLLLVDTPETKHPKKG

SEQ ID NO: 9261 - protein, 11 aa, Artificial Sequence
  Synthetic Peptide
QGLAKVAYVYK

SEQ ID NO: 9262 - protein, 11 aa, Artificial Sequence
  Synthetic Peptide
RQGLAKVAYVY

SEQ ID NO: 9263 - protein, 20 aa, Artificial Sequence
  Synthetic Peptide
TPETKHPKKGVEKYGPEASA

SEQ ID NO: 9264 - protein, 20 aa, Artificial Sequence
  Synthetic Peptide
VEKYGPEASAFTKKMVENAK

SEQ ID NO: 9265 - protein, 11 aa, Artificial Sequence
  Synthetic Peptide
VRQGLAKVAYV

SEQ ID NO: 9266 - protein, 20 aa, Artificial Sequence
  Synthetic Peptide
YIYADGKMVNEALVRQGLAK

SEQ ID NO: 9267 - protein, 20 aa, Artificial Sequence
  Synthetic Peptide
FTKKMVENAKKIEVEFDKGQ

SEQ ID NO: 9268 - protein, 20 aa, Artificial Sequence
  Synthetic Peptide
HEQHLRKSEAQAKKEKLNIW

SEQ ID NO: 9269 - protein, 20 aa, Artificial Sequence
  Synthetic Peptide
PATLIKAIDGDTVKLMYKGQ

SEQ ID NO: 9270 - protein, 19 aa, Artificial Sequence
  Synthetic Peptide
QAKKEKLNIWSEDNADSGQ

SEQ ID NO: 9271 - protein, 20 aa, Artificial Sequence
  Synthetic Peptide
VEKYGPEASAFTKKMVENAK

SEQ ID NO: 9272 - protein, 20 aa, Artificial Sequence
  Synthetic Peptide
YIYADGKMVNEALVRQGLAK

SEQ ID NO: 9273 - protein, 17 aa, Artificial Sequence
  Synthetic Peptide
YGAVDSILGGVATYGAA

SEQ ID NO: 9274 - protein, 15 aa, Artificial Sequence
  Synthetic Peptide
AGTIAALNNSIGVLG

SEQ ID NO: 9275 - protein, 15 aa, Artificial Sequence
  Synthetic Peptide
GSISYPARYANAMAV

SEQ ID NO: 9276 - protein, 15 aa, Artificial Sequence
  Synthetic Peptide
GTVAALDNSAGVLGV

SEQ ID NO: 9277 - protein, 15 aa, Artificial Sequence
  Synthetic Peptide
GTVAALDNSIGVLGV

SEQ ID NO: 9278 - protein, 15 aa, Artificial Sequence
  Synthetic Peptide
GTVAALNNSAGVLGV

SEQ ID NO: 9279 - protein, 15 aa, Artificial Sequence
  Synthetic Peptide
GTVAALNNSIGVLGV

SEQ ID NO: 9280 - protein, 15 aa, Artificial Sequence
  Synthetic Peptide
IAALNNSIGVLGVAP

SEQ ID NO: 9281 - protein, 15 aa, Artificial Sequence
  Synthetic Peptide
NGIEWAIANNMDVAN

SEQ ID NO: 9282 - protein, 15 aa, Artificial Sequence
  Synthetic Peptide
NGIEWAIANNMDVIN

SEQ ID NO: 9283 - protein, 15 aa, Artificial Sequence
  Synthetic Peptide
SYPARYANAMAVGAT

SEQ ID NO: 9284 - protein, 15 aa, Artificial Sequence
  Synthetic Peptide
TGSGVKVAVLDTGIS

SEQ ID NO: 9285 - protein, 13 aa, Artificial Sequence
  Synthetic Peptide
ANSKFIGITELKK

SEQ ID NO: 9286 - protein, 15 aa, Artificial Sequence
  Synthetic Peptide
IKANSKFIGITELKK

SEQ ID NO: 9287 - protein, 10 aa, Artificial Sequence
  Synthetic Peptide
ILMQYIKANS

SEQ ID NO: 9288 - protein, 14 aa, Artificial Sequence
  Synthetic Peptide
QAIKANSKFIGITE

SEQ ID NO: 9289 - protein, 14 aa, Artificial Sequence
  Synthetic Peptide
QEIKANSKFIGITE

SEQ ID NO: 9290 - protein, 14 aa, Artificial Sequence
  Synthetic Peptide
QSIKANSKFIGITE

SEQ ID NO: 9291 - protein, 14 aa, Artificial Sequence
  Synthetic Peptide
QYIKANQKFIGITE

SEQ ID NO: 9292 - protein, 14 aa, Artificial Sequence
  Synthetic Peptide
QYIKANSKFKGITE

SEQ ID NO: 9293 - protein, 14 aa, Artificial Sequence
  Synthetic Peptide
QYIKKNSKFIGITE

SEQ ID NO: 9294 - protein, 14 aa, Artificial Sequence
  Synthetic Peptide
QYIKSNSKFIGITE

SEQ ID NO: 9295 - protein, 14 aa, Artificial Sequence
  Synthetic Peptide
QYIRANSKFIGITE

SEQ ID NO: 9296 - protein, 11 aa, Artificial Sequence
  Synthetic Peptide
SKFIGITELKK

SEQ ID NO: 9297 - protein, 14 aa, Artificial Sequence
  Synthetic Peptide
YNGQIGNDPNRDIL

SEQ ID NO: 9298 - protein, 18 aa, Artificial Sequence
  Synthetic Peptide
DTPYLDITYHFVMQRLPL

SEQ ID NO: 9299 - protein, 15 aa, Artificial Sequence
  Synthetic Peptide
GELIGILNAAKVPAD

SEQ ID NO: 9300 - protein, 17 aa, Artificial Sequence
  Synthetic Peptide
ALHIYMDGTMSQVQGSA

SEQ ID NO: 9301 - protein, 17 aa, Artificial Sequence
  Synthetic Peptide
ALHIYMNGTMSQVQGSA

SEQ ID NO: 9302 - protein, 15 aa, Artificial Sequence
  Synthetic Peptide
DQSYLQDSDPDSFQD

SEQ ID NO: 9303 - protein, 15 aa, Artificial Sequence
  Synthetic Peptide
DYSFLQDSDPDSFQD

SEQ ID NO: 9304 - protein, 15 aa, Artificial Sequence
  Synthetic Peptide
DYSYFQDSDPDSFQD

SEQ ID NO: 9305 - protein, 15 aa, Artificial Sequence
  Synthetic Peptide
DYSYLQDSDPDSFQD

SEQ ID NO: 9306 - protein, 15 aa, Artificial Sequence
  Synthetic Peptide
DYSYLQDSVPDSFQD

SEQ ID NO: 9307 - protein, 15 aa, Artificial Sequence
  Synthetic Peptide
DYSYQQDSDPDSFQD

SEQ ID NO: 9308 - protein, 21 aa, Artificial Sequence [sequence omitted]

SEQ ID NO: 9309 - protein, 13 aa, Artificial Sequence
  Synthetic Peptide
ILLSNAPLGPQFP

SEQ ID NO: 9310 - protein, 14 aa, Artificial Sequence
  Synthetic Peptide
NILLSNAPLGPQFP

SEQ ID NO: 9311 - protein, 15 aa, Artificial Sequence
  Synthetic Peptide
QNFLLSNAPLGPQFP

SEQ ID NO: 9312 - protein, 15 aa, Artificial Sequence
  Synthetic Peptide
QNIFLSNAPLGPQFP

SEQ ID NO: 9313 - protein, 15 aa, Artificial Sequence
  Synthetic Peptide
QNILLSNAPQGPQFP

SEQ ID NO: 9314 - protein, 15 aa, Artificial Sequence
  Synthetic Peptide
QNILLSNAQLGPQFP

SEQ ID NO: 9315 - protein, 15 aa, Artificial Sequence
  Synthetic Peptide
QNILLSNAVLGPQFP

SEQ ID NO: 9316 - protein, 15 aa, Artificial Sequence
  Synthetic Peptide
QNILLSNQPLGPQFP

SEQ ID NO: 9317 - protein, 15 aa, Artificial Sequence
  Synthetic Peptide
QNILLSNVPLGPQFP

SEQ ID NO: 9318 - protein, 15 aa, Artificial Sequence [sequence omitted]

SEQ ID NO: 9319 - protein, 15 aa, Artificial Sequence [sequence omitted]

SEQ ID NO: 9320 - protein, 15 aa, Artificial Sequence
  Synthetic Peptide
QNIQLSNAPLGPQFP

SEQ ID NO: 9321 - protein, 15 aa, Artificial Sequence
  Synthetic Peptide
QNIVLSNAPLGPQFP

SEQ ID NO: 9322 - protein, 15 aa, Artificial Sequence
  Synthetic Peptide
QNVLLSNAPLGPQFP

SEQ ID NO: 9323 - protein, 13 aa, Artificial Sequence
  Synthetic Peptide
SYLQDSDPDSFQD

SEQ ID NO: 9324 - protein, 13 aa, Artificial Sequence
  Synthetic Peptide
SYLQDSVPDSFQD

SEQ ID NO: 9325 - protein, 16 aa, Artificial Sequence
  Synthetic Peptide
WPSVFYNRTCQCSGNF

SEQ ID NO: 9326 - protein, 20 aa, Artificial Sequence
  Synthetic Peptide
YGQMKNGSTPMFNDINIYDL

SEQ ID NO: 9327 - protein, 12 aa, Artificial Sequence
  Synthetic Peptide
YLQDSDPDSFQD

SEQ ID NO: 9328 - protein, 14 aa, Artificial Sequence
  Synthetic Peptide
YSYLQDSDPDSFQD

SEQ ID NO: 9329 - protein, 4 aa, Artificial Sequence
  Synthetic Peptide
  VARIANT 1, 2, 3, 4: Xaa = Any Amino Acid
XXXX

SEQ ID NO: 9330 - protein, 9 aa, Artificial Sequence
  Synthetic Peptide
AFAAAAAAA

SEQ ID NO: 9331 - protein, 9 aa, Artificial Sequence
  Synthetic Peptide
AFAAAALAA

SEQ ID NO: 9332 - protein, 10 aa, Artificial Sequence
  Synthetic Peptide
AFAAAATAAA

SEQ ID NO: 9333 - protein, 10 aa, Artificial Sequence
  Synthetic Peptide
AFAAAATLAA

SEQ ID NO: 9334 - protein, 10 aa, Artificial Sequence
  Synthetic Peptide
AKQNTLKLAT

SEQ ID NO: 9335 - protein, 10 aa, Artificial Sequence
  Synthetic Peptide
AAFAAAAAAA

SEQ ID NO: 9336 - protein, 10 aa, Artificial Sequence
  Synthetic Peptide
AAFAAAALAA

SEQ ID NO: 9337 - protein, 11 aa, Artificial Sequence
  Synthetic Peptide
AAFAAAATAAA

SEQ ID NO: 9338 - protein, 11 aa, Artificial Sequence
  Synthetic Peptide
AAFAAAATLAA

SEQ ID NO: 9339 - protein, 17 aa, Artificial Sequence
  Synthetic Peptide
AHAAHAAHAAHAAHAAY

SEQ ID NO: 9340 - protein, 13 aa, Artificial Sequence
  Synthetic Peptide
EVIPMFSALSEGA

SEQ ID NO: 9341 - protein, 15 aa, Artificial Sequence
  Synthetic Peptide
EVWREEAYHAADIKD

SEQ ID NO: 9342 - protein, 16 aa, Artificial Sequence
  Synthetic Peptide
EVWREEAYHAADIKDY

SEQ ID NO: 9343 - protein, 12 aa, Artificial Sequence
  Synthetic Peptide
KYVKQNTLKLAT

SEQ ID NO: 9344 - protein, 12 aa, Artificial Sequence
  Synthetic Peptide
KYVKQNTLKLAT

SEQ ID NO: 9345 - protein, 13 aa, Artificial Sequence
  Synthetic Peptide
LNKIVRMYSPTSI

SEQ ID NO: 9346 - protein, 13 aa, Artificial Sequence
  Synthetic Peptide
NKIVRMYSPTSIL

SEQ ID NO: 9347 - protein, 10 aa, Artificial Sequence
  Synthetic Peptide
PKQNTLKLAT

SEQ ID NO: 9348 - protein, 10 aa, Artificial Sequence
  Synthetic Peptide
PKQNTLKLAT

SEQ ID NO: 9349 - protein, 13 aa, Artificial Sequence
  Synthetic Peptide
PEVIPMFSALSEG

SEQ ID NO: 9350 - protein, 13 aa, Artificial Sequence
  Synthetic Peptide
PIVQNIQGQMVHQ

SEQ ID NO: 9351 - protein, 10 aa, Artificial Sequence
  Synthetic Peptide
PKFVTLKLAT

SEQ ID NO: 9352 - protein, 10 aa, Artificial Sequence
  Synthetic Peptide
PKFVKQNTLT

SEQ ID NO: 9353 - protein, 9 aa, Artificial Sequence
  Synthetic Peptide
PKFVQKLAT

SEQ ID NO: 9354 - protein, 13 aa, Artificial Sequence
  Synthetic Peptide
QEQIGWMTNNPPI

SEQ ID NO: 9355 - protein, 17 aa, Artificial Sequence
  Synthetic Peptide
TFGLQLELTEGMRFDKG

SEQ ID NO: 9356 - protein, 11 aa, Artificial Sequence
  Synthetic Peptide
TYQRTRALVTG

SEQ ID NO: 9357 - protein, 13 aa, Artificial Sequence
  Synthetic Peptide
VQNIQGQMVHQAI

SEQ ID NO: 9358 - protein, 15 aa, Artificial Sequence
  Synthetic Peptide
YIDVWLGGLAENFLP

SEQ ID NO: 9359 - protein, 19 aa, Artificial Sequence
  Synthetic Peptide
YKKSIQFHWKNSNQIKILG

SEQ ID NO: 9360 - protein, 13 aa, Artificial Sequence
  Synthetic Peptide
YKLNDRADSRRSL

SEQ ID NO: 9361 - protein, 18 aa, Artificial Sequence
  Synthetic Peptide
YKPVSQLRLATPLLLRPL

SEQ ID NO: 9362 - protein, 18 aa, Artificial Sequence
  Synthetic Peptide
YLDPLIRGLLARPAKLQV

SEQ ID NO: 9363 - protein, 25 aa, Artificial Sequence
  Synthetic Peptide
YLPKPPKPVSKLRLATPLLLQALPL

SEQ ID NO: 9364 - protein, 10 aa, Artificial Sequence
  Synthetic Peptide
AAAKTAAAFA

SEQ ID NO: 9365 - protein, 10 aa, Artificial Sequence
  Synthetic Peptide
AAAKTAAAFA

SEQ ID NO: 9366 - protein, 9 aa, Artificial Sequence
  Synthetic Peptide
RQTTLKAAA

SEQ ID NO: 9367 - protein, 9 aa, Artificial Sequence
  Synthetic Peptide
RQTTLKAAA

SEQ ID NO: 9368 - protein, 10 aa, Artificial Sequence
  Synthetic Peptide
AAAKTAAAFA

SEQ ID NO: 9369 - protein, 9 aa, Artificial Sequence
  Synthetic Peptide
RQTTLKAAA

SEQ ID NO: 9370 - protein, 8 aa, Artificial Sequence
  Synthetic Peptide
AAAATKAA

SEQ ID NO: 9371 - protein, 8 aa, Artificial Sequence
  Synthetic Peptide
AAAATKAA

SEQ ID NO: 9372 - protein, 8 aa, Artificial Sequence
  Synthetic Peptide
AAAATKAA

SEQ ID NO: 9373 - protein, 10 aa, Artificial Sequence
  Synthetic Peptide
AAAATKAAAA

SEQ ID NO: 9374 - protein, 8 aa, Artificial Sequence
  Synthetic Peptide
AAAKTAAA

SEQ ID NO: 9375 - protein, 10 aa, Artificial Sequence
  Synthetic Peptide
AAAKTAAAFA

SEQ ID NO: 9376 - protein, 9 aa, Artificial Sequence
  Synthetic Peptide
AAAKTAAAF

SEQ ID NO: 9377 - protein, 9 aa, Artificial Sequence
  Synthetic Peptide
AAKTAAAFA

SEQ ID NO: 9378 - protein, 10 aa, Artificial Sequence
  Synthetic Peptide
AAAKTAAAFA

SEQ ID NO: 9379 - protein, 14 aa, Artificial Sequence
  Synthetic Peptide
YARFQSQTTLKAKT

SEQ ID NO: 9380 - protein, 13 aa, Artificial Sequence
  Synthetic Peptide
AADFFFFFFFFDA

SEQ ID NO: 9381 - protein, 13 aa, Artificial Sequence
  Synthetic Peptide
AAFGIDIFGFKIA

SEQ ID NO: 9382 - protein, 10 aa, Artificial Sequence
  Synthetic Peptide
AAAKTAAAFA

SEQ ID NO: 9383 - protein, 10 aa, Artificial Sequence
  Synthetic Peptide
AAAATKAAAA

SEQ ID NO: 9384 - protein, 10 aa, Artificial Sequence
  Synthetic Peptide
AAAKTAAAFA

SEQ ID NO: 9385 - protein, 10 aa, Artificial Sequence
  Synthetic Peptide
AAAATKAAAA

SEQ ID NO: 9386 - protein, 10 aa, Artificial Sequence
  Synthetic Peptide
AAAKTAAAFA

SEQ ID NO: 9387 - protein, 10 aa, Artificial Sequence
  Synthetic Peptide
AAAKTAAAFA

SEQ ID NO: 9388 - protein, 10 aa, Artificial Sequence
  Synthetic Peptide
AAAATKAAAA

SEQ ID NO: 9389 - protein, 8 aa, Artificial Sequence
  Synthetic Peptide
AAAKTAAA

SEQ ID NO: 9390 - protein, 8 aa, Artificial Sequence
  Synthetic Peptide
AAAKTAAA

SEQ ID NO: 9391 - protein, 8 aa, Artificial Sequence
  Synthetic Peptide
AAAKTAAA

SEQ ID NO: 9392 - protein, 10 aa, Artificial Sequence
  Synthetic Peptide
AAAKTAAAAA

SEQ ID NO: 9393 - protein, 10 aa, Artificial Sequence
  Synthetic Peptide
AAAKTAAAFA

SEQ ID NO: 9394 - protein, 9 aa, Artificial Sequence
  Synthetic Peptide
AAKTAAAFA

SEQ ID NO: 9395 - protein, 10 aa, Artificial Sequence
  Synthetic Peptide
AAAATKAAAA

SEQ ID NO: 9396 - protein, 10 aa, Artificial Sequence
  Synthetic Peptide
AAAKTAAAFA

SEQ ID NO: 9397 - protein, 10 aa, Artificial Sequence
  Synthetic Peptide
AAAATKAAAA

SEQ ID NO: 9398 - protein, 10 aa, Artificial Sequence
  Synthetic Peptide
AAAKTAAAFA

SEQ ID NO: 9399 - protein, 10 aa, Artificial Sequence
  Synthetic Peptide
AAAKTAAAFA

SEQ ID NO: 9400 - protein, 10 aa, Artificial Sequence
  Synthetic Peptide
AAAATKAAAA

SEQ ID NO: 9401 - protein, 10 aa, Artificial Sequence
  Synthetic Peptide
AAAKTAAAFA

SEQ ID NO: 9402 - protein, 10 aa, Artificial Sequence
  Synthetic Peptide
AAAATKAAAA

SEQ ID NO: 9403 - protein, 10 aa, Artificial Sequence
  Synthetic Peptide
AAAKTAAAFA

SEQ ID NO: 9404 - protein, 10 aa, Artificial Sequence
  Synthetic Peptide
AAAKTAAAFA

SEQ ID NO: 9405 - protein, 13 aa, Artificial Sequence
  Synthetic Peptide
PKFVKQNTLKLAT

SEQ ID NO: 9406 - protein, 12 aa, Artificial Sequence
  Synthetic Peptide
AAYAAAAAAKAA

SEQ ID NO: 9407 - protein, 10 aa, Artificial Sequence
  Synthetic Peptide
FAAAAAAKAA

SEQ ID NO: 9408 - protein, 10 aa, Artificial Sequence
  Synthetic Peptide
QSQTTLKAKT

SEQ ID NO: 9409 - protein, 14 aa, Artificial Sequence
  Synthetic Peptide
YAAFQRQTTLKAAA

SEQ ID NO: 9410 - protein, 10 aa, Artificial Sequence
  Synthetic Peptide
AAAKTAAAFA

SEQ ID NO: 9411 - protein, 30 aa, Artificial Sequence; identical to SEQ ID NO: 8198
  Synthetic Peptide

SEQ ID NO: 9412 - protein, 11 aa, Artificial Sequence
  Synthetic Peptide
AAAAKTAAAAA

SEQ ID NO: 9413 - protein, 10 aa, Artificial Sequence
  Synthetic Peptide
AAAAKTAAAA

SEQ ID NO: 9414 - protein, 11 aa, Artificial Sequence
  Synthetic Peptide
AAAAKTAAAFA

SEQ ID NO: 9415 - protein, 9 aa, Artificial Sequence
  Synthetic Peptide
AAAAKTAAA

SEQ ID NO: 9416 - protein, 9 aa, Artificial Sequence
  Synthetic Peptide
AAAAKTAAA

SEQ ID NO: 9417 - protein, 8 aa, Artificial Sequence
  Synthetic Peptide
AAAAKTAA

SEQ ID NO: 9418 - protein, 8 aa, Artificial Sequence
  Synthetic Peptide
AAAAKTAA

SEQ ID NO: 9419 - protein, 12 aa, Artificial Sequence
  Synthetic Peptide
AAAAAAAAKAAA

SEQ ID NO: 9420 - protein, 12 aa, Artificial Sequence
  Synthetic Peptide
AAAAAAAAKAAA

SEQ ID NO: 9421 - protein, 10 aa, Artificial Sequence
  Synthetic Peptide
AAAATKAAAA

SEQ ID NO: 9422 - protein, 11 aa, Artificial Sequence
  Synthetic Peptide
AAAAAAKAAAA

SEQ ID NO: 9423 - protein, 12 aa, Artificial Sequence
  Synthetic Peptide
AAAAAAAAKAAA

SEQ ID NO: 9424 - protein, 12 aa, Artificial Sequence
  Synthetic Peptide
AAAAAAPKAAAA

SEQ ID NO: 9425 - protein, 12 aa, Artificial Sequence
  Synthetic Peptide
AAAAAATEKAAA

SEQ ID NO: 9426 - protein, 12 aa, Artificial Sequence
  Synthetic Peptide
AAAAAATFKAAA

SEQ ID NO: 9427 - protein, 12 aa, Artificial Sequence
  Synthetic Peptide
AAAAAATIKAAA

SEQ ID NO: 9428 - protein, 10 aa, Artificial Sequence
  Synthetic Peptide
AAAAAATKAA

SEQ ID NO: 9429 - protein, 10 aa, Artificial Sequence
  Synthetic Peptide
AAAAAATKAA

SEQ ID NO: 9430 - protein, 10 aa, Artificial Sequence
  Synthetic Peptide
AAAAAATKAA

SEQ ID NO: 9431 - protein, 10 aa, Artificial Sequence
  Synthetic Peptide
AAAAAATKAA

SEQ ID NO: 9432 - protein, 10 aa, Artificial Sequence
  Synthetic Peptide
AAAAAATKAA

SEQ ID NO: 9433 - protein, 10 aa, Artificial Sequence
  Synthetic Peptide
AAAAAATKAA

SEQ ID NO: 9434 - protein, 10 aa, Artificial Sequence
  Synthetic Peptide
AAAAAATKAA

SEQ ID NO: 9435 - protein, 10 aa, Artificial Sequence
  Synthetic Peptide
AAAAAATKAA

SEQ ID NO: 9436 - protein, 12 aa, Artificial Sequence
  Synthetic Peptide
AAAAAATKAAAA

SEQ ID NO: 9437 - protein, 12 aa, Artificial Sequence
  Synthetic Peptide
AAAAAATKAAAA

SEQ ID NO: 9438 - protein, 12 aa, Artificial Sequence
  Synthetic Peptide
AAAAAATKKAAA

SEQ ID NO: 9439 - protein, 12 aa, Artificial Sequence
  Synthetic Peptide
AAAAAATLEAAA

SEQ ID NO: 9440 - protein, 12 aa, Artificial Sequence
  Synthetic Peptide
AAAAAATLFAAA

SEQ ID NO: 9441 - protein, 12 aa, Artificial Sequence
  Synthetic Peptide
AAAAAATLKAAA

SEQ ID NO: 9442 - protein, 12 aa, Artificial Sequence
  Synthetic Peptide
AAAAAATLKAEA

SEQ ID NO: 9443 - protein, 12 aa, Artificial Sequence
  Synthetic Peptide
AAAAAATLKAFA

SEQ ID NO: 9444 - protein, 12 aa, Artificial Sequence
  Synthetic Peptide
AAAAAATLKAQA

SEQ ID NO: 9445 - protein, 12 aa, Artificial Sequence
  Synthetic Peptide
AAAAAATLKAVA

SEQ ID NO: 9446 - protein, 12 aa, Artificial Sequence
  Synthetic Peptide
AAAAAATLKEAA

SEQ ID NO: 9447 - protein, 12 aa, Artificial Sequence
  Synthetic Peptide
AAAAAATLKFAA

SEQ ID NO: 9448 - protein, 12 aa, Artificial Sequence
  Synthetic Peptide
AAAAAATLKIAA

SEQ ID NO: 9449 - protein, 12 aa, Artificial Sequence
  Synthetic Peptide
AAAAAATLKKAA

SEQ ID NO: 9450 - protein, 12 aa, Artificial Sequence
  Synthetic Peptide
AAAAAATLKQAA

SEQ ID NO: 9451 - protein, 12 aa, Artificial Sequence
  Synthetic Peptide
AAAAAATLKVAA

SEQ ID NO: 9452 - protein, 12 aa, Artificial Sequence
  Synthetic Peptide
AAAAAATLQAAA

SEQ ID NO: 9453 - protein, 12 aa, Artificial Sequence
  Synthetic Peptide
AAAAAATLRAAA

SEQ ID NO: 9454 - protein, 12 aa, Artificial Sequence
  Synthetic Peptide
AAAAAATQKAAA

SEQ ID NO: 9455 - protein, 12 aa, Artificial Sequence
  Synthetic Peptide
AAAAAATVKAAA

SEQ ID NO: 9456 - protein, 12 aa, Artificial Sequence
  Synthetic Peptide
AAAAAETLKAAA

SEQ ID NO: 9457 - protein, 12 aa, Artificial Sequence
  Synthetic Peptide
AAAAAFTLKAAA

SEQ ID NO: 9458 - protein, 10 aa, Artificial Sequence
  Synthetic Peptide
AAAAAKTAAA

SEQ ID NO: 9459 - protein, 12 aa, Artificial Sequence
  Synthetic Peptide
AAAAAKTAAAAA

SEQ ID NO: 9460 - protein, 12 aa, Artificial Sequence
  Synthetic Peptide
AAAAAKTLKAAA

SEQ ID NO: 9461 - protein, 12 aa, Artificial Sequence
  Synthetic Peptide
AAAAAQTLKAAA

SEQ ID NO: 9462 - protein, 12 aa, Artificial Sequence
  Synthetic Peptide
AAAAATTLKAAA

SEQ ID NO: 9463 - protein, 12 aa, Artificial Sequence
  Synthetic Peptide
AAAAAVTLKAAA

SEQ ID NO: 9464 - protein, 12 aa, Artificial Sequence
  Synthetic Peptide
AAAAEATLKAAA

SEQ ID NO: 9465 - protein, 12 aa, Artificial Sequence
  Synthetic Peptide
AAAAFATLKAAA

SEQ ID NO: 9466 - protein, 12 aa, Artificial Sequence
  Synthetic Peptide
AAAAKATLKAAA

SEQ ID NO: 9467 - protein, 12 aa, Artificial Sequence
  Synthetic Peptide
AAAAQATLKAAA

SEQ ID NO: 9468 - protein, 12 aa, Artificial Sequence
  Synthetic Peptide
AAAAVATLKAAA

SEQ ID NO: 9469 - protein, 12 aa, Artificial Sequence
  Synthetic Peptide
AAAEAATLKAAA

SEQ ID NO: 9470 - protein, 12 aa, Artificial Sequence
  Synthetic Peptide
AAAFAATLKAAA

SEQ ID NO: 9471 - protein, 12 aa, Artificial Sequence
  Synthetic Peptide
AAAKAATLKAAA

SEQ ID NO: 9472 - protein, 12 aa, Artificial Sequence
  Synthetic Peptide
AAAQAATLKAAA

SEQ ID NO: 9473 - protein, 12 aa, Artificial Sequence
  Synthetic Peptide
AAAVAATLKAAA

SEQ ID NO: 9474 - protein, 12 aa, Artificial Sequence
  Synthetic Peptide
AAEAAATLKAAA

SEQ ID NO: 9475 - protein, 12 aa, Artificial Sequence
  Synthetic Peptide
AAFAAATLKAAA

SEQ ID NO: 9476 - protein, 12 aa, Artificial Sequence
  Synthetic Peptide
AAIAAATLKAAA

SEQ ID NO: 9477 - protein, 12 aa, Artificial Sequence
  Synthetic Peptide
AAKAAATLKAAA

SEQ ID NO: 9478 - protein, 12 aa, Artificial Sequence
  Synthetic Peptide
AALAAATLKAAA

SEQ ID NO: 9479 - protein, 12 aa, Artificial Sequence
  Synthetic Peptide
AAQAAATLKAAA

SEQ ID NO: 9480 - protein, 12 aa, Artificial Sequence
  Synthetic Peptide
AAVAAATLKAAA

SEQ ID NO: 9481 - protein, 12 aa, Artificial Sequence
  Synthetic Peptide
AAVVAATLKAFA

SEQ ID NO: 9482 - protein, 12 aa, Artificial Sequence
  Synthetic Peptide
AAAAAATKAAAA

SEQ ID NO: 9483 - protein, 11 aa, Artificial Sequence
  Synthetic Peptide
AAAAKTAAAFA

SEQ ID NO: 9484 - protein, 11 aa, Artificial Sequence
  Synthetic Peptide
AAAAKTGGGFG

SEQ ID NO: 9485 - protein, 11 aa, Artificial Sequence
  Synthetic Peptide
AAGGKGGGGFG

SEQ ID NO: 9486 - protein, 11 aa, Artificial Sequence
  Synthetic Peptide
AAGGKTAAAFA

SEQ ID NO: 9487 - protein, 11 aa, Artificial Sequence
  Synthetic Peptide
AAGGKTGGGFG

SEQ ID NO: 9488 - protein, 12 aa, Artificial Sequence
  Synthetic Peptide
AAAAAAAAKAAA

SEQ ID NO: 9489 - protein, 12 aa, Artificial Sequence
  Synthetic Peptide
AAAAAAAAKAAA

SEQ ID NO: 9490 - protein, 12 aa, Artificial Sequence
  Synthetic Peptide
AAAAAAAAKAAA

SEQ ID NO: 9491 - protein, 12 aa, Artificial Sequence
  Synthetic Peptide
AAAAAAAAKAAA

SEQ ID NO: 9492 - protein, 12 aa, Artificial Sequence
  Synthetic Peptide
AAAAAAAAKAAA

SEQ ID NO: 9493 - protein, 12 aa, Artificial Sequence
  Synthetic Peptide
AAAAAAAAKAAA

SEQ ID NO: 9494 - protein, 12 aa, Artificial Sequence
  Synthetic Peptide
AAAAAAAAKAAA

SEQ ID NO: 9495 - protein, 12 aa, Artificial Sequence
  Synthetic Peptide
AAAAAAAAKAAA

SEQ ID NO: 9496 - protein, 13 aa, Artificial Sequence
  Synthetic Peptide
AAAAKAATLKAAA

SEQ ID NO: 9497 - protein, 14 aa, Artificial Sequence
  Synthetic Peptide
AAAFAAAKTAAAFA

SEQ ID NO: 9498 - protein, 12 aa, Artificial Sequence
  Synthetic Peptide
AAAKAAAAAAAA

SEQ ID NO: 9499 - protein, 13 aa, Artificial Sequence
  Synthetic Peptide
AAAKAAAAAAFAA

SEQ ID NO: 9500 - protein, 13 aa, Artificial Sequence
  Synthetic Peptide
AAAKAAAAAAYAA

SEQ ID NO: 9501 - protein, 13 aa, Artificial Sequence
  Synthetic Peptide
AAAKAAAAAAYAA

SEQ ID NO: 9502 - protein, 13 aa, Artificial Sequence
  Synthetic Peptide
AAAKAAAAAFAAA

SEQ ID NO: 9503 - protein, 12 aa, Artificial Sequence
  Synthetic Peptide
AAAKATAAAAAA

SEQ ID NO: 9504 - protein, 13 aa, Artificial Sequence
  Synthetic Peptide
AADFGIFIDFIIA

SEQ ID NO: 9505 - protein, 13 aa, Artificial Sequence
  Synthetic Peptide
AAEAAAAAAKAAA

SEQ ID NO: 9506 - protein, 13 aa, Artificial Sequence
  Synthetic Peptide
AAFAAAAAAKAAA

SEQ ID NO: 9507 - protein, 13 aa, Artificial Sequence
  Synthetic Peptide
AAFAAAAAARLFA

SEQ ID NO: 9508 - protein, 13 aa, Artificial Sequence
  Synthetic Peptide
AAFAAAABKAAAA

SEQ ID NO: 9509 - protein, 13 aa, Artificial Sequence
  Synthetic Peptide
AAFAAAATAKAAA

SEQ ID NO: 9510 - protein, 13 aa, Artificial Sequence
  Synthetic Peptide
AAFAAAATAKAAA

SEQ ID NO: 9511 - protein, 13 aa, Artificial Sequence
  Synthetic Peptide
AAFAAAATLKAAA

SEQ ID NO: 9512 - protein, 13 aa, Artificial Sequence
  Synthetic Peptide
AAFAAAATLKAAA

SEQ ID NO: 9513 - protein, 13 aa, Artificial Sequence
  Synthetic Peptide
AAFAAAATLKAKA

SEQ ID NO: 9514 - protein, 13 aa, Artificial Sequence
  Synthetic Peptide
AAFAAAATLKKAA

SEQ ID NO: 9515 - protein, 13 aa, Artificial Sequence
  Synthetic Peptide
AAFAAAKTAAAAA

SEQ ID NO: 9516 - protein, 13 aa, Artificial Sequence
  Synthetic Peptide
AAFAAAKTAAAFA

SEQ ID NO: 9517 - protein, 13 aa, Artificial Sequence
  Synthetic Peptide
AAFAAAKTAAAFA

SEQ ID NO: 9518 - protein, 13 aa, Artificial Sequence
  Synthetic Peptide
AAFAAAKTAAAFA

SEQ ID NO: 9519 - protein, 13 aa, Artificial Sequence
  Synthetic Peptide
AAFAAAKTAAAFE

SEQ ID NO: 9520 - protein, 13 aa, Artificial Sequence
  Synthetic Peptide
AAFAAAKTAAAKA

SEQ ID NO: 9521 - protein, 13 aa, Artificial Sequence
  Synthetic Peptide
AAFAAAKTLAAAA

SEQ ID NO: 9522 - protein, 13 aa, Artificial Sequence
  Synthetic Peptide
AAFAAAKTLKAAA

SEQ ID NO: 9523 - protein, 13 aa, Artificial Sequence
  Synthetic Peptide
AAFAAKATLKAAA

SEQ ID NO: 9524 - protein, 13 aa, Artificial Sequence
  Synthetic Peptide
AAFAANKNAAFAA

SEQ ID NO: 9525 - protein, 13 aa, Artificial Sequence
  Synthetic Peptide
AAFAAQKQAAFAA

SEQ ID NO: 9526 - protein, 13 aa, Artificial Sequence
  Synthetic Peptide
AAFAATKTAAFAA

SEQ ID NO: 9527 - protein, 13 aa, Artificial Sequence
  Synthetic Peptide
AAFAKAATAKAAA

SEQ ID NO: 9528 - protein, 13 aa, Artificial Sequence
  Synthetic Peptide
AAFAKAATLKAAA

SEQ ID NO: 9529 - protein, 13 aa, Artificial Sequence
  Synthetic Peptide
AAFAKAATLKAKA

SEQ ID NO: 9530 - protein, 13 aa, Artificial Sequence
  Synthetic Peptide
AAFAKAATLKKAA

SEQ ID NO: 9531 - protein, 13 aa, Artificial Sequence
  Synthetic Peptide
AAFAKAKTLKAAA

SEQ ID NO: 9532 - protein, 13 aa, Artificial Sequence
  Synthetic Peptide
AAFAKKATLKAAA

SEQ ID NO: 9533 - protein, 13 aa, Artificial Sequence
  Synthetic Peptide
AAFFGIFKIGKFA

SEQ ID NO: 9534 - protein, 13 aa, Artificial Sequence
  Synthetic Peptide
AAFGIKIFGFKIA

SEQ ID NO: 9535 - protein, 13 aa, Artificial Sequence
  Synthetic Peptide
AAFKKAATLKAAA

SEQ ID NO: 9536 - protein, 13 aa, Artificial Sequence
  Synthetic Peptide
AAFPPPPTLKAAA

SEQ ID NO: 9537 - protein, 13 aa, Artificial Sequence
  Synthetic Peptide
AAFVSQTTLKAAA

SEQ ID NO: 9538 - protein, 13 aa, Artificial Sequence
  Synthetic Peptide
AAHAAAAAAKAAA

SEQ ID NO: 9539 - protein, 13 aa, Artificial Sequence
  Synthetic Peptide
AAIGFFFFKKGIA

SEQ ID NO: 9540 - protein, 13 aa, Artificial Sequence
  Synthetic Peptide
AAIGGIFIFKKDA

SEQ ID NO: 9541 - protein, 13 aa, Artificial Sequence
  Synthetic Peptide
AALAAAAAAKAAA

SEQ ID NO: 9542 - protein, 13 aa, Artificial Sequence
  Synthetic Peptide
AALKATAAAAYAA

SEQ ID NO: 9543 - protein, 13 aa, Artificial Sequence
  Synthetic Peptide
AAWAAAAAAKAAA

SEQ ID NO: 9544 - protein, 11 aa, Artificial Sequence
  Synthetic Peptide
AAYAAAAKAAA

SEQ ID NO: 9545 - protein, 11 aa, Artificial Sequence
  Synthetic Peptide
AAYAAAAKAAA

SEQ ID NO: 9546 - protein, 12 aa, Artificial Sequence
  Synthetic Peptide
AAYAAAAAKAAA

SEQ ID NO: 9547 - protein, 12 aa, Artificial Sequence
  Synthetic Peptide
AAYAAAAAKAAA

SEQ ID NO: 9548 - protein, 12 aa, Artificial Sequence
  Synthetic Peptide
AAYAAAAAKAAA

SEQ ID NO: 9549 - protein, 12 aa, Artificial Sequence
  Synthetic Peptide
AAYAAAAAKAAA

SEQ ID NO: 9550 - protein, 12 aa, Artificial Sequence
  Synthetic Peptide
AAYAAAAAKAAA

SEQ ID NO: 9551 - protein, 12 aa, Artificial Sequence
  Synthetic Peptide
AAYAAAAAKAAA

SEQ ID NO: 9552 - protein, 13 aa, Artificial Sequence
  Synthetic Peptide
AAYAAAAAAKAAA

SEQ ID NO: 9553 - protein, 13 aa, Artificial Sequence
  Synthetic Peptide
AAYAAAAPAKAAA

SEQ ID NO: 9554 - protein, 13 aa, Artificial Sequence
  Synthetic Peptide
AAYAAAATAAAKA

SEQ ID NO: 9555 - protein, 13 aa, Artificial Sequence
  Synthetic Peptide
AAYAAAATAKAAA

SEQ ID NO: 9556 - protein, 13 aa, Artificial Sequence
  Synthetic Peptide
AAYAAAAYAAAKA

SEQ ID NO: 9557 - protein, 11 aa, Artificial Sequence
  Synthetic Peptide
AAYAAAAKAAA

SEQ ID NO: 9558 - protein, 13 aa, Artificial Sequence
  Synthetic Peptide
AAYAKAATLKAAA

SEQ ID NO: 9559 - protein, 12 aa, Artificial Sequence
  Synthetic Peptide
AAAAAATLKAAA

SEQ ID NO: 9560 - protein, 12 aa, Artificial Sequence
  Synthetic Peptide
AAAAAKTAAAAA

SEQ ID NO: 9561 - protein, 12 aa, Artificial Sequence
  Synthetic Peptide
AAAKAAAAAAAA

SEQ ID NO: 9562 - protein, 13 aa, Artificial Sequence
  Synthetic Peptide
AAAKAAAAAAYAA

SEQ ID NO: 9563 - protein, 13 aa, Artificial Sequence
  Synthetic Peptide
AAAKAAAAAAYAA

SEQ ID NO: 9564 - protein, 13 aa, Artificial Sequence
  Synthetic Peptide
AAFAAAATAKAAA

SEQ ID NO: 9565 - protein, 13 aa, Artificial Sequence
  Synthetic Peptide
AAFAAAATLKAAA

SEQ ID NO: 9566 - protein, 13 aa, Artificial Sequence
  Synthetic Peptide
AAFAAAKTAAAAA

SEQ ID NO: 9567 - protein, 13 aa, Artificial Sequence
  Synthetic Peptide
AAFAAAKTAAAFA

SEQ ID NO: 9568 - protein, 13 aa, Artificial Sequence
  Synthetic Peptide
AAFAAAKTLAAAA

SEQ ID NO: 9569 - protein, 13 aa, Artificial Sequence
  Synthetic Peptide
AAFAANKNAAFAA

SEQ ID NO: 9570 - protein, 13 aa, Artificial Sequence
  Synthetic Peptide
AAFAAQKQAAFAA

SEQ ID NO: 9571 - protein, 13 aa, Artificial Sequence
  Synthetic Peptide
AAFAATKTAAFAA

SEQ ID NO: 9572 - protein, 13 aa, Artificial Sequence
  Synthetic Peptide
YAALFLSAARKRA

SEQ ID NO: 9573 - protein, 13 aa, Artificial Sequence
  Synthetic Peptide
YAAAAAATLKAAA

SEQ ID NO: 9574 - protein, 13 aa, Artificial Sequence
  Synthetic Peptide
YAAAAAKTAAAAA

SEQ ID NO: 9575 - protein, 14 aa, Artificial Sequence
  Synthetic Peptide
YAAFAAAATAKAAA

SEQ ID NO: 9576 - protein, 14 aa, Artificial Sequence
  Synthetic Peptide
YAAFAAAATLKAAA

SEQ ID NO: 9577 - protein, 14 aa, Artificial Sequence
  Synthetic Peptide
YAAFAAAKTAAAAA

SEQ ID NO: 9578 - protein, 14 aa, Artificial Sequence
  Synthetic Peptide
YAAFAAAKTAAAFA

SEQ ID NO: 9579 - protein, 14 aa, Artificial Sequence
  Synthetic Peptide
YAAFAAAKTLAAAA

SEQ ID NO: 9580 - protein, 14 aa, Artificial Sequence
  Synthetic Peptide
YARFLALTTLRARA

SEQ ID NO: 9581 - protein, 12 aa, Artificial Sequence
  Synthetic Peptide
AEAAAATLKAAA

SEQ ID NO: 9582 - protein, 13 aa, Artificial Sequence
  Synthetic Peptide
AEFAAAKTLAAFA

SEQ ID NO: 9583 - protein, 12 aa, Artificial Sequence
  Synthetic Peptide
AFAAAATLKAAA

SEQ ID NO: 9584 - protein, 9 aa, Artificial Sequence
  Synthetic Peptide
AFAAAKTAA

SEQ ID NO: 9585 - protein, 11 aa, Artificial Sequence
  Synthetic Peptide
AFAAAKTAAAA

SEQ ID NO: 9586 - protein, 10 aa, Artificial Sequence
  Synthetic Peptide
AFAAAKTAAA

SEQ ID NO: 9587 - protein, 14 aa, Artificial Sequence
  Synthetic Peptide
AFLRAAAAAAFAAY

SEQ ID NO: 9588 - protein, 12 aa, Artificial Sequence
  Synthetic Peptide
AKAAAATLKAAA

SEQ ID NO: 9589 - protein, 12 aa, Artificial Sequence
  Synthetic Peptide
AKVAAATLKAAA

SEQ ID NO: 9590 - protein, 12 aa, Artificial Sequence
  Synthetic Peptide
AKVAAHTLKAAA

SEQ ID NO: 9591 - protein, 12 aa, Artificial Sequence
  Synthetic Peptide
AKVAAKTLKAAA

SEQ ID NO: 9592 - protein, 12 aa, Artificial Sequence
  Synthetic Peptide
AKVAANTLKAAA

SEQ ID NO: 9593 - protein, 12 aa, Artificial Sequence
  Synthetic Peptide
AKVAANTLKAAA

SEQ ID NO: 9594 - protein, 12 aa, Artificial Sequence
  Synthetic Peptide
AKVAAWTLKAAA

SEQ ID NO: 9595 - protein, 12 aa, Artificial Sequence
  Synthetic Peptide
AKVAAWTLKAAA

SEQ ID NO: 9596 - protein, 12 aa, Artificial Sequence
  Synthetic Peptide
AKVAAYTLKAAA

SEQ ID NO: 9597 - protein, 12 aa, Artificial Sequence
  Synthetic Peptide
AKVAAYTLKAAA

SEQ ID NO: 9598 - protein, 12 aa, Artificial Sequence
  Synthetic Peptide
AKVKAHTLKAAA

SEQ ID NO: 9599 - protein, 12 aa, Artificial Sequence
  Synthetic Peptide
AKVKAHTLKAAA

SEQ ID NO: 9600 - protein, 12 aa, Artificial Sequence
  Synthetic Peptide
AKVKANTLKAAA

SEQ ID NO: 9601 - protein, 12 aa, Artificial Sequence
  Synthetic Peptide
AKVKANTLKAAA

SEQ ID NO: 9602 - protein, 12 aa, Artificial Sequence
  Synthetic Peptide
AKVKAWTLKAAA

SEQ ID NO: 9603 - protein, 12 aa, Artificial Sequence
  Synthetic Peptide
AKVKAWTLKAAA

SEQ ID NO: 9604 - protein, 12 aa, Artificial Sequence
  Synthetic Peptide
AKVWANTLKAAA

SEQ ID NO: 9605 - protein, 12 aa, Artificial Sequence
  Synthetic Peptide
AKVWANTLKAAA

SEQ ID NO: 9606 - protein, 12 aa, Artificial Sequence
  Synthetic Peptide
AKVWAYTLKAAA

SEQ ID NO: 9607 - protein, 12 aa, Artificial Sequence
  Synthetic Peptide
AKVWAYTLKAAA

SEQ ID NO: 9608 - protein, 12 aa, Artificial Sequence
  Synthetic Peptide
AKVYAWTLKAAA

SEQ ID NO: 9609 - protein, 12 aa, Artificial Sequence
  Synthetic Peptide
AKVYAWTLKAAA

SEQ ID NO: 9610 - protein, 16 aa, Artificial Sequence
  Synthetic Peptide
AKAAKAAKAAKAAKAA

SEQ ID NO: 9611 - protein, 13 aa, Artificial Sequence
  Synthetic Peptide
AKFAAAATLKAAA

SEQ ID NO: 9612 - protein, 13 aa, Artificial Sequence
  Synthetic Peptide
AKFAAAKTAAAKA

SEQ ID NO: 9613 - protein, 13 aa, Artificial Sequence
  Synthetic Peptide
AKFAAALTLAAPA

SEQ ID NO: 9614 - protein, 13 aa, Artificial Sequence
  Synthetic Peptide
AKFAAALTLAQAA

SEQ ID NO: 9615 - protein, 13 aa, Artificial Sequence
  Synthetic Peptide
AKFIAADTLKAAA

SEQ ID NO: 9616 - protein, 13 aa, Artificial Sequence
  Synthetic Peptide
AKFIAAWTLKAAA

SEQ ID NO: 9617 - protein, 13 aa, Artificial Sequence
  Synthetic Peptide
AKFVAAWTLKAAA

SEQ ID NO: 9618 - protein, 13 aa, Artificial Sequence
  Synthetic Peptide
AKFVAAWTLKAAA

SEQ ID NO: 9619 - protein, 13 aa, Artificial Sequence
  Synthetic Peptide
AKFVAAYTLKAAA

SEQ ID NO: 9620 - protein, 13 aa, Artificial Sequence
  Synthetic Peptide
AKFVADWTLKAAA

SEQ ID NO: 9621 - protein, 13 aa, Artificial Sequence
  Synthetic Peptide
AKFVIAWTLKAAA

SEQ ID NO: 9622 - protein, 13 aa, Artificial Sequence
  Synthetic Peptide
AKFVWANTLKAAA

SEQ ID NO: 9623 - protein, 13 aa, Artificial Sequence
  Synthetic Peptide
AKFVYANTLKAAA

SEQ ID NO: 9624 - protein, 13 aa, Artificial Sequence
  Synthetic Peptide
AKIVAAWTLKAAA

SEQ ID NO: 9625 - protein, 13 aa, Artificial Sequence
  Synthetic Peptide
AKIVADWTLKAAA

SEQ ID NO: 9626 - protein, 13 aa, Artificial Sequence
  Synthetic Peptide
AKLVAAWTLKAAA

SEQ ID NO: 9627 - protein, 13 aa, Artificial Sequence
  Synthetic Peptide
AKMVAAWTLKAAA

SEQ ID NO: 9628 - protein, 13 aa, Artificial Sequence
  Synthetic Peptide
AKMVADWTLKAAA

SEQ ID NO: 9629 - protein, 12 aa, Artificial Sequence
  Synthetic Peptide
AQAAAATLKAAA

SEQ ID NO: 9630 - protein, 12 aa, Artificial Sequence
  Synthetic Peptide
ARVRANTLKAAA

SEQ ID NO: 9631 - protein, 11 aa, Artificial Sequence
  Synthetic Peptide
ARRQTTLKAAA

SEQ ID NO: 9632 - protein, 13 aa, Artificial Sequence
  Synthetic Peptide
ARFQRQTTLKAAA

SEQ ID NO: 9633 - protein, 13 aa, Artificial Sequence
  Synthetic Peptide
ARFQRQTTLKAAA

SEQ ID NO: 9634 - protein, 13 aa, Artificial Sequence
  Synthetic Peptide
ARRLKARRLKAIY

SEQ ID NO: 9635 - protein, 12 aa, Artificial Sequence
  Synthetic Peptide
AVAAAATLKAAA

SEQ ID NO: 9636 - protein, 12 aa, Artificial Sequence
  Synthetic Peptide
AVAVAATLKAFA

SEQ ID NO: 9637 - protein, 12 aa, Artificial Sequence
  Synthetic Peptide
AVVFAATLKAFA

SEQ ID NO: 9638 - protein, 12 aa, Artificial Sequence
  Synthetic Peptide
AVVVAATLKAAA

SEQ ID NO: 9639 - protein, 12 aa, Artificial Sequence
  Synthetic Peptide
AVVVAATLKAFA

SEQ ID NO: 9640 - protein, 21 aa, Artificial Sequence
  Synthetic Peptide
AWRNRAKAWRNRAKAWRNRAK

SEQ ID NO: 9641 - protein, 17 aa, Artificial Sequence
  Synthetic Peptide
AWRNRAKAWRNRAKGTD

SEQ ID NO: 9642 - protein, 10 aa, Artificial Sequence
  Synthetic Peptide
AYAAAAKAAA

SEQ ID NO: 9643 - protein, 13 aa, Artificial Sequence
  Synthetic Peptide
AYZAYAYTLKAAA

SEQ ID NO: 9644 - protein, 13 aa, Artificial Sequence
  Synthetic Peptide
AYZAYAYTLKAAA

SEQ ID NO: 9645 - protein, 14 aa, Artificial Sequence
  Synthetic Peptide
  VARIANT 3, 6, 8: Xaa = Any Amino Acid
BCXFAXAXTLKAAA

SEQ ID NO: 9646 - protein, 19 aa, Artificial Sequence
  Synthetic Peptide
DDYVKQYTKQYTKQNTLKK

SEQ ID NO: 9647 - protein, 19 aa, Artificial Sequence
  Synthetic Peptide
DDYVKQYTKQYTKQNTLKK

SEQ ID NO: 9648 - protein, 14 aa, Artificial Sequence
  Synthetic Peptide
EFAAATKAAAFAAY

SEQ ID NO: 9649 - protein, 11 aa, Artificial Sequence
  Synthetic Peptide
GGGGKGGGGFG

SEQ ID NO: 9650 - protein, 9 aa, Artificial Sequence
  Synthetic Peptide
YAAAAKAAA

SEQ ID NO: 9651 - protein, 17 aa, Artificial Sequence
  Synthetic Peptide
KNRAKNRAKNRAKNRAK

SEQ ID NO: 9652 - protein, 15 aa, Artificial Sequence
  Synthetic Peptide
KRLKRLKRLKRLKRL

SEQ ID NO: 9653 - protein, 15 aa, Artificial Sequence
  Synthetic Peptide
KSSAKVAAWTLKAAA

SEQ ID NO: 9654 - protein, 13 aa, Artificial Sequence
  Synthetic Peptide
PKYDKQGGLKIAT

SEQ ID NO: 9655 - protein, 13 aa, Artificial Sequence
  Synthetic Peptide
PKYFKQFRLKIAT

SEQ ID NO: 9656 - protein, 13 aa, Artificial Sequence
  Synthetic Peptide
PKYFKQIGLKRAT

SEQ ID NO: 9657 - protein, 13 aa, Artificial Sequence
  Synthetic Peptide
PKYGKQRFLKIAT

SEQ ID NO: 9658 - protein, 13 aa, Artificial Sequence
  Synthetic Peptide
PKYIKQDGLKGAT

SEQ ID NO: 9659 - protein, 13 aa, Artificial Sequence
  Synthetic Peptide
PKYIKQFFLKRAT

SEQ ID NO: 9660 - protein, 13 aa, Artificial Sequence
  Synthetic Peptide
PKYIKQIILKIAT

SEQ ID NO: 9661 - protein, 13 aa, Artificial Sequence
  Synthetic Peptide
PKYRKQFILKGAT

SEQ ID NO: 9662 - protein, 13 aa, Artificial Sequence
  Synthetic Peptide
PNYAAAAAAKAAA

SEQ ID NO: 9663 - protein, 12 aa, Artificial Sequence
  Synthetic Peptide
PNYAAAAAAKAA

SEQ ID NO: 9664 - protein, 12 aa, Artificial Sequence
  Synthetic Peptide
RFQRQTTLKAAA

SEQ ID NO: 9665 - protein, 15 aa, Artificial Sequence
  Synthetic Peptide
TAIKKLTTQRQFRAY

SEQ ID NO: 9666 - protein, 14 aa, Artificial Sequence
  Synthetic Peptide
TKQKLTTQSQFRAY

SEQ ID NO: 9667 - protein, 12 aa, Artificial Sequence
  Synthetic Peptide
  VARIANT 1, 4, 6: Xaa = Any Amino Acid
XFAXAXTLKAAA

SEQ ID NO: 9668 - protein, 13 aa, Artificial Sequence
  Synthetic Peptide
YAFAAAKTAAAFA

SEQ ID NO: 9669 - protein, 11 aa, Artificial Sequence
  Synthetic Peptide
YAFQQTTLAAA

SEQ ID NO: 9670 - protein, 13 aa, Artificial Sequence
  Synthetic Peptide
YAALFLSAARKRA

SEQ ID NO: 9671 - protein, 12 aa, Artificial Sequence
  Synthetic Peptide
YAAAAAAKAAAA

SEQ ID NO: 9672 - protein, 13 aa, Artificial Sequence
  Synthetic Peptide
YAAAAAAPKAAAA

SEQ ID NO: 9673 - protein, 13 aa, Artificial Sequence
  Synthetic Peptide
YAAAAAATKAAAA

SEQ ID NO: 9674 - protein, 13 aa, Artificial Sequence
  Synthetic Peptide
YAAAAAATLKAAA

SEQ ID NO: 9675 - protein, 13 aa, Artificial Sequence
  Synthetic Peptide
YAAAAAKTAAAAA

SEQ ID NO: 9676 - protein, 13 aa, Artificial Sequence
  Synthetic Peptide
YAAAVAATLKAAA

SEQ ID NO: 9677 - protein, 13 aa, Artificial Sequence
  Synthetic Peptide
YAAAAAATKAAAA

SEQ ID NO: 9678 - protein, 13 aa, Artificial Sequence
  Synthetic Peptide
YAAAAAKTAAAFA

SEQ ID NO: 9679 - protein, 14 aa, Artificial Sequence
  Synthetic Peptide
YAAAKAAAAAAFAA

SEQ ID NO: 9680 - protein, 13 aa, Artificial Sequence
  Synthetic Peptide
YAAFAAATAAAFA

SEQ ID NO: 9681 - protein, 13 aa, Artificial Sequence
  Synthetic Peptide
YAAFAAATAAAFA

SEQ ID NO: 9682 - protein, 13 aa, Artificial Sequence
  Synthetic Peptide
YAAFAAAAKAAAA

SEQ ID NO: 9683 - protein, 14 aa, Artificial Sequence
  Synthetic Peptide
YAAFAAAAAAKAAA

SEQ ID NO: 9684 - protein, 14 aa, Artificial Sequence
  Synthetic Peptide
YAAFAAAAAARLFA

SEQ ID NO: 9685 - protein, 14 aa, Artificial Sequence
  Synthetic Peptide
YAAFAAAAAQRLFA

SEQ ID NO: 9686 - protein, 14 aa, Artificial Sequence
  Synthetic Peptide
YAAFAAAATAKAAA

SEQ ID NO: 9687 - protein, 14 aa, Artificial Sequence
  Synthetic Peptide
YAAFAAAATLKAAA

SEQ ID NO: 9688 - protein, 14 aa, Artificial Sequence
  Synthetic Peptide
YAAFAAAKTAAAAA

SEQ ID NO: 9689 - protein, 14 aa, Artificial Sequence
  Synthetic Peptide
YAAFAAAKTAAAAA

SEQ ID NO: 9690 - protein, 14 aa, Artificial Sequence
  Synthetic Peptide
YAAFAAAKTAAAAA

SEQ ID NO: 9691 - protein, 14 aa, Artificial Sequence
  Synthetic Peptide
YAAFAAAKTAAAFA

SEQ ID NO: 9692 - protein, 14 aa, Artificial Sequence
  Synthetic Peptide
YAAFAAAKTAAAFA

SEQ ID NO: 9693 - protein, 14 aa, Artificial Sequence
  Synthetic Peptide
YAAFAAAKTAAAFA

SEQ ID NO: 9694 - protein, 14 aa, Artificial Sequence
  Synthetic Peptide
YAAFAAAKTAAAFE

SEQ ID NO: 9695 - protein, 14 aa, Artificial Sequence
  Synthetic Peptide
YAAFAAAKTLAAAA

SEQ ID NO: 9696 - protein, 14 aa, Artificial Sequence
  Synthetic Peptide
YAAFQRQTTLKAAA

SEQ ID NO: 9697 - protein, 14 aa, Artificial Sequence
  Synthetic Peptide
YAAFQSQTTLKAAA

SEQ ID NO: 9698 - protein, 14 aa, Artificial Sequence
  Synthetic Peptide
YAAFVRQTTLKAAA

SEQ ID NO: 9699 - protein, 14 aa, Artificial Sequence
  Synthetic Peptide
YAAFVSQTTLKAAA

SEQ ID NO: 9700 - protein, 14 aa, Artificial Sequence
  Synthetic Peptide
YAEFAAAKTLAAFA

SEQ ID NO: 9701 - protein, 13 aa, Artificial Sequence
  Synthetic Peptide
YAKQRQTTLKAAA

SEQ ID NO: 9702 - protein, 13 aa, Artificial Sequence
  Synthetic Peptide
YAKFAAAKTAAAA

SEQ ID NO: 9703 - protein, 14 aa, Artificial Sequence
  Synthetic Peptide
YAKFKSTTKKRIKS

SEQ ID NO: 9704 - protein, 14 aa, Artificial Sequence
  Synthetic Peptide
YAKFVAAWTLKAAA

SEQ ID NO: 9705 - protein, 13 aa, Artificial Sequence
  Synthetic Peptide
YARQSQTTLKAKT

SEQ ID NO: 9706 - protein, 13 aa, Artificial Sequence
  Synthetic Peptide
YARQKQTTLKAAA

SEQ ID NO: 9707 - protein, 13 aa, Artificial Sequence
  Synthetic Peptide
YARQRQTTLKAAA

SEQ ID NO: 9708 - protein, 13 aa, Artificial Sequence
  Synthetic Peptide
YARQRQTTLKAAA

SEQ ID NO: 9709 - protein, 13 aa, Artificial Sequence
  Synthetic Peptide
YARASQTTLKAKT

SEQ ID NO: 9710 - protein, 13 aa, Artificial Sequence
  Synthetic Peptide
YARASQTTLKAKT

SEQ ID NO: 9711 - protein, 12 aa, Artificial Sequence
  Synthetic Peptide
YARRQTTLKAAA

SEQ ID NO: 9712 - protein, 12 aa, Artificial Sequence
  Synthetic Peptide
YARRQTTLKAAA

SEQ ID NO: 9713 - protein, 12 aa, Artificial Sequence
  Synthetic Peptide
YARSQTTLKAKT

SEQ ID NO: 9714 - protein, 12 aa, Artificial Sequence
  Synthetic Peptide
YARSQTTLKAKT

SEQ ID NO: 9715 - protein, 13 aa, Artificial Sequence
  Synthetic Peptide
YARASQTTLKAKT

SEQ ID NO: 9716 - protein, 13 aa, Artificial Sequence
  Synthetic Peptide
YARQSQTTLKAKT

SEQ ID NO: 9717 - protein, 14 aa, Artificial Sequence
  Synthetic Peptide
YAREQSQTTLKAKT

SEQ ID NO: 9718 - protein, 14 aa, Artificial Sequence
  Synthetic Peptide
YARFGGQTTLKAKT

SEQ ID NO: 9719 - protein, 14 aa, Artificial Sequence
  Synthetic Peptide
YARFLALTTLRARA

SEQ ID NO: 9720 - protein, 14 aa, Artificial Sequence
  Synthetic Peptide
YARFLALTTLRARA

SEQ ID NO: 9721 - protein, 13 aa, Artificial Sequence
  Synthetic Peptide
YARFQSQTLKAKT

SEQ ID NO: 9722 - protein, 14 aa, Artificial Sequence
  Synthetic Peptide
YARFQSQTELKAKT

SEQ ID NO: 9723 - protein, 13 aa, Artificial Sequence
  Synthetic Peptide
YARFQSQTTLAKT

SEQ ID NO: 9724 - protein, 14 aa, Artificial Sequence
  Synthetic Peptide
YARFQSQTTLKEKT

SEQ ID NO: 9725 - protein, 15 aa, Artificial Sequence
  Synthetic Peptide
YARRLKAIFARRLKA

SEQ ID NO: 9726 - protein, 14 aa, Artificial Sequence
  Synthetic Peptide
YASFQSQTTLKAAA

SEQ ID NO: 9727 - protein, 14 aa, Artificial Sequence
  Synthetic Peptide
YASFVSQTTLKAAA

SEQ ID NO: 9728 - protein, 30 aa, Artificial Sequence; identical to SEQ ID NO: 8515
  Synthetic Peptide

SEQ ID NO: 9729 - protein, 14 aa, Artificial Sequence
  Synthetic Peptide
YPKFVKQNTLKAAT

SEQ ID NO: 9730 - protein, 15 aa, Artificial Sequence
  Synthetic Peptide
YQFIKANSKFKGKFK

SEQ ID NO: 9731 - protein, 14 aa, Artificial Sequence
  Synthetic Peptide
YSSFSSSSSSKSSS

SEQ ID NO: 9732 - protein, 14 aa, Artificial Sequence
  Synthetic Peptide
YSSFSSSSSSKSSS

SEQ ID NO: 9733 - protein, 14 aa, Artificial Sequence
  Synthetic Peptide
YSSFSSSSSSSSSS

SEQ ID NO: 9734 - protein, 14 aa, Artificial Sequence
  Synthetic Peptide
YSSFSSSSSSSSSS

SEQ ID NO: 9735 - protein, 18 aa, Artificial Sequence
  Synthetic Peptide
YVKADYVKADYVKADYVK

SEQ ID NO: 9736 - protein, 16 aa, Artificial Sequence
  Synthetic Peptide
YVKQNTLAFVKQNTLA

SEQ ID NO: 9737 - protein, 16 aa, Artificial Sequence
  Synthetic Peptide
YVKQYTKQYTKQNTLK

SEQ ID NO: 9738 - protein, 14 aa, Artificial Sequence
  Synthetic Peptide
ZAAFAAAATLKAAA

SEQ ID NO: 9739 - protein, 14 aa, Artificial Sequence
  Synthetic Peptide
  VARIANT 8: Xaa = Any Amino Acid
ZAAFAAAXTAYAYA

SEQ ID NO: 9740 - protein, 14 aa, Artificial Sequence
  Synthetic Peptide
  VARIANT 6: Xaa = Any Amino Acid
ZAAFAXAATAYAYA

SEQ ID NO: 9741 - protein, 14 aa, Artificial Sequence
  Synthetic Peptide
  VARIANT 6: Xaa = Any Amino Acid
ZAAFAXAATLKAAA

SEQ ID NO: 9742 - protein, 16 aa, Artificial Sequence
  Synthetic Peptide
SALLSSDITASVNCAK

SEQ ID NO: 9743 - protein, 16 aa, Artificial Sequence
  Synthetic Peptide
SALSEGATPQDLNTML

SEQ ID NO: 9744 - protein, 16 aa, Artificial Sequence
  Synthetic Peptide
NKALELFRKDIAAKYK

SEQ ID NO: 9745 - protein, 20 aa, Artificial Sequence
  Synthetic Peptide
NKALELFRKDIAAKYKELGY

SEQ ID NO: 9746 - protein, 18 aa, Artificial Sequence
  Synthetic Peptide
ALELFRKDIAAKYKELGY

SEQ ID NO: 9747 - protein, 15 aa, Artificial Sequence
  Synthetic Peptide
ELFRDIAAKYKELGY

SEQ ID NO: 9748 - protein, 16 aa, Artificial Sequence
  Synthetic Peptide
MAKTIAYDEEARRGLI

SEQ ID NO: 9749 - protein, 20 aa, Artificial Sequence
  Synthetic Peptide
KVYLPRMKMEEKYNLTSVLM

SEQ ID NO: 9750 - protein, 13 aa, Artificial Sequence
  Synthetic Peptide
YASFKTTTLRKFT

SEQ ID NO: 9751 - protein, 20 aa, Artificial Sequence
  Synthetic Peptide
PHHTALRQAILCWGELMTLA

SEQ ID NO: 9752 - protein, 15 aa, Artificial Sequence
  Synthetic Peptide
YKMKMVHAAHAKMKM

SEQ ID NO: 9753 - protein, 20 aa, Artificial Sequence
  Synthetic Peptide
GFYTTGAVRQIFGDYKTTIC

SEQ ID NO: 9754 - protein, 15 aa, Artificial Sequence
  Synthetic Peptide
QNILLSNAPLGPQFP

SEQ ID NO: 9755 - protein, 20 aa, Artificial Sequence
  Synthetic Peptide
AAYAAQGYKVLVLNPSVAAT

SEQ ID NO: 9756 - protein, 20 aa, Artificial Sequence
  Synthetic Peptide
GYKVLVLNPSVAATLGFGAY

SEQ ID NO: 9757 - protein, 20 aa, Artificial Sequence
  Synthetic Peptide
GYKVLVLNPSVAATLGFGAY

SEQ ID NO: 9758 - protein, 19 aa, Artificial Sequence
  Synthetic Peptide
SYVNTNMGLKFRQLLWFHI

SEQ ID NO: 9759 - protein, 12 aa, Artificial Sequence
  Synthetic Peptide
GLKFRQLLWFHI

SEQ ID NO: 9760 - protein, 20 aa, Artificial Sequence
  Synthetic Peptide
TLHGPTPLLYRLGAVQNEIT

SEQ ID NO: 9761 - protein, 20 aa, Artificial Sequence
  Synthetic Peptide
NFISGIQYLAGLSTLPGNPA

SEQ ID NO: 9762 - protein, 21 aa, Artificial Sequence
  Synthetic Peptide
GEGAVQWMNRLIAFASRGNHV

SEQ ID NO: 9763 - protein, 17 aa, Artificial Sequence
  Synthetic Peptide
KPVSQMRMATPLLMRPM

SEQ ID NO: 9764 - protein, 24 aa, Artificial Sequence
  Synthetic Peptide
LPKPPKPVSKMRMATPLLMQALPM

SEQ ID NO: 9765 - protein, 15 aa, Artificial Sequence
  Synthetic Peptide
EYLVSFGVWIRTPPA

SEQ ID NO: 9766 - protein, 15 aa, Artificial Sequence
  Synthetic Peptide
GVWIRTPPAYRPPNA

SEQ ID NO: 9767 - protein, 15 aa, Artificial Sequence
  Synthetic Peptide
RHYLHTLWKAGILYK

SEQ ID NO: 9768 - protein, 15 aa, Artificial Sequence
  Synthetic Peptide
VPNLQSLTNLLSSNL

SEQ ID NO: 9769 - protein, 15 aa, Artificial Sequence
  Synthetic Peptide
WVTVYYGVPVWKEAT

SEQ ID NO: 9770 - protein, 15 aa, Artificial Sequence
  Synthetic Peptide
YYGVPVWKEATTTLF

SEQ ID NO: 9771 - protein, 15 aa, Artificial Sequence
  Synthetic Peptide
VPVWKEATTTLFCAS

SEQ ID NO: 9772 - protein, 15 aa, Artificial Sequence
  Synthetic Peptide
LSGIVQQQNNLLRAI

SEQ ID NO: 9773 - protein, 15 aa, Artificial Sequence
  Synthetic Peptide
QQHLLQLTVWGIKQL

SEQ ID NO: 9774 - protein, 15 aa, Artificial Sequence
  Synthetic Peptide
QHLLQLTVWGIKQLQ

SEQ ID NO: 9775 - protein, 15 aa, Artificial Sequence
  Synthetic Peptide
LLQLTVWGIKQLQAR

SEQ ID NO: 9776 - protein, 15 aa, Artificial Sequence
  Synthetic Peptide
QGQMVHQAISPRTLN

SEQ ID NO: 9777 - protein, 15 aa, Artificial Sequence
  Synthetic Peptide
SPEVIPMFSALSEGA

SEQ ID NO: 9778 - protein, 15 aa, Artificial Sequence
  Synthetic Peptide
QEQIGWMTNNPPIPV

SEQ ID NO: 9779 - protein, 14 aa, Artificial Sequence
  Synthetic Peptide
GEIYRWIILGLNKI

SEQ ID NO: 9780 - protein, 15 aa, Artificial Sequence
  Synthetic Peptide
YKRWIILGLNKIVRM

SEQ ID NO: 9781 - protein, 15 aa, Artificial Sequence
  Synthetic Peptide
KRWIILGLNKIVRMY

SEQ ID NO: 9782 - protein, 15 aa, Artificial Sequence
  Synthetic Peptide
WIILGLNKIVRMYSP

SEQ ID NO: 9783 - protein, 15 aa, Artificial Sequence
  Synthetic Peptide
VKNWMTETLLVQNAN

SEQ ID NO: 9784 - protein, 15 aa, Artificial Sequence
  Synthetic Peptide
GTVLVGPTPVNIIGR

SEQ ID NO: 9785 - protein, 14 aa, Artificial Sequence
  Synthetic Peptide
PVNIIGNLLTQIGC

SEQ ID NO: 9786 - protein, 15 aa, Artificial Sequence
  Synthetic Peptide
GRNLLTQIGCTLNFP

SEQ ID NO: 9787 - protein, 15 aa, Artificial Sequence
  Synthetic Peptide
TLNFPISPIETVPVK

SEQ ID NO: 9788 - protein, 15 aa, Artificial Sequence
  Synthetic Peptide
NFPISPIETVPVKLK

SEQ ID NO: 9789 - protein, 15 aa, Artificial Sequence
  Synthetic Peptide
FRKYTAFTIPSINNE

SEQ ID NO: 9790 - protein, 15 aa, Artificial Sequence
  Synthetic Peptide
SPAIFQSSMTKILEP

SEQ ID NO: 9791 - protein, 15 aa, Artificial Sequence
  Synthetic Peptide
PAIFQSSMTKILEPF

SEQ ID NO: 9792 - protein, 15 aa, Artificial Sequence
  Synthetic Peptide
QKLVGKLNWASQIYA

SEQ ID NO: 9793 - protein, 15 aa, Artificial Sequence
  Synthetic Peptide
VGKLNWASQIYAGIK

SEQ ID NO: 9794 - protein, 15 aa, Artificial Sequence
  Synthetic Peptide
NREILKEPVHGVYYD

SEQ ID NO: 9795 - protein, 15 aa, Artificial Sequence
  Synthetic Peptide
IPEWEFVNTPPLVKL

SEQ ID NO: 9796 - protein, 15 aa, Artificial Sequence
  Synthetic Peptide
WEFVNTPPLVKLWYQ

SEQ ID NO: 9797 - protein, 15 aa, Artificial Sequence
  Synthetic Peptide
EQLIKKEKVYLAWVP

SEQ ID NO: 9798 - protein, 14 aa, Artificial Sequence
  Synthetic Peptide
EVYLAWVPAHKGIG

SEQ ID NO: 9799 - protein, 15 aa, Artificial Sequence
  Synthetic Peptide
HSNWRAMASDFNLPP

SEQ ID NO: 9800 - protein, 16 aa, Artificial Sequence
  Synthetic Peptide
NASGYIEAEVIPAETG

SEQ ID NO: 9801 - protein, 15 aa, Artificial Sequence
  Synthetic Peptide
AEHLKTAVQMAVFIH

SEQ ID NO: 9802 - protein, 15 aa, Artificial Sequence
  Synthetic Peptide
KTAVQMAVFIHNFKR

SEQ ID NO: 9803 - protein, 15 aa, Artificial Sequence
  Synthetic Peptide
QKQITKIQNFRVVYR

SEQ ID NO: 9804 - protein, 15 aa, Artificial Sequence
  Synthetic Peptide
KLLWKGEGAVVIQDN

SEQ ID NO: 9805 - protein, 15 aa, Artificial Sequence
  Synthetic Peptide
ENRWQVMIVWQVDRM

SEQ ID NO: 9806 - protein, 15 aa, Artificial Sequence
  Synthetic Peptide
VEAIIRILQQLLFIH

SEQ ID NO: 9807 - protein, 15 aa, Artificial Sequence
  Synthetic Peptide
FNVVNSSIGLIMVLS

SEQ ID NO: 9808 - protein, 15 aa, Artificial Sequence
  Synthetic Peptide
MNYYGKQENWYSLKK

SEQ ID NO: 9809 - protein, 15 aa, Artificial Sequence
  Synthetic Peptide
MRKLAILSVSSFLFV

SEQ ID NO: 9810 - protein, 15 aa, Artificial Sequence
  Synthetic Peptide
NSSIGLIMVLSFLFL

SEQ ID NO: 9811 - protein, 15 aa, Artificial Sequence
  Synthetic Peptide
SSVFNVVNSSIGLIM

SEQ ID NO: 9812 - protein, 15 aa, Artificial Sequence
  Synthetic Peptide
MKILSVFFLALFFII

SEQ ID NO: 9813 - protein, 15 aa, Artificial Sequence
  Synthetic Peptide
FILVNLLIFHINGKI

SEQ ID NO: 9814 - protein, 15 aa, Artificial Sequence
  Synthetic Peptide
HILYISFYFILVNLL

SEQ ID NO: 9815 - protein, 15 aa, Artificial Sequence
  Synthetic Peptide
LLIFHINGKIIKNSE

SEQ ID NO: 9816 - protein, 15 aa, Artificial Sequence
  Synthetic Peptide
LVNLLIFHINGKIIK

SEQ ID NO: 9817 - protein, 15 aa, Artificial Sequence
  Synthetic Peptide
NLLIFHINGKIIKNS

SEQ ID NO: 9818 - protein, 15 aa, Artificial Sequence
  Synthetic Peptide
QTNFKSLLRNLGVSE

SEQ ID NO: 9819 - protein, 15 aa, Artificial Sequence
  Synthetic Peptide
AYKFVVPGAATPYAG

SEQ ID NO: 9820 - protein, 15 aa, Artificial Sequence
  Synthetic Peptide
NVKYLVIVFLIFFDL

SEQ ID NO: 9821 - protein, 15 aa, Artificial Sequence
  Synthetic Peptide
VKNVIGPFMKAVCVE

SEQ ID NO: 9822 - protein, 15 aa, Artificial Sequence
  Synthetic Peptide
WENVKNVIGPFMKAV

SEQ ID NO: 9823 - protein, 15 aa, Artificial Sequence
  Synthetic Peptide
CSVVRRAFPHCLAFS

SEQ ID NO: 9824 - protein, 15 aa, Artificial Sequence
  Synthetic Peptide
FVQWFVGLSPTVWLS

SEQ ID NO: 9825 - protein, 15 aa, Artificial Sequence
  Synthetic Peptide
LAQFTSAICSVVRRA

SEQ ID NO: 9826 - protein, 15 aa, Artificial Sequence
  Synthetic Peptide
LVPFVQWFVGLSPTV

SEQ ID NO: 9827 - protein, 15 aa, Artificial Sequence
  Synthetic Peptide
NLSWLSLDVSAAFYH

SEQ ID NO: 9828 - protein, 15 aa, Artificial Sequence
  Synthetic Peptide
SFGVWIRTPPAYRPP

SEQ ID NO: 9829 - protein, 16 aa, Artificial Sequence
  Synthetic Peptide
SPEFLLAQFTSAICSV

SEQ ID NO: 9830 - protein, 15 aa, Artificial Sequence
  Synthetic Peptide
SSNLSWLSLDVSAAF

SEQ ID NO: 9831 - protein, 15 aa, Artificial Sequence
  Synthetic Peptide
DKELTMSNVKNVSQT

SEQ ID NO: 9832 - protein, 15 aa, Artificial Sequence
  Synthetic Peptide
AGLLGNVSTVLLGGV

SEQ ID NO: 9833 - protein, 15 aa, Artificial Sequence
  Synthetic Peptide
KSKYKLATSVLAGLL

SEQ ID NO: 9834 - protein, 15 aa, Artificial Sequence
  Synthetic Peptide
GLAYKFVVPGAATPY

SEQ ID NO: 9835 - protein, 15 aa, Artificial Sequence
  Synthetic Peptide
HNWVNHAVPLAMKLI

SEQ ID NO: 9836 - protein, 15 aa, Artificial Sequence
  Synthetic Peptide
IGPFMKAVCVEVEKT

SEQ ID NO: 9837 - protein, 15 aa, Artificial Sequence
  Synthetic Peptide
KYKIAGGIAGGLALL

SEQ ID NO: 9838 - protein, 15 aa, Artificial Sequence
  Synthetic Peptide
RHNWVNHAVPLAMKL

SEQ ID NO: 9839 - protein, 16 aa, Artificial Sequence
  Synthetic Peptide
IKQFINMWQEVGKAMY

SEQ ID NO: 9840 - protein, 15 aa, Artificial Sequence
  Synthetic Peptide
LQSLTNLLSSNLSWL

SEQ ID NO: 9841 - protein, 15 aa, Artificial Sequence
  Synthetic Peptide
PFLLAQFTSAICSVV

SEQ ID NO: 9842 - protein, 15 aa, Artificial Sequence
  Synthetic Peptide
KYKLATSVLAGLLGN

SEQ ID NO: 9843 - protein, 15 aa, Artificial Sequence
  Synthetic Peptide
LAGLLGNVSTVLLGG

SEQ ID NO: 9844 - protein, 15 aa, Artificial Sequence
  Synthetic Peptide
RHPFKIGSSDPADNA

SEQ ID NO: 9845 - protein, 15 aa, Artificial Sequence
  Synthetic Peptide
ANQLVVILTDGIPDS

SEQ ID NO: 9846 - protein, 15 aa, Artificial Sequence
  Synthetic Peptide
KFVVPGAATPYAGEP

SEQ ID NO: 9847 - protein, 15 aa, Artificial Sequence
  Synthetic Peptide
VFNVVNSSIGLIMVL

SEQ ID NO: 9848 - protein, 15 aa, Artificial Sequence
  Synthetic Peptide
VGPLTVNEKRRLKLI

SEQ ID NO: 9849 - protein, 15 aa, Artificial Sequence
  Synthetic Peptide
ESRLVVDFSQFSRGN

SEQ ID NO: 9850 - protein, 15 aa, Artificial Sequence
  Synthetic Peptide
LCQVFADATPTGWGL

SEQ ID NO: 9851 - protein, 15 aa, Artificial Sequence
  Synthetic Peptide
VVVVATDALMTGYTG

SEQ ID NO: 9852 - protein, 15 aa, Artificial Sequence
  Synthetic Peptide
TVDFSLDPTFTIETT

SEQ ID NO: 9853 - protein, 15 aa, Artificial Sequence
  Synthetic Peptide
AETFYVDGAANRETK

SEQ ID NO: 9854 - protein, 15 aa, Artificial Sequence
  Synthetic Peptide
EVNIVTDSQYALGII

SEQ ID NO: 9855 - protein, 15 aa, Artificial Sequence
  Synthetic Peptide
WAGIKQEFGIPYNPQ

SEQ ID NO: 9856 - protein, 15 aa, Artificial Sequence
  Synthetic Peptide
GAVVIQDNSDIKVVP

SEQ ID NO: 9857 - protein, 15 aa, Artificial Sequence
  Synthetic Peptide
YRKILRQRKIDRLIP

SEQ ID NO: 9858 - protein, 15 aa, Artificial Sequence
  Synthetic Peptide
PDSIQDSLKESRKLN

SEQ ID NO: 9859 - protein, 15 aa, Artificial Sequence
  Synthetic Peptide
KCNLYADSAWENVKN

SEQ ID NO: 9860 - protein, 15 aa, Artificial Sequence
  Synthetic Peptide
IGTVLVGPTPVNIIG

SEQ ID NO: 9861 - protein, 15 aa, Artificial Sequence
  Synthetic Peptide
KVYLAWVPAHKGIGG

SEQ ID NO: 9862 - protein, 15 aa, Artificial Sequence
  Synthetic Peptide
TKELQKQITKIQNFR

SEQ ID NO: 9863 - protein, 15 aa, Artificial Sequence
  Synthetic Peptide
AGEFLLTRILTIPQS

SEQ ID NO: 9864 - protein, 15 aa, Artificial Sequence
  Synthetic Peptide
GFFLLTRILTIPQSL

SEQ ID NO: 9865 - protein, 15 aa, Artificial Sequence
  Synthetic Peptide
GTSFVYVPSALNPAD

SEQ ID NO: 9866 - protein, 15 aa, Artificial Sequence
  Synthetic Peptide
IIFLFILLLCLIFLL

SEQ ID NO: 9867 - protein, 15 aa, Artificial Sequence
  Synthetic Peptide
KFAVPNLQSLTNLLS

SEQ ID NO: 9868 - protein, 15 aa, Artificial Sequence
  Synthetic Peptide
LHLYSHPIILGFRKI

SEQ ID NO: 9869 - protein, 15 aa, Artificial Sequence
  Synthetic Peptide
LLCLIFLLVLLDYQG

SEQ ID NO: 9870 - protein, 15 aa, Artificial Sequence
  Synthetic Peptide
VGLLGFAAPFTQCGY

SEQ ID NO: 9871 - protein, 15 aa, Artificial Sequence
  Synthetic Peptide
FYFILVNLLIFHING

SEQ ID NO: 9872 - protein, 15 aa, Artificial Sequence
  Synthetic Peptide
KSLLRNLGVSENIFL

SEQ ID NO: 9873 - protein, 15 aa, Artificial Sequence
  Synthetic Peptide
RGYYIPHQSSLPQDN

SEQ ID NO: 9874 - protein, 16 aa, Artificial Sequence
  Synthetic Peptide
VYLLPRRRGPRLGVRA

SEQ ID NO: 9875 - protein, 15 aa, Artificial Sequence
  Synthetic Peptide
GHRMAWDMMMNWSPT

SEQ ID NO: 9876 - protein, 14 aa, Artificial Sequence
  Synthetic Peptide
CGPYDFTPSPVVVG

SEQ ID NO: 9877 - protein, 15 aa, Artificial Sequence
  Synthetic Peptide
VYCFTPSPVVVGTTD

SEQ ID NO: 9878 - protein, 15 aa, Artificial Sequence
  Synthetic Peptide
GNWFGCTWMNSTGFT

SEQ ID NO: 9879 - protein, 15 aa, Artificial Sequence
  Synthetic Peptide
FTTLPALSTGLIHLH

SEQ ID NO: 9880 - protein, 15 aa, Artificial Sequence
  Synthetic Peptide
SKGWRLLAPITAYAQ

SEQ ID NO: 9881 - protein, 15 aa, Artificial Sequence
  Synthetic Peptide
DLYLVTRHADVIPVR

SEQ ID NO: 9882 - protein, 15 aa, Artificial Sequence
  Synthetic Peptide
AQGYKVLVLNPSVAA

SEQ ID NO: 9883 - protein, 15 aa, Artificial Sequence
  Synthetic Peptide
GYKVLVLNPSVAATL

SEQ ID NO: 9884 - protein, 15 aa, Artificial Sequence
  Synthetic Peptide
VLVLNPSVAATLGFG

SEQ ID NO: 9885 - protein, 15 aa, Artificial Sequence
  Synthetic Peptide
GARLVVLATATPPGS

SEQ ID NO: 9886 - protein, 15 aa, Artificial Sequence
  Synthetic Peptide
DVVVVATDALMTGYT

SEQ ID NO: 9887 - protein, 15 aa, Artificial Sequence
  Synthetic Peptide
FTGLTHIDAHFLSQT

SEQ ID NO: 9888 - protein, 15 aa, Artificial Sequence
  Synthetic Peptide
YLVAYQATVCARAQA

SEQ ID NO: 9889 - protein, 15 aa, Artificial Sequence
  Synthetic Peptide
LEVVTSTWVLVGGVL

SEQ ID NO: 9890 - protein, 15 aa, Artificial Sequence
  Synthetic Peptide
TWVLVGGVLAALAAY

SEQ ID NO: 9891 - protein, 15 aa, Artificial Sequence
  Synthetic Peptide
AKHMWNFISGIQYLA

SEQ ID NO: 9892 - protein, 15 aa, Artificial Sequence
  Synthetic Peptide
IQYLAGLSTLPGNPA

SEQ ID NO: 9893 - protein, 15 aa, Artificial Sequence
  Synthetic Peptide
MNRLIAFASRGNHVS

SEQ ID NO: 9894 - protein, 15 aa, Artificial Sequence
  Synthetic Peptide
SYTWTGALITPCAAE

SEQ ID NO: 9895 - protein, 15 aa, Artificial Sequence
  Synthetic Peptide
GSSYGFQYSPGQRVE

SEQ ID NO: 9896 - protein, 15 aa, Artificial Sequence
  Synthetic Peptide
LELITSCSSNVSVAH

SEQ ID NO: 9897 - protein, 15 aa, Artificial Sequence
  Synthetic Peptide
ASCLRKLGVPPLRVW

SEQ ID NO: 9898 - protein, 15 aa, Artificial Sequence
  Synthetic Peptide
VGNFTGLYSSTVPVF

SEQ ID NO: 9899 - protein, 15 aa, Artificial Sequence
  Synthetic Peptide
TNFLLSLGIHLNPNK

SEQ ID NO: 9900 - protein, 14 aa, Artificial Sequence
  Synthetic Peptide
KQFRKLPVNRPIDW

SEQ ID NO: 9901 - protein, 15 aa, Artificial Sequence
  Synthetic Peptide
KQAFTFSPTYKAFLC

SEQ ID NO: 9902 - protein, 15 aa, Artificial Sequence
  Synthetic Peptide
AANWILFGTSFVYVP

SEQ ID NO: 9903 - protein, 15 aa, Artificial Sequence
  Synthetic Peptide
PDRVHFASPLHVAWR

SEQ ID NO: 9904 - protein, 15 aa, Artificial Sequence
  Synthetic Peptide
IRPVVSTQLLLNGSL

SEQ ID NO: 9905 - protein, 15 aa, Artificial Sequence
  Synthetic Peptide
RSELYKYKVVKIEPL

SEQ ID NO: 9906 - protein, 15 aa, Artificial Sequence
  Synthetic Peptide
DRFYKTLRAEQASQE

SEQ ID NO: 9907 - protein, 15 aa, Artificial Sequence
  Synthetic Peptide
KVILVAVHVASGYIE

SEQ ID NO: 9908 - protein, 17 aa, Artificial Sequence
  Synthetic Peptide
LVNLLIFHINGKIIKNS

SEQ ID NO: 9909 - protein, 16 aa, Artificial Sequence
  Synthetic Peptide
RHNWVNHAVPLAMKLI

SEQ ID NO: 9910 - protein, 16 aa, Artificial Sequence
  Synthetic Peptide
SALLSSDITASVNCAK

SEQ ID NO: 9911 - protein, 16 aa, Artificial Sequence
  Synthetic Peptide
SALSEGATPQDLNTML

SEQ ID NO: 9912 - protein, 15 aa, Artificial Sequence
  Synthetic Peptide
NKALELFRKDIAATK

SEQ ID NO: 9913 - protein, 20 aa, Artificial Sequence
  Synthetic Peptide
NKALELFRKDIAAKYKELGY

SEQ ID NO: 9914 - protein, 18 aa, Artificial Sequence
  Synthetic Peptide
ALELFRKDIAAKYKELGY

SEQ ID NO: 9915 - protein, 16 aa, Artificial Sequence
  Synthetic Peptide
ELFRKDIAAKYKELGY

SEQ ID NO: 9916 - protein, 16 aa, Artificial Sequence
  Synthetic Peptide
MAKTIAYDEEARRGLE

SEQ ID NO: 9917 - protein, 22 aa, Artificial Sequence
  Synthetic Peptide
KVYLPRMKEMEEKYNLTSLVSM

SEQ ID NO: 9918 - protein, 14 aa, Artificial Sequence
  Synthetic Peptide
YASFVKTTTLRKFT

SEQ ID NO: 9919 - protein, 20 aa, Artificial Sequence
  Synthetic Peptide
PHHTALRQAILCWGELMTLA

SEQ ID NO: 9920 - protein, 15 aa, Artificial Sequence
  Synthetic Peptide
YKMKMVHAAHAKMKM

SEQ ID NO: 9921 - protein, 20 aa, Artificial Sequence
  Synthetic Peptide
GFYTTGAVRQIFGDYKTTIC

SEQ ID NO: 9922 - protein, 15 aa, Artificial Sequence
  Synthetic Peptide
QNILLSNAPLGPQFP

SEQ ID NO: 9923 - protein, 20 aa, Artificial Sequence
  Synthetic Peptide
AAYAAQGYKVLVLNPSVAAT

SEQ ID NO: 9924 - protein, 20 aa, Artificial Sequence
  Synthetic Peptide
GYKVLVLNPSVAATLGFGAY

SEQ ID NO: 9925 - protein, 13 aa, Artificial Sequence
  Synthetic Peptide
GYKVLVNPSVAAT

SEQ ID NO: 9926 - protein, 18 aa, Artificial Sequence
  Synthetic Peptide
SYNTNMGLKFRQLLWFHI

SEQ ID NO: 9927 - protein, 12 aa, Artificial Sequence
  Synthetic Peptide
GLKFRQLLWFHI

SEQ ID NO: 9928 - protein, 20 aa, Artificial Sequence
  Synthetic Peptide
TLHGPTPLLYRLGAVQNEIT

SEQ ID NO: 9929 - protein, 20 aa, Artificial Sequence
  Synthetic Peptide
NFISGIQYLAGLSTLPGNPA

SEQ ID NO: 9930 - protein, 21 aa, Artificial Sequence
  Synthetic Peptide
GEGAVQWMNRLIAFASRGNHV

SEQ ID NO: 9931 - protein, 17 aa, Artificial Sequence
  Synthetic Peptide
KPVSQMRMATPLLMRPM

SEQ ID NO: 9932 - protein, 24 aa, Artificial Sequence
  Synthetic Peptide
LPKPPKPVSKMRMATPLLMQALPM

SEQ ID NO: 9933 - protein, 15 aa, Artificial Sequence
  Synthetic Peptide
EYLVSFGVWIRTPPA

SEQ ID NO: 9934 - protein, 15 aa, Artificial Sequence
  Synthetic Peptide
GVWIRTPPAYRPPNA

SEQ ID NO: 9935 - protein, 15 aa, Artificial Sequence
  Synthetic Peptide
RHYLHTLWKAGILYK

SEQ ID NO: 9936 - protein, 15 aa, Artificial Sequence
  Synthetic Peptide
VPNLQSLTNLLSSNL

SEQ ID NO: 9937 - protein, 15 aa, Artificial Sequence
  Synthetic Peptide
WVTVYYGVPVWKEAT

SEQ ID NO: 9938 - protein, 15 aa, Artificial Sequence
  Synthetic Peptide
YYGVPVWKEATTTLF

SEQ ID NO: 9939 - protein, 15 aa, Artificial Sequence
  Synthetic Peptide
VPVWKEATTTLFCAS

SEQ ID NO: 9940 - protein, 15 aa, Artificial Sequence
  Synthetic Peptide
LSGIVQQQNNLLRAI

SEQ ID NO: 9941 - protein, 15 aa, Artificial Sequence
  Synthetic Peptide
QQHLLQLTVWGIKQL

SEQ ID NO: 9942 - protein, 15 aa, Artificial Sequence
  Synthetic Peptide
QHLLQLTVWGIKQLQ

SEQ ID NO: 9943 - protein, 15 aa, Artificial Sequence
  Synthetic Peptide
LLQLTVWGIKQLQAR

SEQ ID NO: 9944 - protein, 15 aa, Artificial Sequence
  Synthetic Peptide
QGQMVHQAISPRTLN

SEQ ID NO: 9945 - protein, 15 aa, Artificial Sequence
  Synthetic Peptide
SPEVIPMFSALSEGA

SEQ ID NO: 9946 - protein, 15 aa, Artificial Sequence
  Synthetic Peptide
QEQIGWMTNNPPIPV

SEQ ID NO: 9947 - protein, 15 aa, Artificial Sequence
  Synthetic Peptide
GEIYKRWIILGLNKI

SEQ ID NO: 9948 - protein, 15 aa, Artificial Sequence
  Synthetic Peptide
YKRWIILGLNKIVRM

SEQ ID NO: 9949 - protein, 15 aa, Artificial Sequence
  Synthetic Peptide
KRWIILGLNKIVRMY

SEQ ID NO: 9950 - protein, 15 aa, Artificial Sequence
  Synthetic Peptide
WIILGLNKIVRMYSP

SEQ ID NO: 9951 - protein, 15 aa, Artificial Sequence
  Synthetic Peptide
VKNWMTETLLVQNAN

SEQ ID NO: 9952 - protein, 15 aa, Artificial Sequence
  Synthetic Peptide
GTVLVGPTPVNIIGR

SEQ ID NO: 9953 - protein, 15 aa, Artificial Sequence
  Synthetic Peptide
PVNIIGRNLLTQIGC

SEQ ID NO: 9954 - protein, 15 aa, Artificial Sequence
  Synthetic Peptide
GRNLLTQIGCTLNFP

SEQ ID NO: 9955 - protein, 15 aa, Artificial Sequence
  Synthetic Peptide
TLNFPISPIETVPVK

SEQ ID NO: 9956 - protein, 16 aa, Artificial Sequence
  Synthetic Peptide
NFPISPIETTVPVKLK

SEQ ID NO: 9957 - protein, 15 aa, Artificial Sequence
  Synthetic Peptide
FRKYTAFTIPSINNE

SEQ ID NO: 9958 - protein, 15 aa, Artificial Sequence
  Synthetic Peptide
SPAIFQSSMTKILEP

SEQ ID NO: 9959 - protein, 15 aa, Artificial Sequence
  Synthetic Peptide
PAIFQSSMTKILEPF

SEQ ID NO: 9960 - protein, 15 aa, Artificial Sequence
  Synthetic Peptide
QKLVGKLNWASQIYA

SEQ ID NO: 9961 - protein, 15 aa, Artificial Sequence
  Synthetic Peptide
VGKLNWASQIYAGIK

SEQ ID NO: 9962 - protein, 15 aa, Artificial Sequence
  Synthetic Peptide
NREILKEPVHGVYYD

SEQ ID NO: 9963 - protein, 15 aa, Artificial Sequence
  Synthetic Peptide
IPEWEFVNTPPLVKL

SEQ ID NO: 9964 - protein, 15 aa, Artificial Sequence
  Synthetic Peptide
WEFVNTPPLVKLWYQ

SEQ ID NO: 9965 - protein, 15 aa, Artificial Sequence
  Synthetic Peptide
EQLIKKEKVYLAWVP

SEQ ID NO: 9966 - protein, 15 aa, Artificial Sequence
  Synthetic Peptide
EKVYLAWVPAHKGIG

SEQ ID NO: 9967 - protein, 15 aa, Artificial Sequence
  Synthetic Peptide
HSNWRAMASDFNLPP

SEQ ID NO: 9968 - protein, 15 aa, Artificial Sequence
  Synthetic Peptide
ASGYIEAEVIPAETG

SEQ ID NO: 9969 - protein, 15 aa, Artificial Sequence
  Synthetic Peptide
AEHLKTAVQMAVFIH

SEQ ID NO: 9970 - protein, 15 aa, Artificial Sequence
  Synthetic Peptide
KTAVQMAVFIHNFKR

SEQ ID NO: 9971 - protein, 15 aa, Artificial Sequence
  Synthetic Peptide
QKQITKIQNFRVYYR

SEQ ID NO: 9972 - protein, 15 aa, Artificial Sequence
  Synthetic Peptide
KLLWKGEGAVVIQDN

SEQ ID NO: 9973 - protein, 15 aa, Artificial Sequence
  Synthetic Peptide
ENRWQVMIVWQVDRM

SEQ ID NO: 9974 - protein, 15 aa, Artificial Sequence
  Synthetic Peptide
VEAIIRILQQLLFIH

SEQ ID NO: 9975 - protein, 15 aa, Artificial Sequence
  Synthetic Peptide
FNVVNSSIGLIMVLS

SEQ ID NO: 9976 - protein, 15 aa, Artificial Sequence
  Synthetic Peptide
MNYYGKQENWYSLKK

SEQ ID NO: 9977 - protein, 15 aa, Artificial Sequence
  Synthetic Peptide
MRKLAILSVSSFLFV

SEQ ID NO: 9978 - protein, 15 aa, Artificial Sequence
  Synthetic Peptide
NSSIGLIMVLSFLFL

SEQ ID NO: 9979 - protein, 15 aa, Artificial Sequence
  Synthetic Peptide
SSVFNVVNSSIGLIM

SEQ ID NO: 9980 - protein, 15 aa, Artificial Sequence
  Synthetic Peptide
MKILSVFFLALFFII

SEQ ID NO: 9981 - protein, 15 aa, Artificial Sequence
  Synthetic Peptide
FILVNLLIFHINGKI

SEQ ID NO: 9982 - protein, 15 aa, Artificial Sequence
  Synthetic Peptide
HILYISFYFILVNLL

SEQ ID NO: 9983 - protein, 15 aa, Artificial Sequence
  Synthetic Peptide
LLIFHINGKIIKNSE

SEQ ID NO: 9984 - protein, 15 aa, Artificial Sequence
  Synthetic Peptide
LVNLLIFHINGKIIK

SEQ ID NO: 9985 - protein, 16 aa, Artificial Sequence
  Synthetic Peptide
NLLIFHYINGKIIKNS

SEQ ID NO: 9986 - protein, 15 aa, Artificial Sequence
  Synthetic Peptide
QTNFKSLLRNLGVSE

SEQ ID NO: 9987 - protein, 15 aa, Artificial Sequence
  Synthetic Peptide
AYKFVVPGAATPYAG

SEQ ID NO: 9988 - protein, 15 aa, Artificial Sequence
  Synthetic Peptide
NVKYLVIVFLIFFDL

SEQ ID NO: 9989 - protein, 15 aa, Artificial Sequence
  Synthetic Peptide
VKNVIGPFMKAVCVE

SEQ ID NO: 9990 - protein, 15 aa, Artificial Sequence
  Synthetic Peptide
WENVKNVIGPFMKAV

SEQ ID NO: 9991 - protein, 15 aa, Artificial Sequence
  Synthetic Peptide
CSVVRRAFPHCLAFS

SEQ ID NO: 9992 - protein, 15 aa, Artificial Sequence
  Synthetic Peptide
FVQWFVGLSPTVWLS

SEQ ID NO: 9993 - protein, 15 aa, Artificial Sequence
  Synthetic Peptide
LAQFTSAICSVVRRA

SEQ ID NO: 9994 - protein, 15 aa, Artificial Sequence
  Synthetic Peptide
LVPFVQWFVGLSPTV

SEQ ID NO: 9995 - protein, 15 aa, Artificial Sequence
  Synthetic Peptide
NLSWLSLDVSAAFYN

SEQ ID NO: 9996 - protein, 15 aa, Artificial Sequence
  Synthetic Peptide
SFGVWIRTPPAYRPP

SEQ ID NO: 9997 - protein, 14 aa, Artificial Sequence
  Synthetic Peptide
SPFLLAQFTSAICV

SEQ ID NO: 9998 - protein, 15 aa, Artificial Sequence
  Synthetic Peptide
SSNLSWLSLDVSAAF

SEQ ID NO: 9999 - protein, 15 aa, Artificial Sequence
  Synthetic Peptide
DKELTMSNVKNVSQT

SEQ ID NO: 10000 - protein, 15 aa, Artificial Sequence
  Synthetic Peptide
AGLLGNVSTVLLGGV

SEQ ID NO: 10001 - protein, 15 aa, Artificial Sequence
  Synthetic Peptide
KSKYKLATSVLAGLL

SEQ ID NO: 10002 - protein, 15 aa, Artificial Sequence
  Synthetic Peptide
GLAYKFVVPGAATPY

SEQ ID NO: 10003 - protein, 15 aa, Artificial Sequence
  Synthetic Peptide
HNWVNHAVPLAMKLI

SEQ ID NO: 10004 - protein, 15 aa, Artificial Sequence
  Synthetic Peptide
IGPFMKAVCVEVEKT

SEQ ID NO: 10005 - protein, 15 aa, Artificial Sequence
  Synthetic Peptide
KYKIAGGIAGGLALL

SEQ ID NO: 10006 - protein, 15 aa, Artificial Sequence
  Synthetic Peptide
RHNWVNHAVPLAMKL

SEQ ID NO: 10007 - protein, 16 aa, Artificial Sequence
  Synthetic Peptide
IKQFINMWQEVGRAMY

SEQ ID NO: 10008 - protein, 15 aa, Artificial Sequence
  Synthetic Peptide
LQSLTNLLSSNLSWL

SEQ ID NO: 10009 - protein, 15 aa, Artificial Sequence
  Synthetic Peptide
PFLLAQFTSAICSVV

SEQ ID NO: 10010 - protein, 15 aa, Artificial Sequence
  Synthetic Peptide
KYKLATSVLAGLLGN

SEQ ID NO: 10011 - protein, 15 aa, Artificial Sequence
  Synthetic Peptide
LAGLLGNVSTVLLGG

SEQ ID NO: 10012 - protein, 15 aa, Artificial Sequence
  Synthetic Peptide
RHPFKIGSSDPADNA

SEQ ID NO: 10013 - protein, 15 aa, Artificial Sequence
  Synthetic Peptide
ANQLVVILTDGIPDS

SEQ ID NO: 10014 - protein, 15 aa, Artificial Sequence
  Synthetic Peptide
KFVVPGAATPYAGEP

SEQ ID NO: 10015 - protein, 15 aa, Artificial Sequence
  Synthetic Peptide
VFNVVNSSIGLIMVL

SEQ ID NO: 10016 - protein, 15 aa, Artificial Sequence
  Synthetic Peptide
VGPLTVNEKRRLKLI

SEQ ID NO: 10017 - protein, 15 aa, Artificial Sequence
  Synthetic Peptide
ESRLVVDFSQFSRGN

SEQ ID NO: 10018 - protein, 15 aa, Artificial Sequence
  Synthetic Peptide
LCQVFADATPTGWGL

SEQ ID NO: 10019 - protein, 15 aa, Artificial Sequence
  Synthetic Peptide
VVVVATDALMTGYTG

SEQ ID NO: 10020 - protein, 15 aa, Artificial Sequence
  Synthetic Peptide
TVDFSLDPTFTIETT

SEQ ID NO: 10021 - protein, 15 aa, Artificial Sequence
  Synthetic Peptide
AETFYVDGAANRETK

SEQ ID NO: 10022 - protein, 15 aa, Artificial Sequence
  Synthetic Peptide
EVNIVTDSQYALGII

SEQ ID NO: 10023 - protein, 15 aa, Artificial Sequence
  Synthetic Peptide
WAGIKQEFGIPYNPQ

SEQ ID NO: 10024 - protein, 15 aa, Artificial Sequence
  Synthetic Peptide
GAVVIQDNSDIKVVP

SEQ ID NO: 10025 - protein, 15 aa, Artificial Sequence
  Synthetic Peptide
YRKILRQRKIDRLID

SEQ ID NO: 10026 - protein, 15 aa, Artificial Sequence
  Synthetic Peptide
PDSIQDSLKESRKLN

SEQ ID NO: 10027 - protein, 15 aa, Artificial Sequence
  Synthetic Peptide
KCNLYADSAWENVKN

SEQ ID NO: 10028 - protein, 15 aa, Artificial Sequence
  Synthetic Peptide
IGTVLVGPTPVNIIG

SEQ ID NO: 10029 - protein, 15 aa, Artificial Sequence
  Synthetic Peptide
KVYLAWVPAHKGIGG

SEQ ID NO: 10030 - protein, 15 aa, Artificial Sequence
  Synthetic Peptide
TKELQKQITKIQNFR

SEQ ID NO: 10031 - protein, 15 aa, Artificial Sequence
  Synthetic Peptide
AGFFLLTRILTIPQS

SEQ ID NO: 10032 - protein, 15 aa, Artificial Sequence
  Synthetic Peptide
GFFLLTRILTIPQSL

SEQ ID NO: 10033 - protein, 15 aa, Artificial Sequence
  Synthetic Peptide
GTSFVYVPSALNPAD

SEQ ID NO: 10034 - protein, 15 aa, Artificial Sequence
  Synthetic Peptide
IIFLFILLLCLIFLL

SEQ ID NO: 10035 - protein, 15 aa, Artificial Sequence
  Synthetic Peptide
KFAVPNLQSLTNLLS

SEQ ID NO: 10036 - protein, 15 aa, Artificial Sequence
  Synthetic Peptide
LHLYSHPIILGFRKI

SEQ ID NO: 10037 - protein, 15 aa, Artificial Sequence
  Synthetic Peptide
LLCLIFLLVLLDYQG

SEQ ID NO: 10038 - protein, 15 aa, Artificial Sequence
  Synthetic Peptide
VGLLGFAAPFTQCGY

SEQ ID NO: 10039 - protein, 15 aa, Artificial Sequence
  Synthetic Peptide
FYFILVNLLIFHING

SEQ ID NO: 10040 - protein, 15 aa, Artificial Sequence
  Synthetic Peptide
KSLLRNLGVSENIFL

SEQ ID NO: 10041 - protein, 15 aa, Artificial Sequence
  Synthetic Peptide
RGYYIPHQSSLPQDN

SEQ ID NO: 10042 - protein, 15 aa, Artificial Sequence
  Synthetic Peptide
VYLLPRRGPRLGVRA

SEQ ID NO: 10043 - protein, 15 aa, Artificial Sequence
  Synthetic Peptide
GHRMAWDMMMNWSPT

SEQ ID NO: 10044 - protein, 15 aa, Artificial Sequence
  Synthetic Peptide
CGPVYCFTPSPVVVG

SEQ ID NO: 10045 - protein, 15 aa, Artificial Sequence
  Synthetic Peptide
VYCFTPSPVVVGTTD

SEQ ID NO: 10046 - protein, 15 aa, Artificial Sequence
  Synthetic Peptide
GNWFGCTWMNSTGFT

SEQ ID NO: 10047 - protein, 16 aa, Artificial Sequence
  Synthetic Peptide
FITTLPALSTGLIHLH

SEQ ID NO: 10048 - protein, 15 aa, Artificial Sequence
  Synthetic Peptide
SKGWRLLAPITAYAQ

SEQ ID NO: 10049 - protein, 15 aa, Artificial Sequence
  Synthetic Peptide
DLYLVTRHADVIPVR

SEQ ID NO: 10050 - protein, 15 aa, Artificial Sequence
  Synthetic Peptide
AQGYKVLVLNPSVAA

SEQ ID NO: 10051 - protein, 20 aa, Artificial Sequence
  Synthetic Peptide
GYKVLVLNPSVAATLGFGAY

SEQ ID NO: 10052 - protein, 15 aa, Artificial Sequence
  Synthetic Peptide
VLVLNPSVAATLGFG

SEQ ID NO: 10053 - protein, 15 aa, Artificial Sequence
  Synthetic Peptide
GARLVVLATATPPGS

SEQ ID NO: 10054 - protein, 15 aa, Artificial Sequence
  Synthetic Peptide
DVVVVATDALMTGYT

SEQ ID NO: 10055 - protein, 15 aa, Artificial Sequence
  Synthetic Peptide
FTGLTHIDAHFLSQT

SEQ ID NO: 10056 - protein, 15 aa, Artificial Sequence
  Synthetic Peptide
YLVAYQATVCARAQA

SEQ ID NO: 10057 - protein, 15 aa, Artificial Sequence
  Synthetic Peptide
LEVVTSTWVLVGGVL

SEQ ID NO: 10058 - protein, 15 aa, Artificial Sequence
  Synthetic Peptide
TWVLVGGVLAALAAY

SEQ ID NO: 10059 - protein, 15 aa, Artificial Sequence
  Synthetic Peptide
AKHMWNFISGIQYLA

SEQ ID NO: 10060 - protein, 15 aa, Artificial Sequence
  Synthetic Peptide
IQYLAGLSTLPGNPA

SEQ ID NO: 10061 - protein, 15 aa, Artificial Sequence
  Synthetic Peptide
MNRLIAFASRGNHVS

SEQ ID NO: 10062 - protein, 15 aa, Artificial Sequence
  Synthetic Peptide
SYTWTGALITPCAAE

SEQ ID NO: 10063 - protein, 15 aa, Artificial Sequence
  Synthetic Peptide
GSSYGFQYSPGQRVE

SEQ ID NO: 10064 - protein, 15 aa, Artificial Sequence
  Synthetic Peptide
LELITSCSSNVSVAH

SEQ ID NO: 10065 - protein, 15 aa, Artificial Sequence
  Synthetic Peptide
ASCLRKLGVPPLRVW

SEQ ID NO: 10066 - protein, 15 aa, Artificial Sequence
  Synthetic Peptide
VGNFTGLYSSTVPVF

SEQ ID NO: 10067 - protein, 15 aa, Artificial Sequence
  Synthetic Peptide
TNFLLSLGIHLNPNK

SEQ ID NO: 10068 - protein, 15 aa, Artificial Sequence
  Synthetic Peptide
KQCFRKLPVNRPIDW

SEQ ID NO: 10069 - protein, 15 aa, Artificial Sequence
  Synthetic Peptide
KQAFTFSPTYKAFLC

SEQ ID NO: 10070 - protein, 15 aa, Artificial Sequence
  Synthetic Peptide
AANWILRGTSFVYVP

SEQ ID NO: 10071 - protein, 15 aa, Artificial Sequence
  Synthetic Peptide
PDRVHFASPLHVAWR

SEQ ID NO: 10072 - protein, 15 aa, Artificial Sequence
  Synthetic Peptide
IRPVVSTQLLLNGSL

SEQ ID NO: 10073 - protein, 15 aa, Artificial Sequence
  Synthetic Peptide
RSELYKYKVVKEIPL

SEQ ID NO: 10074 - protein, 15 aa, Artificial Sequence
  Synthetic Peptide
DRFYKTLRAEQASQE

SEQ ID NO: 10075 - protein, 15 aa, Artificial Sequence
  Synthetic Peptide
KVILVAVHVASGYIE

SEQ ID NO: 10076 - protein, 17 aa, Artificial Sequence
  Synthetic Peptide
LVNLLIFHINGKIIKNS

SEQ ID NO: 10077 - protein, 15 aa, Artificial Sequence
  Synthetic Peptide
RHNWVHAVPLAMKLI

SEQ ID NO: 10078 - protein, 20 aa, Artificial Sequence
  Synthetic Peptide
FPQPQLPYSQPQPFRPQQPY

SEQ ID NO: 10079 - protein, 16 aa, Artificial Sequence
  Synthetic Peptide
IPPYCTIAPFGIFGTN

SEQ ID NO: 10080 - protein, 20 aa, Artificial Sequence
  Synthetic Peptide
LGQQQPFPPQQPYPQPQPFP

SEQ ID NO: 10081 - protein, 20 aa, Artificial Sequence
  Synthetic Peptide
LHQQQKQQQQPSSQVSFQQP

SEQ ID NO: 10082 - protein, 20 aa, Artificial Sequence
  Synthetic Peptide
LLQELCCQHLWQIPEQSQCQ

SEQ ID NO: 10083 - protein, 20 aa, Artificial Sequence
  Synthetic Peptide
LQQHNIAHGRSQVLQQSTYQ

SEQ ID NO: 10084 - protein, 20 aa, Artificial Sequence
  Synthetic Peptide
PQPFRPQQPYPQPQPQYSQP

SEQ ID NO: 10085 - protein, 20 aa, Artificial Sequence
  Synthetic Peptide
PQPQPQYSQPQQPISQQQQQ

SEQ ID NO: 10086 - protein, 20 aa, Artificial Sequence
  Synthetic Peptide
PSSQVSFQQPLQQYPLGQGS

SEQ ID NO: 10087 - protein, 20 aa, Artificial Sequence
  Synthetic Peptide
QFEEIRNLALQTLPAMCNVY

SEQ ID NO: 10088 - protein, 20 aa, Artificial Sequence
  Synthetic Peptide
QGSVQPQQLPQFEEIRNLAL

SEQ ID NO: 10089 - protein, 20 aa, Artificial Sequence
  Synthetic Peptide
QNPSQQQPQEQVPLVQQQQF

SEQ ID NO: 10090 - protein, 20 aa, Artificial Sequence
  Synthetic Peptide
QPYPQPQPFPSQQPYLQLQP

SEQ ID NO: 10091 - protein, 20 aa, Artificial Sequence
  Synthetic Peptide
QQLIFCMDVVLQQHNIAHGR

SEQ ID NO: 10092 - protein, 20 aa, Artificial Sequence
  Synthetic Peptide
QVPLVQQQQFLGQQQPFPPQ

SEQ ID NO: 10093 - protein, 20 aa, Artificial Sequence
  Synthetic Peptide
SQQPYLQLQPFPQPQLPYSQ

SEQ ID NO: 10094 - protein, 20 aa, Artificial Sequence
  Synthetic Peptide
VRVPVPQLQPQNPSQQQPQE

SEQ ID NO: 10095 - protein, 16 aa, Artificial Sequence
  Synthetic Peptide
IRNLALQTLPAMCNVY

SEQ ID NO: 10096 - protein, 12 aa, Artificial Sequence
  Synthetic Peptide
PAPFRPQQPYPQ

SEQ ID NO: 10097 - protein, 20 aa, Artificial Sequence
  Synthetic Peptide
PQPFRPQQPYPQPQPQYSQP

SEQ ID NO: 10098 - protein, 20 aa, Artificial Sequence
  Synthetic Peptide
QFEEIRNLALQTLPAMCNVY

SEQ ID NO: 10099 - protein, 16 aa, Artificial Sequence
  Synthetic Peptide
QFEEIRNLALQTLPAM

SEQ ID NO: 10100 - protein, 14 aa, Artificial Sequence
  Synthetic Peptide
QFLFQQQPFPFPPQ

SEQ ID NO: 10101 - protein, 12 aa, Artificial Sequence
  Synthetic Peptide
QVPLVQQQQFLG

SEQ ID NO: 10102 - protein, 16 aa, Artificial Sequence
  Synthetic Peptide
VQQQQFLGQQQPFPPQ

SEQ ID NO: 10103 - protein, 16 aa, Artificial Sequence
  Synthetic Peptide
AHAAHAAHAAHAAHAA

SEQ ID NO: 10104 - protein, 12 aa, Artificial Sequence
  Synthetic Peptide
CPKYVRSAKLRM

SEQ ID NO: 10105 - protein, 12 aa, Artificial Sequence
  Synthetic Peptide
GACPKYVKQNTL

SEQ ID NO: 10106 - protein, 13 aa, Artificial Sequence
  Synthetic Peptide
GACPKYVKQNTLK

SEQ ID NO: 10107 - protein, 12 aa, Artificial Sequence
  Synthetic Peptide
KQNTLKLATGMR

SEQ ID NO: 10108 - protein, 18 aa, Artificial Sequence
  Synthetic Peptide
LAKQNTLAKQNTLAKQNT

SEQ ID NO: 10109 - protein, 13 aa, Artificial Sequence
  Synthetic Peptide
PKAVKQNTLKLAT

SEQ ID NO: 10110 - protein, 13 aa, Artificial Sequence
  Synthetic Peptide
PKSVKQNTLKLAT

SEQ ID NO: 10111 - protein, 13 aa, Artificial Sequence
  Synthetic Peptide
PKYDKQGGLKIAT

SEQ ID NO: 10112 - protein, 13 aa, Artificial Sequence
  Synthetic Peptide
PKYFKQFRLKIAT

SEQ ID NO: 10113 - protein, 13 aa, Artificial Sequence
  Synthetic Peptide
PKYGKQRFLKIAT

SEQ ID NO: 10114 - protein, 13 aa, Artificial Sequence
  Synthetic Peptide
PKYIKQIILKIAT

SEQ ID NO: 10115 - protein, 13 aa, Artificial Sequence
  Synthetic Peptide
PKYVKKNTLKLAT

SEQ ID NO: 10116 - protein, 13 aa, Artificial Sequence
  Synthetic Peptide
PKYVKQNKLKLAT

SEQ ID NO: 10117 - protein, 13 aa, Artificial Sequence
  Synthetic Peptide
PKYVKQNTKKLAT

SEQ ID NO: 10118 - protein, 13 aa, Artificial Sequence
  Synthetic Peptide
PKYVKQNTLKEAT

SEQ ID NO: 10119 - protein, 13 aa, Artificial Sequence
  Synthetic Peptide
PKYVKQNTLKLAT

SEQ ID NO: 10120 - protein, 13 aa, Artificial Sequence
  Synthetic Peptide
PKYVKQNTLKIAT

SEQ ID NO: 10121 - protein, 13 aa, Artificial Sequence
  Synthetic Peptide
PKYVKQNTLKIAT

SEQ ID NO: 10122 - protein, 13 aa, Artificial Sequence
  Synthetic Peptide
PKYVKQNTIKLAT

SEQ ID NO: 10123 - protein, 13 aa, Artificial Sequence
  Synthetic Peptide
PKYVKQNTLKLAT

SEQ ID NO: 10124 - protein, 13 aa, Artificial Sequence
  Synthetic Peptide
PKYVKQNTLKLAT

SEQ ID NO: 10125 - protein, 13 aa, Artificial Sequence
  Synthetic Peptide
PKYVKQNTLKNAT

SEQ ID NO: 10126 - protein, 13 aa, Artificial Sequence
  Synthetic Peptide
PKYVKQNTNKLAT

SEQ ID NO: 10127 - protein, 20 aa, Artificial Sequence
  Synthetic Peptide
RTLYQNVGTYVSVGTSTLNK

SEQ ID NO: 10128 - protein, 13 aa, Artificial Sequence
  Synthetic Peptide
VKQNTLKLATGMR

SEQ ID NO: 10129 - protein, 14 aa, Artificial Sequence
  Synthetic Peptide
YPKYVKRNTLKLAT

SEQ ID NO: 10130 - protein, 15 aa, Artificial Sequence
  Synthetic Peptide
AAPFTQCGRPALMPL

SEQ ID NO: 10131 - protein, 15 aa, Artificial Sequence
  Synthetic Peptide
AFSYMDDVVLGAKSV

SEQ ID NO: 10132 - protein, 12 aa, Artificial Sequence
  Synthetic Peptide
AILCWGELMTLA

SEQ ID NO: 10133 - protein, 16 aa, Artificial Sequence
  Synthetic Peptide
ALRQAILCWGELMTLA

SEQ ID NO: 10134 - protein, 20 aa, Artificial Sequence
  Synthetic Peptide
ASARFSWLSLLVPFVQWFVG

SEQ ID NO: 10135 - protein, 15 aa, Artificial Sequence
  Synthetic Peptide
DWKVCQRIVGLLGFA

SEQ ID NO: 10136 - protein, 15 aa, Artificial Sequence
  Synthetic Peptide
GAHLSLRGLPVCAFS

SEQ ID NO: 10137 - protein, 20 aa, Artificial Sequence
  Synthetic Peptide
GYRWMCLRRFIIFLFILLLC

SEQ ID NO: 10138 - protein, 19 aa, Artificial Sequence
  Synthetic Peptide
HHTALRQAILCWGELMTLA

SEQ ID NO: 10139 - protein, 15 aa, Artificial Sequence
  Synthetic Peptide
HLSLRGLPVCAFSSA

SEQ ID NO: 10140 - protein, 11 aa, Artificial Sequence
  Synthetic Peptide
ILCWGELMTLA

SEQ ID NO: 10141 - protein, 15 aa, Artificial Sequence
  Synthetic Peptide
IVGLLGFAAPFTQCG

SEQ ID NO: 10142 - protein, 15 aa, Artificial Sequence
  Synthetic Peptide
LCQVFADATPTGWGL

SEQ ID NO: 10143 - protein, 10 aa, Artificial Sequence
  Synthetic Peptide
LCWGELMTLA

SEQ ID NO: 10144 - protein, 15 aa, Artificial Sequence
  Synthetic Peptide
LRQAILCWGELMTLA

SEQ ID NO: 10145 - protein, 20 aa, Artificial Sequence
  Synthetic Peptide
LSPTVWLSVIWMMWYWGPSL

SEQ ID NO: 10146 - protein, 16 aa, Artificial Sequence
  Synthetic Peptide
LSTLPETTVVRRRGRS

SEQ ID NO: 10147 - protein, 19 aa, Artificial Sequence
  Synthetic Peptide
MDIDPYKEFGASVELLSFL

SEQ ID NO: 10148 - protein, 25 aa, Artificial Sequence
  Synthetic Peptide
MDIDPYKEFGASVELLSFLPSDFFP

SEQ ID NO: 10149 - protein, 19 aa, Artificial Sequence
  Synthetic Peptide
MDIDPYKEFGATVELLSFL

SEQ ID NO: 10150 - protein, 20 aa, Artificial Sequence
  Synthetic Peptide
MDIDPYKEFGATVELLSFLP

SEQ ID NO: 10151 - protein, 25 aa, Artificial Sequence
  Synthetic Peptide
MDIDPYKEFGATVELLSFLPSDFFP

SEQ ID NO: 10152 - protein, 25 aa, Artificial Sequence
  Synthetic Peptide
MDIDPYKEFGATVELLSFLPSDFFP

SEQ ID NO: 10153 - protein, 25 aa, Artificial Sequence
  Synthetic Peptide
MDIDPYKEFGATVQLLSFLPSDFFP

SEQ ID NO: 10154 - protein, 15 aa, Artificial Sequence
  Synthetic Peptide
NAPILSTLPETTVVR

SEQ ID NO: 10155 - protein, 18 aa, Artificial Sequence
  Synthetic Peptide
PFLLAQFTSAICSVVRRA

SEQ ID NO: 10156 - protein, 13 aa, Artificial Sequence
  Synthetic Peptide
PHHTALRQAILCW

SEQ ID NO: 10157 - protein, 14 aa, Artificial Sequence
  Synthetic Peptide
PHHTALRQAILCWG

SEQ ID NO: 10158 - protein, 16 aa, Artificial Sequence
  Synthetic Peptide
PHHTALRQAILCWGEL

SEQ ID NO: 10159 - protein, 17 aa, Artificial Sequence
  Synthetic Peptide
PHHTALRQAILSWGELM

SEQ ID NO: 10160 - protein, 18 aa, Artificial Sequence
  Synthetic Peptide
PHHTALRQAILSWGELMT

SEQ ID NO: 10161 - protein, 19 aa, Artificial Sequence
  Synthetic Peptide
PHHTALRQAILCWGELMTL

SEQ ID NO: 10162 - protein, 20 aa, Artificial Sequence
  Synthetic Peptide
PHHTALRQAILCWGELMTLA

SEQ ID NO: 10163 - protein, 15 aa, Artificial Sequence
  Synthetic Peptide
PLPIHTAELLAACFA

SEQ ID NO: 10164 - protein, 15 aa, Artificial Sequence
  Synthetic Peptide
PPAYRPPNAPILSTL

SEQ ID NO: 10165 - protein, 15 aa, Artificial Sequence
  Synthetic Peptide
PQAMQWNSTTFHQTL

SEQ ID NO: 10166 - protein, 15 aa, Artificial Sequence
  Synthetic Peptide
QCGYPALMPLYACIQ

SEQ ID NO: 10167 - protein, 15 aa, Artificial Sequence
  Synthetic Peptide
RDLLDTASALYREAL

SEQ ID NO: 10168 - protein, 21 aa, Artificial Sequence
  Synthetic Peptide
RDLLDTASALYRREALESPEH

SEQ ID NO: 10169 - protein, 20 aa, Artificial Sequence
  Synthetic Peptide
RDLVVSYVNTNMGLKFRQLL

SEQ ID NO: 10170 - protein, 15 aa, Artificial Sequence
  Synthetic Peptide
RFSWLSLLVPFVQWF

SEQ ID NO: 10171 - protein, 14 aa, Artificial Sequence
  Synthetic Peptide
RQAILCWGELMTLA

SEQ ID NO: 10172 - protein, 20 aa, Artificial Sequence
  Synthetic Peptide
SLDSWWTSLNFLGGTTVCLG

SEQ ID NO: 10173 - protein, 15 aa, Artificial Sequence
  Synthetic Peptide
SVRFSWLSLLVPFVQ

SEQ ID NO: 10174 - protein, 17 aa, Artificial Sequence
  Synthetic Peptide
TALRQAILCWGELMTLA

SEQ ID NO: 10175 - protein, 15 aa, Artificial Sequence
  Synthetic Peptide
TNLLSSNLSWLSLDV

SEQ ID NO: 10176 - protein, 15 aa, Artificial Sequence
  Synthetic Peptide
TNMGLKFRQLLWFHI

SEQ ID NO: 10177 - protein, 15 aa, Artificial Sequence
  Synthetic Peptide
TNVGLKFRQLLWFHI

SEQ ID NO: 10178 - protein, 14 aa, Artificial Sequence
  Synthetic Peptide
TTVVRRRGRSPRRR

SEQ ID NO: 10179 - protein, 15 aa, Artificial Sequence
  Synthetic Peptide
VCAFSSAGPCALRFT

SEQ ID NO: 10180 - protein, 20 aa, Artificial Sequence
  Synthetic Peptide
VSFGVWIRTPPAYRPPNAPI

SEQ ID NO: 10181 - protein, 15 aa, Artificial Sequence
  Synthetic Peptide
YPALMPLYACIQSKQ

SEQ ID NO: 10182 - protein, 15 aa, Artificial Sequence
  Synthetic Peptide
AEQFKQKALGLLQTA

SEQ ID NO: 10183 - protein, 15 aa, Artificial Sequence
  Synthetic Peptide
ANLLWRQEMGGNITR

SEQ ID NO: 10184 - protein, 15 aa, Artificial Sequence
  Synthetic Peptide
ARLIVFPDLGVRVCE

SEQ ID NO: 10185 - protein, 15 aa, Artificial Sequence
  Synthetic Peptide
ASQLSAPSLKATCTT

SEQ ID NO: 10186 - protein, 15 aa, Artificial Sequence
  Synthetic Peptide
AVQWMNRLIAFASRG

SEQ ID NO: 10187 - protein, 15 aa, Artificial Sequence
  Synthetic Peptide
DADLIEANLLWRQEM

SEQ ID NO: 10188 - protein, 15 aa, Artificial Sequence
  Synthetic Peptide
EDLVNLLPAILSPGA

SEQ ID NO: 10189 - protein, 15 aa, Artificial Sequence
  Synthetic Peptide
GALVVGVVCAAILRR

SEQ ID NO: 10190 - protein, 15 aa, Artificial Sequence
  Synthetic Peptide
GCSFSIFLLALLSCL

SEQ ID NO: 10191 - protein, 20 aa, Artificial Sequence
  Synthetic Peptide
GPGEGAVQWMNRLIAFASRG

SEQ ID NO: 10192 - protein, 15 aa, Artificial Sequence
  Synthetic Peptide
KPTLHGPTPLLYRLG

SEQ ID NO: 10193 - protein, 15 aa, Artificial Sequence
  Synthetic Peptide
LAGYGAGVAGALVAF

SEQ ID NO: 10194 - protein, 15 aa, Artificial Sequence
  Synthetic Peptide
LHGLSAFSLHSYSPG

SEQ ID NO: 10195 - protein, 20 aa, Artificial Sequence
  Synthetic Peptide
LLFNILGGWVAAQLAAPGAA

SEQ ID NO: 10196 - protein, 15 aa, Artificial Sequence
  Synthetic Peptide
LTSMLTDPSHITAET

SEQ ID NO: 10197 - protein, 20 aa, Artificial Sequence
  Synthetic Peptide
NFISGIQYLAGLSTLPGNPA

SEQ ID NO: 10198 - protein, 16 aa, Artificial Sequence
  Synthetic Peptide
PAILSPGALVVGVVCA

SEQ ID NO: 10199 - protein, 15 aa, Artificial Sequence
  Synthetic Peptide
PQTFQVAHLHAPTGS

SEQ ID NO: 10200 - protein, 15 aa, Artificial Sequence
  Synthetic Peptide
PTLWARMILMTHFFS

SEQ ID NO: 10201 - protein, 15 aa, Artificial Sequence
  Synthetic Peptide
RAAVCTRGVAKAVDF

SEQ ID NO: 10202 - protein, 15 aa, Artificial Sequence
  Synthetic Peptide
TVDFSLDPTFTIETT

SEQ ID NO: 10203 - protein, 15 aa, Artificial Sequence
  Synthetic Peptide
VVLLFLLLADARVCA

SEQ ID NO: 10204 - protein, 15 aa, Artificial Sequence
  Synthetic Peptide
WESVFTGLTHIDAHF

SEQ ID NO: 10205 - protein, 10 aa, Artificial Sequence
  Synthetic Peptide
AFVAWRNRCK

SEQ ID NO: 10206 - protein, 10 aa, Artificial Sequence
  Synthetic Peptide
AWAAWRNRCK

SEQ ID NO: 10207 - protein, 10 aa, Artificial Sequence
  Synthetic Peptide
AWEAWRNRCK

SEQ ID NO: 10208 - protein, 10 aa, Artificial Sequence
  Synthetic Peptide
AWLAWRNRCK

SEQ ID NO: 10209 - protein, 10 aa, Artificial Sequence
  Synthetic Peptide
AWVAARNRCK

SEQ ID NO: 10210 - protein, 10 aa, Artificial Sequence
  Synthetic Peptide
AWVAFRNRCK

SEQ ID NO: 10211 - protein, 10 aa, Artificial Sequence
  Synthetic Peptide
AWVAQRNRCK

SEQ ID NO: 10212 - protein, 10 aa, Artificial Sequence
  Synthetic Peptide
AWVAWANRCK

SEQ ID NO: 10213 - protein, 10 aa, Artificial Sequence
  Synthetic Peptide
AWVAWENRCK

SEQ ID NO: 10214 - protein, 10 aa, Artificial Sequence
  Synthetic Peptide
AWVAWKNRCK

SEQ ID NO: 10215 - protein, 10 aa, Artificial Sequence
  Synthetic Peptide
AWVAWRARCK

SEQ ID NO: 10216 - protein, 10 aa, Artificial Sequence
  Synthetic Peptide
AWVAWRNACK

SEQ ID NO: 10217 - protein, 10 aa, Artificial Sequence
  Synthetic Peptide
AWVAWRNECK

SEQ ID NO: 10218 - protein, 10 aa, Artificial Sequence
  Synthetic Peptide
AWVAWRNKCK

SEQ ID NO: 10219 - protein, 10 aa, Artificial Sequence
  Synthetic Peptide
AWVAWRNRCA

SEQ ID NO: 10220 - protein, 10 aa, Artificial Sequence
  Synthetic Peptide
AWVAWRNRCK

SEQ ID NO: 10221 - protein, 10 aa, Artificial Sequence
  Synthetic Peptide
AWVAWRNRCK

SEQ ID NO: 10222 - protein, 10 aa, Artificial Sequence
  Synthetic Peptide
AWVAWRNRCR

SEQ ID NO: 10223 - protein, 10 aa, Artificial Sequence
  Synthetic Peptide
AWVAWRNREK

SEQ ID NO: 10224 - protein, 10 aa, Artificial Sequence
  Synthetic Peptide
AWVAWRNRKK

SEQ ID NO: 10225 - protein, 10 aa, Artificial Sequence
  Synthetic Peptide
AWVAWRNRQK

SEQ ID NO: 10226 - protein, 10 aa, Artificial Sequence
  Synthetic Peptide
AWVAWRNRVK

SEQ ID NO: 10227 - protein, 10 aa, Artificial Sequence
  Synthetic Peptide
AWVAWRVRCK

SEQ ID NO: 10228 - protein, 10 aa, Artificial Sequence
  Synthetic Peptide
AWVEWRNRCK

SEQ ID NO: 10229 - protein, 10 aa, Artificial Sequence
  Synthetic Peptide
AWVSWRNRCK

SEQ ID NO: 10230 - protein, 10 aa, Artificial Sequence
  Synthetic Peptide
AWVVWRNRCK

SEQ ID NO: 10231 - protein, 10 aa, Artificial Sequence
  Synthetic Peptide
EFVAAKAAQK

SEQ ID NO: 10232 - protein, 10 aa, Artificial Sequence
  Synthetic Peptide
EWVAWRNRCK

SEQ ID NO: 10233 - protein, 22 aa, Artificial Sequence
  Synthetic Peptide
LAAAMKRHGLDNYRGYSLGNWV

SEQ ID NO: 10234 - protein, 16 aa, Artificial Sequence
  Synthetic Peptide
NTDGSTDYGILQINSR

SEQ ID NO: 10235 - protein, 18 aa, Artificial Sequence
  Synthetic Peptide
RNRCKGTDVQAWIRGCRL

SEQ ID NO: 10236 - protein, 16 aa, Artificial Sequence
  Synthetic Peptide
SVNCAKKIVSDGNGMN

SEQ ID NO: 10237 - protein, 10 aa, Artificial Sequence
  Synthetic Peptide
SWVAWRNRCK

SEQ ID NO: 10238 - protein, 10 aa, Artificial Sequence
  Synthetic Peptide
VWVAWRNRCK

SEQ ID NO: 10239 - protein, 15 aa, Artificial Sequence
  Synthetic Peptide
WRNAKWRNAKWRNAK

SEQ ID NO: 10240 - protein, 22 aa, Artificial Sequence
  Synthetic Peptide
YRGYSLGNWVCAAKFESNFNTQ

SEQ ID NO: 10241 - protein, 13 aa, Artificial Sequence
  Synthetic Peptide
SPYVSRLLGICLT

SEQ ID NO: 10242 - protein, 15 aa, Artificial Sequence
  Synthetic Peptide
ASDFNLPPVVAKEIV

SEQ ID NO: 10243 - protein, 15 aa, Artificial Sequence
  Synthetic Peptide
AVQMAVFIHNFKRKG

SEQ ID NO: 10244 - protein, 15 aa, Artificial Sequence
  Synthetic Peptide
DFNLPPVVAKEIVAS

SEQ ID NO: 10245 - protein, 15 aa, Artificial Sequence
  Synthetic Peptide
DQQLLGIWGCSGKLI

SEQ ID NO: 10246 - protein, 15 aa, Artificial Sequence
  Synthetic Peptide
DQSLKPCVKLTPLCV

SEQ ID NO: 10247 - protein, 12 aa, Artificial Sequence
  Synthetic Peptide
DRVHPVHAGPIA

SEQ ID NO: 10248 - protein, 14 aa, Artificial Sequence
  Synthetic Peptide
DRVHPVHAGPIAPG

SEQ ID NO: 10249 - protein, 16 aa, Artificial Sequence
  Synthetic Peptide
DRVHPVHAGPIAPGQM

SEQ ID NO: 10250 - protein, 18 aa, Artificial Sequence
  Synthetic Peptide
DRVHPVHAGPIAPGQMRE

SEQ ID NO: 10251 - protein, 20 aa, Artificial Sequence
  Synthetic Peptide
DRVHPVHAGPIAPGQMREPR

SEQ ID NO: 10252 - protein, 22 aa, Artificial Sequence
  Synthetic Peptide
DRVHPVHAGPIAPGQMREPRGS

SEQ ID NO: 10253 - protein, 20 aa, Artificial Sequence
  Synthetic Peptide
DTEVHNVWATQACVPTDPNP

SEQ ID NO: 10254 - protein, 15 aa, Artificial Sequence
  Synthetic Peptide
EAIIRILQQLLFIHF

SEQ ID NO: 10255 - protein, 15 aa, Artificial Sequence
  Synthetic Peptide
EDIISLWDQSLKPCF

SEQ ID NO: 10256 - protein, 15 aa, Artificial Sequence
  Synthetic Peptide
EKAFSPEVIPMFSAL

SEQ ID NO: 10257 - protein, 15 aa, Artificial Sequence
  Synthetic Peptide
EKVYLAWVPAHKGIG

SEQ ID NO: 10258 - protein, 16 aa, Artificial Sequence
  Synthetic Peptide
ERFAVNPGLLETSEGC

SEQ ID NO: 10259 - protein, 16 aa, Artificial Sequence
  Synthetic Peptide
ERYLKDQQLLGIWGCS

SEQ ID NO: 10260 - protein, 15 aa, Artificial Sequence
  Synthetic Peptide
ESELVSQIIEQLIKK

SEQ ID NO: 10261 - protein, 15 aa, Artificial Sequence
  Synthetic Peptide
ETAYFLLKLAGRWPV

SEQ ID NO: 10262 - protein, 15 aa, Artificial Sequence
  Synthetic Peptide
EVQLGIPHPAGLKKK

SEQ ID NO: 10263 - protein, 15 aa, Artificial Sequence
  Synthetic Peptide
FWEVQLGIPHPAGLK

SEQ ID NO: 10264 - protein, 16 aa, Artificial Sequence
  Synthetic Peptide
GARASVLSGGELDKWE

SEQ ID NO: 10265 - protein, 15 aa, Artificial Sequence
  Synthetic Peptide
GCTLNFPISPIETVP

SEQ ID NO: 10266 - protein, 15 aa, Artificial Sequence
  Synthetic Peptide
GEIYKRWIILGLNKI

SEQ ID NO: 10267 - protein, 16 aa, Artificial Sequence
  Synthetic Peptide
GGELDKWEKIRLRPGG

SEQ ID NO: 10268 - protein, 15 aa, Artificial Sequence
  Synthetic Peptide
HKAIGTVLVGPTPVN

SEQ ID NO: 10269 - protein, 15 aa, Artificial Sequence
  Synthetic Peptide
IGGIGGFIKVRQYDQ

SEQ ID NO: 10270 - protein, 15 aa, Artificial Sequence
  Synthetic Peptide
IIRILQQLLFIHFRI

SEQ ID NO: 10271 - protein, 15 aa, Artificial Sequence
  Synthetic Peptide
IISLWDQSLKPCVKL

SEQ ID NO: 10272 - protein, 16 aa, Artificial Sequence
  Synthetic Peptide
IKVVPRRRKAKIIRDY

SEQ ID NO: 10273 - protein, 16 aa, Artificial Sequence
  Synthetic Peptide
ILKALGPAATLEEMMT

SEQ ID NO: 10274 - protein, 16 aa, Artificial Sequence
  Synthetic Peptide
INEEAAEWERVHPVHA

SEQ ID NO: 10275 - protein, 15 aa, Artificial Sequence
  Synthetic Peptide
IQKLVGKLNWASQIY

SEQ ID NO: 10276 - protein, 15 aa, Artificial Sequence
  Synthetic Peptide
ISLWDQSLKPCVKLT

SEQ ID NO: 10277 - protein, 16 aa, Artificial Sequence
  Synthetic Peptide
IVWASRELERFAVNPG

SEQ ID NO: 10278 - protein, 20 aa, Artificial Sequence
  Synthetic Peptide
IYFKWIILGLNKIVRMYSPB

SEQ ID NO: 10279 - protein, 16 aa, Artificial Sequence
  Synthetic Peptide
IYKRWIILGLNKIVRN

SEQ ID NO: 10280 - protein, 14 aa, Artificial Sequence
  Synthetic Peptide
KARVLEAMSQVTNS

SEQ ID NO: 10281 - protein, 15 aa, Artificial Sequence
  Synthetic Peptide
KDSWTVNDIQKLVGK

SEQ ID NO: 10282 - protein, 16 aa, Artificial Sequence
  Synthetic Peptide
KQIINMWQEVGKAMYA

SEQ ID NO: 10283 - protein, 15 aa, Artificial Sequence
  Synthetic Peptide
KRWIILGLNKIVRMY

SEQ ID NO: 10284 - protein, 15 aa, Artificial Sequence
  Synthetic Peptide
KTILKALGPAATLEE

SEQ ID NO: 10285 - protein, 16 aa, Artificial Sequence
  Synthetic Peptide
LGKIWPSYKGRPGNFL

SEQ ID NO: 10286 - protein, 16 aa, Artificial Sequence
  Synthetic Peptide
LICTTAVPWNASWSNK

SEQ ID NO: 10287 - protein, 16 aa, Artificial Sequence
  Synthetic Peptide
LKQIVKKLREQFGNNK

SEQ ID NO: 10288 - protein, 15 aa, Artificial Sequence
  Synthetic Peptide
LLGIWGCSGKLICTT

SEQ ID NO: 10289 - protein, 15 aa, Artificial Sequence
  Synthetic Peptide
LSIVNRVRQGYSPLS

SEQ ID NO: 10290 - protein, 15 aa, Artificial Sequence
  Synthetic Peptide
NEQVDKLVSAGIRKV

SEQ ID NO: 10291 - protein, 15 aa, Artificial Sequence
  Synthetic Peptide
NNLLRAIEAQQHLLQ

SEQ ID NO: 10292 - protein, 15 aa, Artificial Sequence
  Synthetic Peptide
PAGLKKKKSVTVLDV

SEQ ID NO: 10293 - protein, 15 aa, Artificial Sequence
  Synthetic Peptide
PGNFLQSRPEPTAPP

SEQ ID NO: 10294 - protein, 16 aa, Artificial Sequence
  Synthetic Peptide
PIVQNLQGQMVHQAIS

SEQ ID NO: 10295 - protein, 16 aa, Artificial Sequence
  Synthetic Peptide
PLGVAPTKAKRRVVQR

SEQ ID NO: 10296 - protein, 16 aa, Artificial Sequence
  Synthetic Peptide
QARILAVERYLKDQQL

SEQ ID NO: 10297 - protein, 15 aa, Artificial Sequence
  Synthetic Peptide
QGQMVHQAISPRTLN

SEQ ID NO: 10298 - protein, 16 aa, Artificial Sequence
  Synthetic Peptide
QKQEPIDKELYPLTSL

SEQ ID NO: 10299 - protein, 15 aa, Artificial Sequence
  Synthetic Peptide
QMAVFIHNFKRKGGI

SEQ ID NO: 10300 - protein, 16 aa, Artificial Sequence
  Synthetic Peptide
RIQRGPGRAFVTIGKL

SEQ ID NO: 10301 - protein, 16 aa, Artificial Sequence
  Synthetic Peptide
RQILGQLQPSLQTGSE

SEQ ID NO: 10302 - protein, 16 aa, Artificial Sequence
  Synthetic Peptide
SLKPCVKLTPLCVTLN

SEQ ID NO: 10303 - protein, 16 aa, Artificial Sequence
  Synthetic Peptide
SLWDQSLKPCVKLTPL

SEQ ID NO: 10304 - protein, 15 aa, Artificial Sequence
  Synthetic Peptide
SPAIFQSSMTKILEP

SEQ ID NO: 10305 - protein, 15 aa, Artificial Sequence
  Synthetic Peptide
SPGIWQLDCTHLEGK

SEQ ID NO: 10306 - protein, 15 aa, Artificial Sequence
  Synthetic Peptide
SQIIEQLIKKEKVYL

SEQ ID NO: 10307 - protein, 16 aa, Artificial Sequence
  Synthetic Peptide
SSGGDPEIVMHSFNCG

SEQ ID NO: 10308 - protein, 13 aa, Artificial Sequence
  Synthetic Peptide
TAATNAACAWLEA

SEQ ID NO: 10309 - protein, 17 aa, Artificial Sequence
  Synthetic Peptide
TITLPCRIKQFINMWQE

SEQ ID NO: 10310 - protein, 15 aa, Artificial Sequence
  Synthetic Peptide
VDKLVSAGIRKVLFL

SEQ ID NO: 10311 - protein, 15 aa, Artificial Sequence
  Synthetic Peptide
VIPMFSALSEGATPQ

SEQ ID NO: 10312 - protein, 16 aa, Artificial Sequence
  Synthetic Peptide
VKIEPLGVAPTKAKRR

SEQ ID NO: 10313 - protein, 15 aa, Artificial Sequence
  Synthetic Peptide
VLSIVNRVRQGYSPL

SEQ ID NO: 10314 - protein, 15 aa, Artificial Sequence
  Synthetic Peptide
VNIIGRNLLTQIGCT

SEQ ID NO: 10315 - protein, 15 aa, Artificial Sequence
  Synthetic Peptide
VNIVTDSQYALGIIQ

SEQ ID NO: 10316 - protein, 15 aa, Artificial Sequence
  Synthetic Peptide
VTVYYGVPVWKEATT

SEQ ID NO: 10317 - protein, 20 aa, Artificial Sequence
  Synthetic Peptide
VWGIKQLQARVLAVERYLDK

SEQ ID NO: 10318 - protein, 16 aa, Artificial Sequence
  Synthetic Peptide
WDQSLKPCFKLTPLCV

SEQ ID NO: 10319 - protein, 16 aa, Artificial Sequence
  Synthetic Peptide
WGCSGKLICTTAVPWN

SEQ ID NO: 10320 - protein, 15 aa, Artificial Sequence
  Synthetic Peptide
WRKLVDFRELNKRTQ

SEQ ID NO: 10321 - protein, 20 aa, Artificial Sequence
  Synthetic Peptide
VYVWKTTWGQYWQVLGGPVS

SEQ ID NO: 10322 - protein, 17 aa, Artificial Sequence
  Synthetic Peptide
ALHIYMNGTMSQVQGSA

SEQ ID NO: 10323 - protein, 16 aa, Artificial Sequence
  Synthetic Peptide
WPSVFYNRTCQCSGNF

SEQ ID NO: 10324 - protein, 20 aa, Artificial Sequence
  Synthetic Peptide
YGQMKNGSTPMFNDINIYDL

SEQ ID NO: 10325 - protein, 15 aa, Artificial Sequence
  Synthetic Peptide
DIVIYSKYGGTEIKY

SEQ ID NO: 10326 - protein, 15 aa, Artificial Sequence
  Synthetic Peptide
IKYNGEEYLILSARD

SEQ ID NO: 10327 - protein, 15 aa, Artificial Sequence
  Synthetic Peptide
IYSKYGGTEIKYNGE

SEQ ID NO: 10328 - protein, 15 aa, Artificial Sequence
  Synthetic Peptide
LVIPENAKEKPQEGT

SEQ ID NO: 10329 - protein, 15 aa, Artificial Sequence
  Synthetic Peptide
NGEEYLILSARDVLA

SEQ ID NO: 10330 - protein, 15 aa, Artificial Sequence
  Synthetic Peptide
PSGLVIPENAKEKPQ

SEQ ID NO: 10331 - protein, 15 aa, Artificial Sequence
  Synthetic Peptide
RIPVDVSEGDIVIYS

SEQ ID NO: 10332 - protein, 15 aa, Artificial Sequence
  Synthetic Peptide
SEGDIVIYSKYGGTE

SEQ ID NO: 10333 - protein, 15 aa, Artificial Sequence
  Synthetic Peptide
VAKVKIKPLEDKILV

SEQ ID NO: 10334 - protein, 15 aa, Artificial Sequence
  Synthetic Peptide
VKIKPLEDKILVQAG

SEQ ID NO: 10335 - protein, 15 aa, Artificial Sequence
  Synthetic Peptide
LQLVFGIEVVEVVPI

SEQ ID NO: 10336 - protein, 15 aa, Artificial Sequence
  Synthetic Peptide
PRKLLMQDLVQENYL

SEQ ID NO: 10337 - protein, 15 aa, Artificial Sequence
  Synthetic Peptide
QDFFPVIFSKASEYL

SEQ ID NO: 10338 - protein, 15 aa, Artificial Sequence
  Synthetic Peptide
QLVFGIEVVEVVPIS

SEQ ID NO: 10339 - protein, 15 aa, Artificial Sequence
  Synthetic Peptide
RALIETSYVKVLHHT

SEQ ID NO: 10340 - protein, 15 aa, Artificial Sequence
  Synthetic Peptide
RKLLMQDLVQENYLE

SEQ ID NO: 10341 - protein, 15 aa, Artificial Sequence
  Synthetic Peptide
SHLYILVTCLGLSYD

SEQ ID NO: 10342 - protein, 15 aa, Artificial Sequence
  Synthetic Peptide
YEFLWGPRALIETSY

SEQ ID NO: 10343 - protein, 15 aa, Artificial Sequence
  Synthetic Peptide
GEALGLVGAQAPATE

SEQ ID NO: 10344 - protein, 15 aa, Artificial Sequence
  Synthetic Peptide
FFPVIFSKASSSLQL

SEQ ID NO: 10345 - protein, 15 aa, Artificial Sequence
  Synthetic Peptide
FPVIFSKASSSLQLV

SEQ ID NO: 10346 - protein, 15 aa, Artificial Sequence
  Synthetic Peptide
GIELMEVDPIGHLYI

SEQ ID NO: 10347 - protein, 15 aa, Artificial Sequence
  Synthetic Peptide
QAALSRKVAELVHFL

SEQ ID NO: 10348 - protein, 15 aa, Artificial Sequence
  Synthetic Peptide
QYFFPVIFSKASSSL

SEQ ID NO: 10349 - protein, 15 aa, Artificial Sequence
  Synthetic Peptide
RALVETSYVKVLHHM

SEQ ID NO: 10350 - protein, 15 aa, Artificial Sequence
  Synthetic Peptide
VDPIGHLYIFATCLG

SEQ ID NO: 10351 - protein, 15 aa, Artificial Sequence
  Synthetic Peptide
VFGIELMEVDPIGHL

SEQ ID NO: 10352 - protein, 15 aa, Artificial Sequence
  Synthetic Peptide
VGNWQYFFPVIFSKA

SEQ ID NO: 10353 - protein, 15 aa, Artificial Sequence
  Synthetic Peptide
YEFLWGPRALVETSY

SEQ ID NO: 10354 - protein, 15 aa, Artificial Sequence
  Synthetic Peptide
VGNWQYFFPVIFSKA

SEQ ID NO: 10355 - protein, 25 aa, Artificial Sequence
  Synthetic Peptide
MVKISGGPRISYPLLHESALREGEE

SEQ ID NO: 10356 - protein, 24 aa, Artificial Sequence
  Synthetic Peptide
QVPGSDPACYEFLWGPRALIETSY

SEQ ID NO: 10357 - protein, 15 aa, Artificial Sequence
  Synthetic Peptide
ANPVVHFFKNIVTPR

SEQ ID NO: 10358 - protein, 20 aa, Artificial Sequence
  Synthetic Peptide
ASQKRPSQRHGSKYLATAST

SEQ ID NO: 10359 - protein, 20 aa, Artificial Sequence
  Synthetic Peptide
AYDAQGTLSKIFKLGGRDSR

SEQ ID NO: 10360 - protein, 11 aa, Artificial Sequence
  Synthetic Peptide
DENPVVHFFKN

SEQ ID NO: 10361 - protein, 12 aa, Artificial Sequence
  Synthetic Peptide
DENPVVHFFKNI

SEQ ID NO: 10362 - protein, 13 aa, Artificial Sequence
  Synthetic Peptide
DENPVVHFFKNIV

SEQ ID NO: 10363 - protein, 14 aa, Artificial Sequence
  Synthetic Peptide
DENPVVHFFKNIVT

SEQ ID NO: 10364 - protein, 16 aa, Artificial Sequence
  Synthetic Peptide
DENPVVHFFKNIVTPR

SEQ ID NO: 10365 - protein, 16 aa, Artificial Sequence
  Synthetic Peptide
DENPVVHFFNIVTPRT

SEQ ID NO: 10366 - protein, 19 aa, Artificial Sequence
  Synthetic Peptide
DENPVVHFFKNIVTPRTPP

SEQ ID NO: 10367 - protein, 20 aa, Artificial Sequence
  Synthetic Peptide
DENPVVHFFKNIVTPRTPPY

SEQ ID NO: 10368 - protein, 20 aa, Artificial Sequence
  Synthetic Peptide
DENPVVHFFRNIVTPRTPPY

SEQ ID NO: 10369 - protein, 15 aa, Artificial Sequence
  Synthetic Peptide
EAPVVHFFKNIVTPR

SEQ ID NO: 10370 - protein, 16 aa, Artificial Sequence
  Synthetic Peptide
EANAVVHFFKNIVTPR

SEQ ID NO: 10371 - protein, 15 aa, Artificial Sequence
  Synthetic Peptide
ENPAVHFFKNIVTPR

SEQ ID NO: 10372 - protein, 15 aa, Artificial Sequence
  Synthetic Peptide
ENPKVHFFKNIVTPR

SEQ ID NO: 10373 - protein, 15 aa, Artificial Sequence
  Synthetic Peptide
ENPVAHFFKNIVTPR

SEQ ID NO: 10374 - protein, 15 aa, Artificial Sequence
  Synthetic Peptide
ENPVKHFFKNIVTPR

SEQ ID NO: 10375 - protein, 15 aa, Artificial Sequence
  Synthetic Peptide
ENPVVAFFKNIVTPR

SEQ ID NO: 10376 - protein, 15 aa, Artificial Sequence
  Synthetic Peptide
ENPVVAFFKNIVTPR

SEQ ID NO: 10377 - protein, 15 aa, Artificial Sequence
  Synthetic Peptide
ENPVVAFFKNIVTPR

SEQ ID NO: 10378 - protein, 15 aa, Artificial Sequence
  Synthetic Peptide
ENPVVDFFKNIVTPR

SEQ ID NO: 10379 - protein, 15 aa, Artificial Sequence
  Synthetic Peptide
ENPVVFFFKNIVTPR

SEQ ID NO: 10380 - protein, 14 aa, Artificial Sequence
  Synthetic Peptide
ENPVHAFKNIVTPR

SEQ ID NO: 10381 - protein, 15 aa, Artificial Sequence
  Synthetic Peptide
ENPVVHAFKNIVTPR

SEQ ID NO: 10382 - protein, 15 aa, Artificial Sequence
  Synthetic Peptide
ENPVVHDFKNIVTPR

SEQ ID NO: 10383 - protein, 15 aa, Artificial Sequence
  Synthetic Peptide
ENPVVHFAKNIVTPR

SEQ ID NO: 10384 - protein, 15 aa, Artificial Sequence
  Synthetic Peptide
ENPVVHFAKNIVTPR

SEQ ID NO: 10385 - protein, 15 aa, Artificial Sequence
  Synthetic Peptide
ENPVVHFARNIVTPR

SEQ ID NO: 10386 - protein, 15 aa, Artificial Sequence
  Synthetic Peptide
ENPVVHDFKNIFTPR

SEQ ID NO: 10387 - protein, 15 aa, Artificial Sequence
  Synthetic Peptide
ENPVVHFAKNIVTPR

SEQ ID NO: 10388 - protein, 15 aa, Artificial Sequence
  Synthetic Peptide
ENPVVHFARNIVTPR

SEQ ID NO: 10389 - protein, 15 aa, Artificial Sequence
  Synthetic Peptide
ENPVVHFFANIVTPR

SEQ ID NO: 10390 - protein, 15 aa, Artificial Sequence
  Synthetic Peptide
ENPVVHFFANIVTPR

SEQ ID NO: 10391 - protein, 17 aa, Artificial Sequence
  Synthetic Peptide
ENPVVHFFANIVTPRTP

SEQ ID NO: 10392 - protein, 15 aa, Artificial Sequence
  Synthetic Peptide
ENPVVHFFDNIVTPR

SEQ ID NO: 10393 - protein, 15 aa, Artificial Sequence
  Synthetic Peptide
ENPVVHFFHNIVTPR

SEQ ID NO: 10394 - protein, 15 aa, Artificial Sequence
  Synthetic Peptide
ENPVVHFFKAIVTPR

SEQ ID NO: 10395 - protein, 17 aa, Artificial Sequence
  Synthetic Peptide
ENPVVHFFKAIVTPRTP

SEQ ID NO: 10396 - protein, 14 aa, Artificial Sequence
  Synthetic Peptide
ENPVVHFFKIVTPR

SEQ ID NO: 10397 - protein, 15 aa, Artificial Sequence
  Synthetic Peptide
ENPVVHFFKNAVTPR

SEQ ID NO: 10398 - protein, 16 aa, Artificial Sequence
  Synthetic Peptide
ENPVVHFFNAVTPRTP

SEQ ID NO: 10399 - protein, 15 aa, Artificial Sequence
  Synthetic Peptide
ENPVVHFFKNIATPR

SEQ ID NO: 10400 - protein, 15 aa, Artificial Sequence
  Synthetic Peptide
ENPVVHFFKNIVAPR

SEQ ID NO: 10401 - protein, 17 aa, Artificial Sequence
  Synthetic Peptide
ENPVVHFFKNIVAPRTP

SEQ ID NO: 10402 - protein, 14 aa, Artificial Sequence
  Synthetic Peptide
ENPVVHFFNIVTAR

SEQ ID NO: 10403 - protein, 15 aa, Artificial Sequence
  Synthetic Peptide
ENPVVHFFKNIVTPA

SEQ ID NO: 10404 - protein, 15 aa, Artificial Sequence
  Synthetic Peptide
ENPVVHFFKNIVTPA

SEQ ID NO: 10405 - protein, 15 aa, Artificial Sequence
  Synthetic Peptide
ENPVVHFFKNIVTPR

SEQ ID NO: 10406 - protein, 19 aa, Artificial Sequence
  Synthetic Peptide
ENPVVHFFKNIVTPRTPPY

SEQ ID NO: 10407 - protein, 14 aa, Artificial Sequence
  Synthetic Peptide
ENPVVHFFNKVTPR

SEQ ID NO: 10408 - protein, 15 aa, Artificial Sequence
  Synthetic Peptide
ENPVVHFFLNIVTPR

SEQ ID NO: 10409 - protein, 15 aa, Artificial Sequence
  Synthetic Peptide
ENPVVHFFRNIVTPR

SEQ ID NO: 10410 - protein, 15 aa, Artificial Sequence
  Synthetic Peptide
ENPVVHFKKNIVTPR

SEQ ID NO: 10411 - protein, 15 aa, Artificial Sequence
  Synthetic Peptide
ENPVVHHFKNIVTPR

SEQ ID NO: 10412 - protein, 15 aa, Artificial Sequence
  Synthetic Peptide
ENPVVHHFRNIVTPR

SEQ ID NO: 10413 - protein, 15 aa, Artificial Sequence
  Synthetic Peptide
ENPVVHLFKNIVTPR

SEQ ID NO: 10414 - protein, 15 aa, Artificial Sequence
  Synthetic Peptide
ENPVVHLFRNIVTPR

SEQ ID NO: 10415 - protein, 15 aa, Artificial Sequence
  Synthetic Peptide
ENPVVHWFKNIVTPR

SEQ ID NO: 10416 - protein, 15 aa, Artificial Sequence
  Synthetic Peptide
ENPVVHYFANIVTPR

SEQ ID NO: 10417 - protein, 15 aa, Artificial Sequence
  Synthetic Peptide
ENPVVHYFHNIVTPR

SEQ ID NO: 10418 - protein, 15 aa, Artificial Sequence
  Synthetic Peptide
ENPVVHYFKNIVTPR

SEQ ID NO: 10419 - protein, 15 aa, Artificial Sequence
  Synthetic Peptide
ENPVVHYFLNIVTPR

SEQ ID NO: 10420 - protein, 15 aa, Artificial Sequence
  Synthetic Peptide
ENPVVHYFRNIVTPR

SEQ ID NO: 10421 - protein, 15 aa, Artificial Sequence
  Synthetic Peptide
ENPVVKFFKNIVTPR

SEQ ID NO: 10422 - protein, 16 aa, Artificial Sequence
  Synthetic Peptide
FFKNIVTPFFKNIVTP

SEQ ID NO: 10423 - protein, 20 aa, Artificial Sequence
  Synthetic Peptide
GFGYGGRASDYKSAHKGFKG

SEQ ID NO: 10424 - protein, 14 aa, Artificial Sequence
  Synthetic Peptide
HFFKNIVTPRTPPY

SEQ ID NO: 10425 - protein, 14 aa, Artificial Sequence
  Synthetic Peptide
HFFKNIVTPRTPPY

SEQ ID NO: 10426 - protein, 18 aa, Artificial Sequence
  Synthetic Peptide
IFKLGGRDSRSGSPMARR

SEQ ID NO: 10427 - protein, 12 aa, Artificial Sequence
  Synthetic Peptide
NPVVHFFKNIVT

SEQ ID NO: 10428 - protein, 14 aa, Artificial Sequence
  Synthetic Peptide
NPVVHFFKNIVTPA

SEQ ID NO: 10429 - protein, 14 aa, Artificial Sequence
  Synthetic Peptide
NPVVHFFKNIVTPR

SEQ ID NO: 10430 - protein, 18 aa, Artificial Sequence
  Synthetic Peptide
NPVVHFFKNIVTPRTPPY

SEQ ID NO: 10431 - protein, 11 aa, Artificial Sequence
  Synthetic Peptide
PVVHFFKNIVT

SEQ ID NO: 10432 - protein, 13 aa, Artificial Sequence
  Synthetic Peptide
PVVHFFKNIVTPA

SEQ ID NO: 10433 - protein, 13 aa, Artificial Sequence
  Synthetic Peptide
PVVHFFKNIVTPR

SEQ ID NO: 10434 - protein, 17 aa, Artificial Sequence
  Synthetic Peptide
PVVHFFKNIVTPRTPPY

SEQ ID NO: 10435 - protein, 20 aa, Artificial Sequence
  Synthetic Peptide
QKSHGRTQDENPVVHFFKNI

SEQ ID NO: 10436 - protein, 20 aa, Artificial Sequence
  Synthetic Peptide
RASDYKSAHKGFKGVDAQGT

SEQ ID NO: 10437 - protein, 20 aa, Artificial Sequence
  Synthetic Peptide
RASDYKSAHKGLKGHDAQGT

SEQ ID NO: 10438 - protein, 20 aa, Artificial Sequence
  Synthetic Peptide
RFFSGDRGAPKRGSGKDSHT

SEQ ID NO: 10439 - protein, 20 aa, Artificial Sequence
  Synthetic Peptide
VDAQGTLSKIFKLGGRDSRS

SEQ ID NO: 10440 - protein, 20 aa, Artificial Sequence
  Synthetic Peptide
VDAQGTLSKLFKLGGRDSRS

SEQ ID NO: 10441 - protein, 20 aa, Artificial Sequence
  Synthetic Peptide
VDAQGTLSRIFKLGGRDSRS

SEQ ID NO: 10442 - protein, 20 aa, Artificial Sequence
  Synthetic Peptide
VDAQGTLSRLFKLGGRDSRS

SEQ ID NO: 10443 - protein, 15 aa, Artificial Sequence
  Synthetic Peptide
VHFFKNIVTPRTPPY

SEQ ID NO: 10444 - protein, 16 aa, Artificial Sequence
  Synthetic Peptide
VVHFFKNIVTPRTPPY

SEQ ID NO: 10445 - protein, 20 aa, Artificial Sequence
  Synthetic Peptide
YKSAHKGFKGAYDAQGTLSK

SEQ ID NO: 10446 - protein, 15 aa, Artificial Sequence
  Synthetic Peptide
ASKVTCTYSPALNKM

SEQ ID NO: 10447 - protein, 15 aa, Artificial Sequence
  Synthetic Peptide
APPVAPAPAAPTPAA

SEQ ID NO: 10448 - protein, 15 aa, Artificial Sequence
  Synthetic Peptide
APSWPLSSSVPSQKT

SEQ ID NO: 10449 - protein, 15 aa, Artificial Sequence
  Synthetic Peptide
FCQLAKTCPVQLWVD

SEQ ID NO: 10450 - protein, 15 aa, Artificial Sequence
  Synthetic Peptide
FSDLWKLLPENNVLS

SEQ ID NO: 10451 - protein, 15 aa, Artificial Sequence
  Synthetic Peptide
GTRVRAMAIYKQSQH

SEQ ID NO: 10452 - protein, 15 aa, Artificial Sequence
  Synthetic Peptide
HYNYMCNSSCMGGMN

SEQ ID NO: 10453 - protein, 15 aa, Artificial Sequence
  Synthetic Peptide
LGFLHSGTAKSVTCT

SEQ ID NO: 10454 - protein, 15 aa, Artificial Sequence
  Synthetic Peptide
LSPLPSQAMDDLMLS

SEQ ID NO: 10455 - protein, 15 aa, Artificial Sequence
  Synthetic Peptide
NNVLSPLPSQAMDDL

SEQ ID NO: 10456 - protein, 15 aa, Artificial Sequence
  Synthetic Peptide
RLGFLHSGTAKSVTC

SEQ ID NO: 10457 - protein, 15 aa, Artificial Sequence
  Synthetic Peptide
RNTFRHSVVVPYEPP

SEQ ID NO: 10458 - protein, 15 aa, Artificial Sequence
  Synthetic Peptide
SWPLSSSVPSQKTYQ

SEQ ID NO: 10459 - protein, 15 aa, Artificial Sequence
  Synthetic Peptide
SYGFRLGFLHSGTAK

SEQ ID NO: 10460 - protein, 15 aa, Artificial Sequence
  Synthetic Peptide
WKLLPENNVLSPLPS

SEQ ID NO: 10461 - protein, 15 aa, Artificial Sequence
  Synthetic Peptide
YNYMCNSSCMGGMNR

SEQ ID NO: 10462 - protein, 13 aa, Artificial Sequence
  Synthetic Peptide
AKFVAAWTLKAAA

SEQ ID NO: 10463 - protein, 14 aa, Artificial Sequence
  Synthetic Peptide
YAKFVAAWTLKAAA

SEQ ID NO: 10464 - protein, 15 aa, Artificial Sequence
  Synthetic Peptide
AGGIAGGLALLACAG

SEQ ID NO: 10465 - protein, 15 aa, Artificial Sequence
  Synthetic Peptide
ATSVLAGLLGNVSTV

SEQ ID NO: 10466 - protein, 15 aa, Artificial Sequence
  Synthetic Peptide
AVPLAMKLIQQLNLN

SEQ ID NO: 10467 - protein, 15 aa, Artificial Sequence
  Synthetic Peptide
FLALFFIIFNKESLA

SEQ ID NO: 10468 - protein, 15 aa, Artificial Sequence
  Synthetic Peptide
GRDVQNNIVDEIKYR

SEQ ID NO: 10469 - protein, 15 aa, Artificial Sequence
  Synthetic Peptide
IFHINGKIIKNSEKD

SEQ ID NO: 10470 - protein, 15 aa, Artificial Sequence
  Synthetic Peptide
KHILYISFYFILVNL

SEQ ID NO: 10471 - protein, 15 aa, Artificial Sequence
  Synthetic Peptide
KYLVIVFLIFFDLFL

SEQ ID NO: 10472 - protein, 15 aa, Artificial Sequence
  Synthetic Peptide
LGNVSTVLLGGVGLV

SEQ ID NO: 10473 - protein, 15 aa, Artificial Sequence
  Synthetic Peptide
LIDVHDLISDMIKKE

SEQ ID NO: 10474 - protein, 15 aa, Artificial Sequence
  Synthetic Peptide
LIFFDKFLVNGRDVQ

SEQ ID NO: 10475 - protein, 15 aa, Artificial Sequence
  Synthetic Peptide
LSVFFLALFFIIFNK

SEQ ID NO: 10476 - protein, 20 aa, Artificial Sequence
  Synthetic Peptide
NAREIIRLHSDASKNKEKAL

SEQ ID NO: 10477 - protein, 15 aa, Artificial Sequence
  Synthetic Peptide
NDRINRENANQLVVI

SEQ ID NO: 10478 - protein, 15 aa, Artificial Sequence
  Synthetic Peptide
NHAVPLAMKLIQQLN

SEQ ID NO: 10479 - protein, 15 aa, Artificial Sequence
  Synthetic Peptide
SFYFILVNLLIFHIN

SEQ ID NO: 10480 - protein, 15 aa, Artificial Sequence
  Synthetic Peptide
TVLLGGVGLVLYNTE

SEQ ID NO: 10481 - protein, 15 aa, Artificial Sequence
  Synthetic Peptide
VFFLALFFIIFNKES

SEQ ID NO: 10482 - protein, 15 aa, Artificial Sequence
  Synthetic Peptide
VSTVLLGGVGLVLYN

SEQ ID NO: 10483 - protein, 15 aa, Artificial Sequence
  Synthetic Peptide
VVILTDGIPDSIQDS

SEQ ID NO: 10484 - protein, 20 aa, Artificial Sequence
  Synthetic Peptide
YADSAWENVKNVIGPFMKAV

SEQ ID NO: 10485 - protein, 15 aa, Artificial Sequence
  Synthetic Peptide
YKFVVPGAATPYAGE

SEQ ID NO: 10486 - protein, 15 aa, Artificial Sequence
  Synthetic Peptide
DQSYLQDSDPDSFQD

SEQ ID NO: 10487 - protein, 15 aa, Artificial Sequence
  Synthetic Peptide
DYSFLQDSDPDSFQD

SEQ ID NO: 10488 - protein, 15 aa, Artificial Sequence
  Synthetic Peptide
DYSYFQDSDPDSFQD

SEQ ID NO: 10489 - protein, 15 aa, Artificial Sequence
  Synthetic Peptide
DYSYLQDSDPDSFQD

SEQ ID NO: 10490 - protein, 15 aa, Artificial Sequence
  Synthetic Peptide
DYSYLQDSDPDSFQD

SEQ ID NO: 10491 - protein, 15 aa, Artificial Sequence
  Synthetic Peptide
DYSYLQDSVPDSFQD

SEQ ID NO: 10492 - protein, 15 aa, Artificial Sequence
  Synthetic Peptide
DYSYQQDSDPDSFQD

SEQ ID NO: 10493 - protein, 14 aa, Artificial Sequence
  Synthetic Peptide
NILLSNAPLGPQFP

SEQ ID NO: 10494 - protein, 15 aa, Artificial Sequence
  Synthetic Peptide
QNFLLSNAPLGPQFP

SEQ ID NO: 10495 - protein, 15 aa, Artificial Sequence
  Synthetic Peptide
QNIFLSNAPLGPQFP

SEQ ID NO: 10496 - protein, 15 aa, Artificial Sequence
  Synthetic Peptide
QNILLSNAPLGPQFP

SEQ ID NO: 10497 - protein, 16 aa, Artificial Sequence
  Synthetic Peptide
QNILLSNAPQLGPQFP

SEQ ID NO: 10498 - protein, 15 aa, Artificial Sequence
  Synthetic Peptide
QNILLSNAVLGPQFP

SEQ ID NO: 10499 - protein, 15 aa, Artificial Sequence
  Synthetic Peptide
QNILLSNVPLGPQFP

SEQ ID NO: 10500 - protein, 15 aa, Artificial Sequence [sequence omitted]

SEQ ID NO: 10501 - protein, 15 aa, Artificial Sequence [sequence omitted]

SEQ ID NO: 10502 - protein, 15 aa, Artificial Sequence
  Synthetic Peptide
QNIQLSNAPLGPQFP

SEQ ID NO: 10503 - protein, 15 aa, Artificial Sequence
  Synthetic Peptide
QNIVLSNAPLGPQFP

SEQ ID NO: 10504 - protein, 15 aa, Artificial Sequence
  Synthetic Peptide
QNVLLSNAPLGPQFP

SEQ ID NO: 10505 - protein, 13 aa, Artificial Sequence
  Synthetic Peptide
SYLQDSDPDSFQD

SEQ ID NO: 10506 - protein, 13 aa, Artificial Sequence
  Synthetic Peptide
SYLQDSVPDSFQD

SEQ ID NO: 10507 - protein, 12 aa, Artificial Sequence
  Synthetic Peptide
YLQDSDPDSFQD

SEQ ID NO: 10508 - protein, 14 aa, Artificial Sequence
  Synthetic Peptide
YSYLQDSDPDSFQD

SEQ ID NO: 10509 - protein, 20 aa, Artificial Sequence
  Synthetic Peptide
FPQPQLPYSQPQPFRPQQPY

SEQ ID NO: 10510 - protein, 16 aa, Artificial Sequence
  Synthetic Peptide
IPPYCTIAPFGIFGTN

SEQ ID NO: 10511 - protein, 20 aa, Artificial Sequence
  Synthetic Peptide
LGQQQPFPPQQPYPQPQPFP

SEQ ID NO: 10512 - protein, 20 aa, Artificial Sequence
  Synthetic Peptide
LHQQQKQQQQPSSQVSFQQP

SEQ ID NO: 10513 - protein, 20 aa, Artificial Sequence
  Synthetic Peptide
LLQELCCQHLWQIPEQSQCQ

SEQ ID NO: 10514 - protein, 20 aa, Artificial Sequence
  Synthetic Peptide
LQQHNIAHGRSQVLQQSTYQ

SEQ ID NO: 10515 - protein, 20 aa, Artificial Sequence
  Synthetic Peptide
PQPFRPQQPYPQPQPQYSQP

SEQ ID NO: 10516 - protein, 20 aa, Artificial Sequence
  Synthetic Peptide
PQPQPQYSQPQQPISQQQQQ

SEQ ID NO: 10517 - protein, 20 aa, Artificial Sequence
  Synthetic Peptide
PSSQVSFQQPLQQYPLGQGS

SEQ ID NO: 10518 - protein, 20 aa, Artificial Sequence
  Synthetic Peptide
QFEEIRNLALQTLPAMCNVY

SEQ ID NO: 10519 - protein, 20 aa, Artificial Sequence
  Synthetic Peptide
QGSVQPQQLPQFEEIRNLAL

SEQ ID NO: 10520 - protein, 20 aa, Artificial Sequence
  Synthetic Peptide
QNPSQQQPQEQVPLVQQQQF

SEQ ID NO: 10521 - protein, 20 aa, Artificial Sequence
  Synthetic Peptide
QPYPQPQPFPSQQPYLQLQP

SEQ ID NO: 10522 - protein, 20 aa, Artificial Sequence
  Synthetic Peptide
QQLIFCMDVVLQQHNIAHGR

SEQ ID NO: 10523 - protein, 20 aa, Artificial Sequence
  Synthetic Peptide
QVPLVQQQQFLGQQQPFPPQ

SEQ ID NO: 10524 - protein, 20 aa, Artificial Sequence
  Synthetic Peptide
SQQPYLQLQPFPQPQLPYSQ

SEQ ID NO: 10525 - protein, 20 aa, Artificial Sequence
  Synthetic Peptide
VRVPVPQLQPQNPSQQQPQE

SEQ ID NO: 10526 - protein, 16 aa, Artificial Sequence
  Synthetic Peptide
IRNLALQTLPAMCNVY

SEQ ID NO: 10527 - protein, 12 aa, Artificial Sequence
  Synthetic Peptide
PQPFRPQQPYPQ

SEQ ID NO: 10528 - protein, 16 aa, Artificial Sequence
  Synthetic Peptide
PQPFRPQQPYPQPQPQ

SEQ ID NO: 10529 - protein, 12 aa, Artificial Sequence
  Synthetic Peptide
QFEEIRNLALQT

SEQ ID NO: 10530 - protein, 16 aa, Artificial Sequence
  Synthetic Peptide
QFEEIRNLALQTLPAM

SEQ ID NO: 10531 - protein, 13 aa, Artificial Sequence
  Synthetic Peptide
QFLGQQQPFFPPQ

SEQ ID NO: 10532 - protein, 12 aa, Artificial Sequence
  Synthetic Peptide
QVPLVQQQQFLG

SEQ ID NO: 10533 - protein, 16 aa, Artificial Sequence
  Synthetic Peptide
QVPLVQQQQFLGQQQP

SEQ ID NO: 10534 - protein, 16 aa, Artificial Sequence
  Synthetic Peptide
VQQQQFLGQQQPFPPQ

SEQ ID NO: 10535 - protein, 16 aa, Artificial Sequence
  Synthetic Peptide
AHAAHAAHAAHAAHAA

SEQ ID NO: 10536 - protein, 12 aa, Artificial Sequence
  Synthetic Peptide
CPKYVRSAKLRM

SEQ ID NO: 10537 - protein, 12 aa, Artificial Sequence
  Synthetic Peptide
GACPKYVKQNTL

SEQ ID NO: 10538 - protein, 13 aa, Artificial Sequence
  Synthetic Peptide
GACPKYVKQNTLK

SEQ ID NO: 10539 - protein, 12 aa, Artificial Sequence
  Synthetic Peptide
KQNTLKLATGMR

SEQ ID NO: 10540 - protein, 18 aa, Artificial Sequence
  Synthetic Peptide
LAKQNTLAKQNTLAKQNT

SEQ ID NO: 10541 - protein, 13 aa, Artificial Sequence
  Synthetic Peptide
PKAVKQNTLKLAT

SEQ ID NO: 10542 - protein, 13 aa, Artificial Sequence
  Synthetic Peptide
PKSVKQNTLKLAT

SEQ ID NO: 10543 - protein, 13 aa, Artificial Sequence
  Synthetic Peptide
PKYDKQGGLKIAT

SEQ ID NO: 10544 - protein, 13 aa, Artificial Sequence
  Synthetic Peptide
PKYFKQFRLKIAT

SEQ ID NO: 10545 - protein, 13 aa, Artificial Sequence
  Synthetic Peptide
PKYGKQRFLKIAT

SEQ ID NO: 10546 - protein, 13 aa, Artificial Sequence
  Synthetic Peptide
PKYIKQIILKIAT

SEQ ID NO: 10547 - protein, 13 aa, Artificial Sequence
  Synthetic Peptide
PKYVKKNTLKLAT

SEQ ID NO: 10548 - protein, 13 aa, Artificial Sequence
  Synthetic Peptide
PKYVKQNKLKLAT

SEQ ID NO: 10549 - protein, 13 aa, Artificial Sequence
  Synthetic Peptide
PKYVKQNTKKLAT

SEQ ID NO: 10550 - protein, 13 aa, Artificial Sequence
  Synthetic Peptide
PKYVKQNTLKEAT

SEQ ID NO: 10551 - protein, 13 aa, Artificial Sequence
  Synthetic Peptide
PKYVKQNTLKLAT

SEQ ID NO: 10552 - protein, 13 aa, Artificial Sequence
  Synthetic Peptide
PKYVKQNTLKIAT

SEQ ID NO: 10553 - protein, 13 aa, Artificial Sequence
  Synthetic Peptide
PKYVKQNTLKIAT

SEQ ID NO: 10554 - protein, 13 aa, Artificial Sequence
  Synthetic Peptide
PKYVKQNTIKLAT

SEQ ID NO: 10555 - protein, 13 aa, Artificial Sequence
  Synthetic Peptide
PKYVKQNTLKLAT

SEQ ID NO: 10556 - protein, 13 aa, Artificial Sequence
  Synthetic Peptide
PKYVKQNTLKLAT

SEQ ID NO: 10557 - protein, 13 aa, Artificial Sequence
  Synthetic Peptide
PKYVKQNTLKNAT

SEQ ID NO: 10558 - protein, 13 aa, Artificial Sequence
  Synthetic Peptide
PKYVKQNTNKLAT

SEQ ID NO: 10559 - protein, 20 aa, Artificial Sequence
  Synthetic Peptide
RTLYQNVGTYVSVGTSTLNK

SEQ ID NO: 10560 - protein, 13 aa, Artificial Sequence
  Synthetic Peptide
VKQNTLKLATGMR

SEQ ID NO: 10561 - protein, 14 aa, Artificial Sequence
  Synthetic Peptide
YPKYVKRNTLKLAT

SEQ ID NO: 10562 - protein, 15 aa, Artificial Sequence
  Synthetic Peptide
AAPFTQCGYPALMPL

SEQ ID NO: 10563 - protein, 15 aa, Artificial Sequence
  Synthetic Peptide
AFSYNDDVVLGAKSV

SEQ ID NO: 10564 - protein, 12 aa, Artificial Sequence
  Synthetic Peptide
AILCWGELMTLA

SEQ ID NO: 10565 - protein, 16 aa, Artificial Sequence
  Synthetic Peptide
ALRQAILCWGELMTLA

SEQ ID NO: 10566 - protein, 20 aa, Artificial Sequence
  Synthetic Peptide
ASARFSWLSLLVPFVQWFVQ

SEQ ID NO: 10567 - protein, 15 aa, Artificial Sequence
  Synthetic Peptide
DWKVCQRIVGLLGFA

SEQ ID NO: 10568 - protein, 15 aa, Artificial Sequence
  Synthetic Peptide
GAHLSLRGLPVCAFS

SEQ ID NO: 10569 - protein, 19 aa, Artificial Sequence
  Synthetic Peptide
GYRWMCLRRFHFLFILLLC

SEQ ID NO: 10570 - protein, 19 aa, Artificial Sequence
  Synthetic Peptide
HHTALRQAILCWGELMTLA

SEQ ID NO: 10571 - protein, 15 aa, Artificial Sequence
  Synthetic Peptide
HLSLRGLPVCAFSSA

SEQ ID NO: 10572 - protein, 18 aa, Artificial Sequence
  Synthetic Peptide
HTALRQAILCWGELMTLA

SEQ ID NO: 10573 - protein, 15 aa, Artificial Sequence
  Synthetic Peptide
IVGLLGFAAPFTQCG

SEQ ID NO: 10574 - protein, 15 aa, Artificial Sequence
  Synthetic Peptide
LCQVFADATPTGWGL

SEQ ID NO: 10575 - protein, 10 aa, Artificial Sequence
  Synthetic Peptide
LCWGELMTLA

SEQ ID NO: 10576 - protein, 15 aa, Artificial Sequence
  Synthetic Peptide
LRQAILCWGELMTLA

SEQ ID NO: 10577 - protein, 20 aa, Artificial Sequence
  Synthetic Peptide
LSPTVWLSVIWMMWYWGPSL

SEQ ID NO: 10578 - protein, 16 aa, Artificial Sequence
  Synthetic Peptide
LSTLPETTVVRRRGRS

SEQ ID NO: 10579 - protein, 19 aa, Artificial Sequence
  Synthetic Peptide
MDIDPYKEFGASVELLSFL

SEQ ID NO: 10580 - protein, 23 aa, Artificial Sequence
  Synthetic Peptide
MDIDPYKEFGASVELLSFLPSDE

SEQ ID NO: 10581 - protein, 19 aa, Artificial Sequence
  Synthetic Peptide
MDIDPYKEFGATVELLSFL

SEQ ID NO: 10582 - protein, 20 aa, Artificial Sequence
  Synthetic Peptide
MDIDPYKEFGATVELLSFLP

SEQ ID NO: 10583 - protein, 25 aa, Artificial Sequence
  Synthetic Peptide
MDIDPYKEFGATVELLSFLPSDFFP

SEQ ID NO: 10584 - protein, 25 aa, Artificial Sequence
  Synthetic Peptide
MDIDPYKEFGATVELLSFLPSDFFP

SEQ ID NO: 10585 - protein, 25 aa, Artificial Sequence
  Synthetic Peptide
MDIDPYKEFGATVQLLSFLPSDFFP

SEQ ID NO: 10586 - protein, 15 aa, Artificial Sequence
  Synthetic Peptide
NAPILSTLPETTVVR

SEQ ID NO: 10587 - protein, 18 aa, Artificial Sequence
  Synthetic Peptide
PFLLAQFTSAICSVVRRA

SEQ ID NO: 10588 - protein, 13 aa, Artificial Sequence
  Synthetic Peptide
PHHTALRQAILCW

SEQ ID NO: 10589 - protein, 14 aa, Artificial Sequence
  Synthetic Peptide
PHHTALRQAILCWG

SEQ ID NO: 10590 - protein, 16 aa, Artificial Sequence
  Synthetic Peptide
PHHTALRQAILCWGEL

SEQ ID NO: 10591 - protein, 17 aa, Artificial Sequence
  Synthetic Peptide
PHHTALRQAILCWGELM

SEQ ID NO: 10592 - protein, 18 aa, Artificial Sequence
  Synthetic Peptide
PHHTALRQAILCWGELMT

SEQ ID NO: 10593 - protein, 19 aa, Artificial Sequence
  Synthetic Peptide
PHHTALRQAILCWGELMTL

SEQ ID NO: 10594 - protein, 20 aa, Artificial Sequence
  Synthetic Peptide
PHHTALRQAILCWGELMTLA

SEQ ID NO: 10595 - protein, 15 aa, Artificial Sequence
  Synthetic Peptide
PLPIHTAELLAACFA

SEQ ID NO: 10596 - protein, 15 aa, Artificial Sequence
  Synthetic Peptide
PPAYRPPNAPILSTL

SEQ ID NO: 10597 - protein, 15 aa, Artificial Sequence
  Synthetic Peptide
PQAMQWNSTTFHQTL

SEQ ID NO: 10598 - protein, 13 aa, Artificial Sequence
  Synthetic Peptide
QAILCWGELMTLA

SEQ ID NO: 10599 - protein, 15 aa, Artificial Sequence
  Synthetic Peptide
QCGYPALMPLYACIQ

SEQ ID NO: 10600 - protein, 15 aa, Artificial Sequence
  Synthetic Peptide
RDLLDTASALYREAL

SEQ ID NO: 10601 - protein, 21 aa, Artificial Sequence
  Synthetic Peptide
RDLLDTASALYRREALESPEH

SEQ ID NO: 10602 - protein, 20 aa, Artificial Sequence
  Synthetic Peptide
RDLVVSYVNTNMGLKFRQLL

SEQ ID NO: 10603 - protein, 15 aa, Artificial Sequence
  Synthetic Peptide
FRSWLSLLVPFVQWF

SEQ ID NO: 10604 - protein, 14 aa, Artificial Sequence
  Synthetic Peptide
RQAILCWGELMTLA

SEQ ID NO: 10605 - protein, 20 aa, Artificial Sequence
  Synthetic Peptide
SLDSWWTSLNFLGGTTVCLG

SEQ ID NO: 10606 - protein, 15 aa, Artificial Sequence
  Synthetic Peptide
SVRFSWLSLLVPFVQ

SEQ ID NO: 10607 - protein, 17 aa, Artificial Sequence
  Synthetic Peptide
TALRQAILCWGELMTLA

SEQ ID NO: 10608 - protein, 15 aa, Artificial Sequence
  Synthetic Peptide
TNLLSSNLSWLSLDV

SEQ ID NO: 10609 - protein, 15 aa, Artificial Sequence
  Synthetic Peptide
TNMGLKFRQLLWFHI

SEQ ID NO: 10610 - protein, 15 aa, Artificial Sequence
  Synthetic Peptide
TNVGLKFRQLLWFHK

SEQ ID NO: 10611 - protein, 14 aa, Artificial Sequence
  Synthetic Peptide
TTVVRRRGRSPRRR

SEQ ID NO: 10612 - protein, 15 aa, Artificial Sequence
  Synthetic Peptide
VCAFSSAGPCALRFT

SEQ ID NO: 10613 - protein, 20 aa, Artificial Sequence
  Synthetic Peptide
VSFGVWIRTPPAYRPPNAPI

SEQ ID NO: 10614 - protein, 15 aa, Artificial Sequence
  Synthetic Peptide
YPALMPLYACIQSKQ

SEQ ID NO: 10615 - protein, 15 aa, Artificial Sequence
  Synthetic Peptide
AEQFKQKALGLLQTA

SEQ ID NO: 10616 - protein, 15 aa, Artificial Sequence
  Synthetic Peptide
ANLLWRQEMGGNITR

SEQ ID NO: 10617 - protein, 15 aa, Artificial Sequence
  Synthetic Peptide
ARLIVFPDLGVRVCE

SEQ ID NO: 10618 - protein, 15 aa, Artificial Sequence
  Synthetic Peptide
ASQLSAPSLKITCTT

SEQ ID NO: 10619 - protein, 15 aa, Artificial Sequence
  Synthetic Peptide
AVQWMNRLIAFASRG

SEQ ID NO: 10620 - protein, 15 aa, Artificial Sequence
  Synthetic Peptide
DADLIEANLLWRQEM

SEQ ID NO: 10621 - protein, 15 aa, Artificial Sequence
  Synthetic Peptide
EDLVNLLPAILSPGA

SEQ ID NO: 10622 - protein, 15 aa, Artificial Sequence
  Synthetic Peptide
GALVVGVVCAAILRR

SEQ ID NO: 10623 - protein, 15 aa, Artificial Sequence
  Synthetic Peptide
GCSFSIFLLALLSCL

SEQ ID NO: 10624 - protein, 19 aa, Artificial Sequence
  Synthetic Peptide
GPEGAVQWMNRLIAFASRG

SEQ ID NO: 10625 - protein, 15 aa, Artificial Sequence
  Synthetic Peptide
KPTLHGPTPLLYRLG

SEQ ID NO: 10626 - protein, 15 aa, Artificial Sequence
  Synthetic Peptide
LAGYGAGVATALVAF

SEQ ID NO: 10627 - protein, 15 aa, Artificial Sequence
  Synthetic Peptide
LHGLSAFSLHSYSPG

SEQ ID NO: 10628 - protein, 20 aa, Artificial Sequence
  Synthetic Peptide
LLFNILGGWVAAQLAAPGAA

SEQ ID NO: 10629 - protein, 15 aa, Artificial Sequence
  Synthetic Peptide
LTSMLTDPSHITAET

SEQ ID NO: 10630 - protein, 20 aa, Artificial Sequence
  Synthetic Peptide
NFISGIQYLAGLSTLPGNPA

SEQ ID NO: 10631 - protein, 16 aa, Artificial Sequence
  Synthetic Peptide
PAILSPGALVVGVVCA

SEQ ID NO: 10632 - protein, 15 aa, Artificial Sequence
  Synthetic Peptide
PQTFQVAHLHAPTGS

SEQ ID NO: 10633 - protein, 15 aa, Artificial Sequence
  Synthetic Peptide
PTLWARMILMTHFFS

SEQ ID NO: 10634 - protein, 15 aa, Artificial Sequence
  Synthetic Peptide
RAAVCTRGVAKAVDR

SEQ ID NO: 10635 - protein, 15 aa, Artificial Sequence
  Synthetic Peptide
TVDFSLDPTFTIETT

SEQ ID NO: 10636 - protein, 14 aa, Artificial Sequence
  Synthetic Peptide
VVLFLLLADARVCS

SEQ ID NO: 10637 - protein, 15 aa, Artificial Sequence
  Synthetic Peptide
WESVFTGLTHIDAHF

SEQ ID NO: 10638 - protein, 10 aa, Artificial Sequence
  Synthetic Peptide
AFVAWRNRCK

SEQ ID NO: 10639 - protein, 10 aa, Artificial Sequence
  Synthetic Peptide
AWAAWRNRCK

SEQ ID NO: 10640 - protein, 10 aa, Artificial Sequence
  Synthetic Peptide
AWEAWRNRCK

SEQ ID NO: 10641 - protein, 10 aa, Artificial Sequence
  Synthetic Peptide
AWLAWRNRCK

SEQ ID NO: 10642 - protein, 10 aa, Artificial Sequence
  Synthetic Peptide
AWVAARNRCK

SEQ ID NO: 10643 - protein, 10 aa, Artificial Sequence
  Synthetic Peptide
AWVAFRNRCK

SEQ ID NO: 10644 - protein, 10 aa, Artificial Sequence
  Synthetic Peptide
AWVAQRNRCK

SEQ ID NO: 10645 - protein, 10 aa, Artificial Sequence
  Synthetic Peptide
AWVAWANRDK

SEQ ID NO: 10646 - protein, 10 aa, Artificial Sequence
  Synthetic Peptide
AWVAWENRCK

SEQ ID NO: 10647 - protein, 10 aa, Artificial Sequence
  Synthetic Peptide
AWVAWKNRCK

SEQ ID NO: 10648 - protein, 10 aa, Artificial Sequence
  Synthetic Peptide
AWVAWRARCK

SEQ ID NO: 10649 - protein, 10 aa, Artificial Sequence
  Synthetic Peptide
AWVAWRNACK

SEQ ID NO: 10650 - protein, 10 aa, Artificial Sequence
  Synthetic Peptide
AWVAWRNECK

SEQ ID NO: 10651 - protein, 10 aa, Artificial Sequence
  Synthetic Peptide
AWVAWRNKCK

SEQ ID NO: 10652 - protein, 10 aa, Artificial Sequence
  Synthetic Peptide
AWVAWRNRCA

SEQ ID NO: 10653 - protein, 10 aa, Artificial Sequence
  Synthetic Peptide
AWVAWRNRCK

SEQ ID NO: 10654 - protein, 10 aa, Artificial Sequence
  Synthetic Peptide
AWVAWRNRCK

SEQ ID NO: 10655 - protein, 10 aa, Artificial Sequence
  Synthetic Peptide
AWVAWRNRCR

SEQ ID NO: 10656 - protein, 10 aa, Artificial Sequence
  Synthetic Peptide
AWVAWRNREK

SEQ ID NO: 10657 - protein, 10 aa, Artificial Sequence
  Synthetic Peptide
AWVAWRNRKK

SEQ ID NO: 10658 - protein, 10 aa, Artificial Sequence
  Synthetic Peptide
AWVAWRNRQK

SEQ ID NO: 10659 - protein, 10 aa, Artificial Sequence
  Synthetic Peptide
AWVAWRNRVK

SEQ ID NO: 10660 - protein, 10 aa, Artificial Sequence
  Synthetic Peptide
AWVAWRVRCK

SEQ ID NO: 10661 - protein, 10 aa, Artificial Sequence
  Synthetic Peptide
AWVEWRNRCK

SEQ ID NO: 10662 - protein, 10 aa, Artificial Sequence
  Synthetic Peptide
AWVSWRNRCK

SEQ ID NO: 10663 - protein, 10 aa, Artificial Sequence
  Synthetic Peptide
AWVVWRNRCK

SEQ ID NO: 10664 - protein, 10 aa, Artificial Sequence
  Synthetic Peptide
EFVAAKAAQK

SEQ ID NO: 10665 - protein, 10 aa, Artificial Sequence
  Synthetic Peptide
EWVAWRNRCK

SEQ ID NO: 10666 - protein, 22 aa, Artificial Sequence
  Synthetic Peptide
LAAAMKRHGLDNYRGYSLGNWV

SEQ ID NO: 10667 - protein, 16 aa, Artificial Sequence
  Synthetic Peptide
NTDGSTDYGILQINSR

SEQ ID NO: 10668 - protein, 18 aa, Artificial Sequence
  Synthetic Peptide
RNRCKGTDVQAWIRGCRL

SEQ ID NO: 10669 - protein, 16 aa, Artificial Sequence
  Synthetic Peptide
SVNCAKKIVSDGNGMN

SEQ ID NO: 10670 - protein, 10 aa, Artificial Sequence
  Synthetic Peptide
SWVAWRNRCK

SEQ ID NO: 10671 - protein, 10 aa, Artificial Sequence
  Synthetic Peptide
VWVAWRNRCK

SEQ ID NO: 10672 - protein, 15 aa, Artificial Sequence
  Synthetic Peptide
WRNAKWRNAKWRNAK

SEQ ID NO: 10673 - protein, 22 aa, Artificial Sequence
  Synthetic Peptide
YRGYSLGNWVCAAKFESNFNTQ

SEQ ID NO: 10674 - protein, 13 aa, Artificial Sequence
  Synthetic Peptide
SPYVSRLLGICLT

SEQ ID NO: 10675 - protein, 15 aa, Artificial Sequence
  Synthetic Peptide
ADNFNLPPVVAKEIV

SEQ ID NO: 10676 - protein, 15 aa, Artificial Sequence
  Synthetic Peptide
AVQMAVFIHNFKRKG

SEQ ID NO: 10677 - protein, 15 aa, Artificial Sequence
  Synthetic Peptide
DFNLPPVVAKEIVAS

SEQ ID NO: 10678 - protein, 15 aa, Artificial Sequence
  Synthetic Peptide
DQQLLGIWGCSGKLI

SEQ ID NO: 10679 - protein, 11 aa, Artificial Sequence
  Synthetic Peptide
DQSLKPCVKLT

SEQ ID NO: 10680 - protein, 12 aa, Artificial Sequence
  Synthetic Peptide
DRVHPVHAGPIA

SEQ ID NO: 10681 - protein, 14 aa, Artificial Sequence
  Synthetic Peptide
DRVHPVHAGPIAPG

SEQ ID NO: 10682 - protein, 16 aa, Artificial Sequence
  Synthetic Peptide
DRVHPVHAGPIAPGQM

SEQ ID NO: 10683 - protein, 18 aa, Artificial Sequence
  Synthetic Peptide
DRVHPVHAGPIAPGQMRE

SEQ ID NO: 10684 - protein, 20 aa, Artificial Sequence
  Synthetic Peptide
DRVHPVHAGPIAPGQMREPR

SEQ ID NO: 10685 - protein, 22 aa, Artificial Sequence
  Synthetic Peptide
DRVHPVHAGPIAPGQMREPRGS

SEQ ID NO: 10686 - protein, 20 aa, Artificial Sequence
  Synthetic Peptide
DTEVHNVWATQACVPTDPNP

SEQ ID NO: 10687 - protein, 15 aa, Artificial Sequence
  Synthetic Peptide
EAIIRILQQLLFIHF

SEQ ID NO: 10688 - protein, 15 aa, Artificial Sequence
  Synthetic Peptide
EDIISLWDQSLKPCV

SEQ ID NO: 10689 - protein, 15 aa, Artificial Sequence
  Synthetic Peptide
EKAFSPEVIPMFSAL

SEQ ID NO: 10690 - protein, 15 aa, Artificial Sequence
  Synthetic Peptide
EKVYLAWVPAHKGIG

SEQ ID NO: 10691 - protein, 16 aa, Artificial Sequence
  Synthetic Peptide
ERFAVNPGLLETSEGC

SEQ ID NO: 10692 - protein, 16 aa, Artificial Sequence
  Synthetic Peptide
ERYLKDQQLLGIWGCS

SEQ ID NO: 10693 - protein, 15 aa, Artificial Sequence
  Synthetic Peptide
ESELVSQIIEGLIKK

SEQ ID NO: 10694 - protein, 15 aa, Artificial Sequence
  Synthetic Peptide
ETAYFLLKLAGRWPV

SEQ ID NO: 10695 - protein, 15 aa, Artificial Sequence
  Synthetic Peptide
EVQLGIPHPAGLKKK

SEQ ID NO: 10696 - protein, 15 aa, Artificial Sequence
  Synthetic Peptide
FWEVQLGIPHPAGLK

SEQ ID NO: 10697 - protein, 16 aa, Artificial Sequence
  Synthetic Peptide
GARASVLSGGELDKWE

SEQ ID NO: 10698 - protein, 15 aa, Artificial Sequence
  Synthetic Peptide
GCTLNFPISPIETVP

SEQ ID NO: 10699 - protein, 15 aa, Artificial Sequence
  Synthetic Peptide
GEIYKRWIILGLNKI

SEQ ID NO: 10700 - protein, 16 aa, Artificial Sequence
  Synthetic Peptide
GGELDKWEKIRLRPGG

SEQ ID NO: 10701 - protein, 15 aa, Artificial Sequence
  Synthetic Peptide
HKAIGTVLVGPTPVN

SEQ ID NO: 10702 - protein, 15 aa, Artificial Sequence
  Synthetic Peptide
IGGIGGFIKVRQYDQ

SEQ ID NO: 10703 - protein, 15 aa, Artificial Sequence
  Synthetic Peptide
IIRILQQLLFIHFRI

SEQ ID NO: 10704 - protein, 15 aa, Artificial Sequence
  Synthetic Peptide
IISLWDQSLKPCVKL

SEQ ID NO: 10705 - protein, 15 aa, Artificial Sequence
  Synthetic Peptide
IKVVPRRKAKIIRDY

SEQ ID NO: 10706 - protein, 16 aa, Artificial Sequence
  Synthetic Peptide
ILKALGPAATLEEMMT

SEQ ID NO: 10707 - protein, 16 aa, Artificial Sequence
  Synthetic Peptide
INEEAAEWERVHPVHA

SEQ ID NO: 10708 - protein, 15 aa, Artificial Sequence
  Synthetic Peptide
IQKLVGKLNWASQIY

SEQ ID NO: 10709 - protein, 15 aa, Artificial Sequence
  Synthetic Peptide
ISLWDQSLKPCVKLT

SEQ ID NO: 10710 - protein, 16 aa, Artificial Sequence
  Synthetic Peptide
IVWASRELERFAVNPG

SEQ ID NO: 10711 - protein, 20 aa, Artificial Sequence
  Synthetic Peptide
IYKRWIILGLNKIVRMYSPV

SEQ ID NO: 10712 - protein, 16 aa, Artificial Sequence
  Synthetic Peptide
IYKRWIILGLNKIVRN

SEQ ID NO: 10713 - protein, 15 aa, Artificial Sequence
  Synthetic Peptide
KARVLAEAMSQVTNS

SEQ ID NO: 10714 - protein, 15 aa, Artificial Sequence
  Synthetic Peptide
KDSWTVNDIQKLVGK

SEQ ID NO: 10715 - protein, 16 aa, Artificial Sequence
  Synthetic Peptide
KQIINMWQEVGKAMYA

SEQ ID NO: 10716 - protein, 15 aa, Artificial Sequence
  Synthetic Peptide
KRWIILGLNKIVRMY

SEQ ID NO: 10717 - protein, 15 aa, Artificial Sequence
  Synthetic Peptide
KTILKALGPAATLEE

SEQ ID NO: 10718 - protein, 16 aa, Artificial Sequence
  Synthetic Peptide
LGKIWPSYKGRPGNFL

SEQ ID NO: 10719 - protein, 16 aa, Artificial Sequence
  Synthetic Peptide
LICTTAVPWNASWSNK

SEQ ID NO: 10720 - protein, 16 aa, Artificial Sequence
  Synthetic Peptide
LKQIVKKLREQFGNNK

SEQ ID NO: 10721 - protein, 15 aa, Artificial Sequence
  Synthetic Peptide
LLGIWGCSGKLICTT

SEQ ID NO: 10722 - protein, 15 aa, Artificial Sequence
  Synthetic Peptide
LSIVNRVRQGYSPLS

SEQ ID NO: 10723 - protein, 15 aa, Artificial Sequence
  Synthetic Peptide
NEQVDKLVSAGIRKV

SEQ ID NO: 10724 - protein, 15 aa, Artificial Sequence
  Synthetic Peptide
NNLLRAIEAQQHLLQ

SEQ ID NO: 10725 - protein, 15 aa, Artificial Sequence
  Synthetic Peptide
PAGLKKKKSVTVLDV

SEQ ID NO: 10726 - protein, 15 aa, Artificial Sequence
  Synthetic Peptide
PGNFLQSRPEPTAPP

SEQ ID NO: 10727 - protein, 16 aa, Artificial Sequence
  Synthetic Peptide
PIVQNLQGQMVHQAIS

SEQ ID NO: 10728 - protein, 16 aa, Artificial Sequence
  Synthetic Peptide
PLGVAPTKAKRRVVQR

SEQ ID NO: 10729 - protein, 16 aa, Artificial Sequence
  Synthetic Peptide
QARILAVERYLKDQQL

SEQ ID NO: 10730 - protein, 15 aa, Artificial Sequence
  Synthetic Peptide
QGQMVHQAISPRTLN

SEQ ID NO: 10731 - protein, 16 aa, Artificial Sequence
  Synthetic Peptide
QKQEPIDKELYPLTSL

SEQ ID NO: 10732 - protein, 15 aa, Artificial Sequence
  Synthetic Peptide
QMAVFIHNFKRKGGI

SEQ ID NO: 10733 - protein, 16 aa, Artificial Sequence
  Synthetic Peptide
RIQRGPGRAFVTIGKL

SEQ ID NO: 10734 - protein, 16 aa, Artificial Sequence
  Synthetic Peptide
RQILGQLQPSLQTGSE

SEQ ID NO: 10735 - protein, 16 aa, Artificial Sequence
  Synthetic Peptide
SLIPCVKLTPLCVTLN

SEQ ID NO: 10736 - protein, 16 aa, Artificial Sequence
  Synthetic Peptide
SLWDQSLKPCVKLTPL

SEQ ID NO: 10737 - protein, 15 aa, Artificial Sequence
  Synthetic Peptide
SPAIFQSSMTKILEP

SEQ ID NO: 10738 - protein, 15 aa, Artificial Sequence
  Synthetic Peptide
SPGIWQLDCTHLEGK

SEQ ID NO: 10739 - protein, 15 aa, Artificial Sequence
  Synthetic Peptide
SQIIEQLIKKEKVYL

SEQ ID NO: 10740 - protein, 16 aa, Artificial Sequence
  Synthetic Peptide
SSGGDPEIVMHSFNCG

SEQ ID NO: 10741 - protein, 13 aa, Artificial Sequence
  Synthetic Peptide
TAATNAACAWLEA

SEQ ID NO: 10742 - protein, 17 aa, Artificial Sequence
  Synthetic Peptide
TITLPCRIKQFINMWQE

SEQ ID NO: 10743 - protein, 15 aa, Artificial Sequence
  Synthetic Peptide
VDKLVSAGIRKVLFL

SEQ ID NO: 10744 - protein, 15 aa, Artificial Sequence
  Synthetic Peptide
VIPMFSALWEGATPQ

SEQ ID NO: 10745 - protein, 16 aa, Artificial Sequence
  Synthetic Peptide
VKIEPLGVAPTKAKRR

SEQ ID NO: 10746 - protein, 15 aa, Artificial Sequence
  Synthetic Peptide
VLSIVNRVRQGYSPL

SEQ ID NO: 10747 - protein, 15 aa, Artificial Sequence
  Synthetic Peptide
VNIIGRNLLTQIGCT

SEQ ID NO: 10748 - protein, 15 aa, Artificial Sequence
  Synthetic Peptide
VNIVTDSQYALGIIQ

SEQ ID NO: 10749 - protein, 15 aa, Artificial Sequence
  Synthetic Peptide
VTVYYGVPVWKEATT

SEQ ID NO: 10750 - protein, 20 aa, Artificial Sequence
  Synthetic Peptide
VWFIKQLQARVLAVERYLKD

SEQ ID NO: 10751 - protein, 16 aa, Artificial Sequence
  Synthetic Peptide
WDQSLKPCVKLTPLCV

SEQ ID NO: 10752 - protein, 16 aa, Artificial Sequence
  Synthetic Peptide
WGCSGKLICTTAVPWN

SEQ ID NO: 10753 - protein, 15 aa, Artificial Sequence
  Synthetic Peptide
WRKLVDFRELNKRTQ

SEQ ID NO: 10754 - protein, 20 aa, Artificial Sequence
  Synthetic Peptide
VYVWKTTWGQYWQVLGGPVS

SEQ ID NO: 10755 - protein, 17 aa, Artificial Sequence
  Synthetic Peptide
ALHIYMNGTMSQVQGSA

SEQ ID NO: 10756 - protein, 16 aa, Artificial Sequence
  Synthetic Peptide
WPSVFYNRTCQCSGNF

SEQ ID NO: 10757 - protein, 20 aa, Artificial Sequence
  Synthetic Peptide
YGQMKNGSTPMFNDINIYDL

SEQ ID NO: 10758 - protein, 15 aa, Artificial Sequence
  Synthetic Peptide
DIVIYSKYGGTEIKY

SEQ ID NO: 10759 - protein, 15 aa, Artificial Sequence
  Synthetic Peptide
IKYNGEEYLILSARD

SEQ ID NO: 10760 - protein, 15 aa, Artificial Sequence
  Synthetic Peptide
IYSKYGGTEIKYNGE

SEQ ID NO: 10761 - protein, 15 aa, Artificial Sequence
  Synthetic Peptide
LVIPENAKEKPQEGT

SEQ ID NO: 10762 - protein, 15 aa, Artificial Sequence
  Synthetic Peptide
NGEEYLILSARDVLA

SEQ ID NO: 10763 - protein, 15 aa, Artificial Sequence
  Synthetic Peptide
PSGLVIPENAKEKPQ

SEQ ID NO: 10764 - protein, 15 aa, Artificial Sequence
  Synthetic Peptide
RIPVDVSEGDIVIYS

SEQ ID NO: 10765 - protein, 15 aa, Artificial Sequence
  Synthetic Peptide
SEGDIVIYSKYGGTE

SEQ ID NO: 10766 - protein, 15 aa, Artificial Sequence
  Synthetic Peptide
VAKVKIKPLEDKILV

SEQ ID NO: 10767 - protein, 15 aa, Artificial Sequence
  Synthetic Peptide
VKIKPLEDKILVQAG

SEQ ID NO: 10768 - protein, 15 aa, Artificial Sequence
  Synthetic Peptide
LQLVFGIEVVEVVPI

SEQ ID NO: 10769 - protein, 15 aa, Artificial Sequence
  Synthetic Peptide
PRKLLMQDLVQENYL

SEQ ID NO: 10770 - protein, 15 aa, Artificial Sequence
  Synthetic Peptide
QDFFPVIFSKASEYL

SEQ ID NO: 10771 - protein, 15 aa, Artificial Sequence
  Synthetic Peptide
QLVFGIEVVEVVPIS

SEQ ID NO: 10772 - protein, 15 aa, Artificial Sequence
  Synthetic Peptide
RALIETSYVKVLHHT

SEQ ID NO: 10773 - protein, 15 aa, Artificial Sequence
  Synthetic Peptide
RKLLMQDLVQENYLE

SEQ ID NO: 10774 - protein, 15 aa, Artificial Sequence
  Synthetic Peptide
SHLYILVTCLGLSYD

SEQ ID NO: 10775 - protein, 15 aa, Artificial Sequence
  Synthetic Peptide
YEFLWGPRALIETSY

SEQ ID NO: 10776 - protein, 15 aa, Artificial Sequence
  Synthetic Peptide
GEALGLVGAQAPATE

SEQ ID NO: 10777 - protein, 15 aa, Artificial Sequence
  Synthetic Peptide
FFPVIFSKASSSLQL

SEQ ID NO: 10778 - protein, 15 aa, Artificial Sequence
  Synthetic Peptide
FPVIFSKASSSLQLV

SEQ ID NO: 10779 - protein, 15 aa, Artificial Sequence
  Synthetic Peptide
GIELMEVDPIGHLYI

SEQ ID NO: 10780 - protein, 15 aa, Artificial Sequence
  Synthetic Peptide
QAALSRKVAELVHFL

SEQ ID NO: 10781 - protein, 15 aa, Artificial Sequence
  Synthetic Peptide
QYFFPVIFSKASSSL

SEQ ID NO: 10782 - protein, 15 aa, Artificial Sequence
  Synthetic Peptide
RALVETSYVKVLHHM

SEQ ID NO: 10783 - protein, 15 aa, Artificial Sequence
  Synthetic Peptide
VDPIGHLYIFATCLG

SEQ ID NO: 10784 - protein, 15 aa, Artificial Sequence
  Synthetic Peptide
VFGIELMEVDPIGHL

SEQ ID NO: 10785 - protein, 15 aa, Artificial Sequence
  Synthetic Peptide
VGNWQYFFPVIFSKA

SEQ ID NO: 10786 - protein, 15 aa, Artificial Sequence
  Synthetic Peptide
YEFLWGPRALVETSY

SEQ ID NO: 10787 - protein, 15 aa, Artificial Sequence
  Synthetic Peptide
VGNWQYFFPVIFSKA

SEQ ID NO: 10788 - protein, 25 aa, Artificial Sequence
  Synthetic Peptide
MVKISGGPRISYPLLHEWALREGEE

SEQ ID NO: 10789 - protein, 24 aa, Artificial Sequence
  Synthetic Peptide
QVPGSDPACYEFLWGPRALIETSY

SEQ ID NO: 10790 - protein, 15 aa, Artificial Sequence
  Synthetic Peptide
ANPVVHFFKNIVTPR

SEQ ID NO: 10791 - protein, 20 aa, Artificial Sequence
  Synthetic Peptide
ASQKRPSQRHGSKYLATAST

SEQ ID NO: 10792 - protein, 20 aa, Artificial Sequence
  Synthetic Peptide
AYDAQGTLSKIFKLGGRDSR

SEQ ID NO: 10793 - protein, 11 aa, Artificial Sequence
  Synthetic Peptide
DENPVVHFFKN

SEQ ID NO: 10794 - protein, 12 aa, Artificial Sequence
  Synthetic Peptide
DENPVVHFFKNI

SEQ ID NO: 10795 - protein, 13 aa, Artificial Sequence
  Synthetic Peptide
DENPVVHFFKNIV

SEQ ID NO: 10796 - protein, 14 aa, Artificial Sequence
  Synthetic Peptide
DENPVVHFFKNIVT

SEQ ID NO: 10797 - protein, 16 aa, Artificial Sequence
  Synthetic Peptide
DENPVVHFFKNIVTPR

SEQ ID NO: 10798 - protein, 17 aa, Artificial Sequence
  Synthetic Peptide
DENPVVHFFKNIVTPRT

SEQ ID NO: 10799 - protein, 19 aa, Artificial Sequence
  Synthetic Peptide
DENPVVHFFKNIVTPRTPP

SEQ ID NO: 10800 - protein, 20 aa, Artificial Sequence
  Synthetic Peptide
DENPVVHFFKNIVTPRTPPY

SEQ ID NO: 10801 - protein, 20 aa, Artificial Sequence
  Synthetic Peptide
DENPVVHFFRNIVTPRTPPY

SEQ ID NO: 10802 - protein, 15 aa, Artificial Sequence
  Synthetic Peptide
EAPVVHFFKNIVTPR

SEQ ID NO: 10803 - protein, 15 aa, Artificial Sequence
  Synthetic Peptide
ENAVVHFFKNIVTPR

SEQ ID NO: 10804 - protein, 15 aa, Artificial Sequence
  Synthetic Peptide
ENPAVHFFKNIVTPR

SEQ ID NO: 10805 - protein, 15 aa, Artificial Sequence
  Synthetic Peptide
ENPKVHFFKNIVTPR

SEQ ID NO: 10806 - protein, 15 aa, Artificial Sequence
  Synthetic Peptide
ENPVAHFFKNIVTPR

SEQ ID NO: 10807 - protein, 15 aa, Artificial Sequence
  Synthetic Peptide
ENPVKHFFKNIVTPR

SEQ ID NO: 10808 - protein, 15 aa, Artificial Sequence
  Synthetic Peptide
ENPVVAFFKNIVTPR

SEQ ID NO: 10809 - protein, 15 aa, Artificial Sequence
  Synthetic Peptide
ENPVVAFFKNIVTPR

SEQ ID NO: 10810 - protein, 15 aa, Artificial Sequence
  Synthetic Peptide
ENPVVDFFKNIVTPR

SEQ ID NO: 10811 - protein, 15 aa, Artificial Sequence
  Synthetic Peptide
ENPVVFFFKNIVTPR

SEQ ID NO: 10812 - protein, 15 aa, Artificial Sequence
  Synthetic Peptide
ENPVVHAFKNIVTPR

SEQ ID NO: 10813 - protein, 15 aa, Artificial Sequence
  Synthetic Peptide
ENPVVHAFKNIVTPR

SEQ ID NO: 10814 - protein, 15 aa, Artificial Sequence
  Synthetic Peptide
ENPVVHAFRNIVTPR

SEQ ID NO: 10815 - protein, 15 aa, Artificial Sequence
  Synthetic Peptide
ENPVVHDFKINVTPR

SEQ ID NO: 10816 - protein, 15 aa, Artificial Sequence
  Synthetic Peptide
ENPVVHFAKINVTPR

SEQ ID NO: 10817 - protein, 15 aa, Artificial Sequence
  Synthetic Peptide
ENPVVHFARNIVTPR

SEQ ID NO: 10818 - protein, 15 aa, Artificial Sequence
  Synthetic Peptide
ENPVVHFFANIVTPR

SEQ ID NO: 10819 - protein, 15 aa, Artificial Sequence
  Synthetic Peptide
ENPVVHFFANIVTPR

SEQ ID NO: 10820 - protein, 17 aa, Artificial Sequence
  Synthetic Peptide
ENPVVHFFANIVTPRTP

SEQ ID NO: 10821 - protein, 15 aa, Artificial Sequence
  Synthetic Peptide
ENPVVHFFDNIVTPR

SEQ ID NO: 10822 - protein, 15 aa, Artificial Sequence
  Synthetic Peptide
ENPVVHFFHNIVTPR

SEQ ID NO: 10823 - protein, 15 aa, Artificial Sequence
  Synthetic Peptide
ENPVVHFFKAIVTPR

SEQ ID NO: 10824 - protein, 17 aa, Artificial Sequence
  Synthetic Peptide
ENPVVHFFKAIVTPRTP

SEQ ID NO: 10825 - protein, 15 aa, Artificial Sequence
  Synthetic Peptide
ENPVVHFFKKIVTPR

SEQ ID NO: 10826 - protein, 15 aa, Artificial Sequence
  Synthetic Peptide
ENPVVHFFKNAVTPR

SEQ ID NO: 10827 - protein, 17 aa, Artificial Sequence
  Synthetic Peptide
ENPVVHFFKNAVTPRTP

SEQ ID NO: 10828 - protein, 15 aa, Artificial Sequence
  Synthetic Peptide
ENPVVHFFKNIVTPR

SEQ ID NO: 10829 - protein, 15 aa, Artificial Sequence
  Synthetic Peptide
ENPVVHFFKNIVAPR

SEQ ID NO: 10830 - protein, 17 aa, Artificial Sequence
  Synthetic Peptide
ENPVVHFFKNIVAPRTP

SEQ ID NO: 10831 - protein, 15 aa, Artificial Sequence
  Synthetic Peptide
ENPVVHFFKNIVTAR

SEQ ID NO: 10832 - protein, 15 aa, Artificial Sequence
  Synthetic Peptide
ENPVVHFFKNIVTPA

SEQ ID NO: 10833 - protein, 15 aa, Artificial Sequence
  Synthetic Peptide
ENPVVHFFKNIVTPA

SEQ ID NO: 10834 - protein, 15 aa, Artificial Sequence
  Synthetic Peptide
ENPVVHFFKNIVTPR

SEQ ID NO: 10835 - protein, 17 aa, Artificial Sequence
  Synthetic Peptide
ENPVVHFFKNIVTPRTP

SEQ ID NO: 10836 - protein, 19 aa, Artificial Sequence
  Synthetic Peptide
ENPVVHFFKNIVTPRTPPY

SEQ ID NO: 10837 - protein, 15 aa, Artificial Sequence
  Synthetic Peptide
ENPVVHFFKNKVTPR

SEQ ID NO: 10838 - protein, 15 aa, Artificial Sequence
  Synthetic Peptide
ENPVVHFFLNIVTPR

SEQ ID NO: 10839 - protein, 15 aa, Artificial Sequence
  Synthetic Peptide
ENPVVHFFRNIVTPR

SEQ ID NO: 10840 - protein, 15 aa, Artificial Sequence
  Synthetic Peptide
ENPVVHFKKNIVTPR

SEQ ID NO: 10841 - protein, 15 aa, Artificial Sequence
  Synthetic Peptide
ENPVVHHFKINVTPR

SEQ ID NO: 10842 - protein, 15 aa, Artificial Sequence
  Synthetic Peptide
ENPVVHHFRNIVTPR

SEQ ID NO: 10843 - protein, 15 aa, Artificial Sequence
  Synthetic Peptide
ENPVVHLFKNIVTPR

SEQ ID NO: 10844 - protein, 15 aa, Artificial Sequence
  Synthetic Peptide
ENPVVHLFRNIVTPR

SEQ ID NO: 10845 - protein, 15 aa, Artificial Sequence
  Synthetic Peptide
ENPVVHWFKNIVTPR

SEQ ID NO: 10846 - protein, 15 aa, Artificial Sequence
  Synthetic Peptide
ENPVVHYFANIVTPR

SEQ ID NO: 10847 - protein, 15 aa, Artificial Sequence
  Synthetic Peptide
ENPVVHYFHNIVTPR

SEQ ID NO: 10848 - protein, 15 aa, Artificial Sequence
  Synthetic Peptide
ENPVVHYFKNIVTPR

SEQ ID NO: 10849 - protein, 15 aa, Artificial Sequence
  Synthetic Peptide
ENPVVHYFLNIVTPR

SEQ ID NO: 10850 - protein, 15 aa, Artificial Sequence
  Synthetic Peptide
ENPVVHYFRNIVTPR

SEQ ID NO: 10851 - protein, 15 aa, Artificial Sequence
  Synthetic Peptide
ENPVVKFFKNIVTPR

SEQ ID NO: 10852 - protein, 16 aa, Artificial Sequence
  Synthetic Peptide
FFKNIVTPFFKNIVTP

SEQ ID NO: 10853 - protein, 20 aa, Artificial Sequence
  Synthetic Peptide
GFGYGGRASDWKSAHKGFKG

SEQ ID NO: 10854 - protein, 14 aa, Artificial Sequence
  Synthetic Peptide
HFFKNIVTPRTPPY

SEQ ID NO: 10855 - protein, 14 aa, Artificial Sequence
  Synthetic Peptide
HFFKNIVTPRTPPY

SEQ ID NO: 10856 - protein, 18 aa, Artificial Sequence
  Synthetic Peptide
IFKLGGRDSRSGSPMARR

SEQ ID NO: 10857 - protein, 12 aa, Artificial Sequence
  Synthetic Peptide
NPVVHFFKNIVT

SEQ ID NO: 10858 - protein, 14 aa, Artificial Sequence
  Synthetic Peptide
NPVVHFFKNIVTPA

SEQ ID NO: 10859 - protein, 14 aa, Artificial Sequence
  Synthetic Peptide
NPVVHFFKNIVTPR

SEQ ID NO: 10860 - protein, 18 aa, Artificial Sequence
  Synthetic Peptide
NPVVHFFKNIVTPRTPPY

SEQ ID NO: 10861 - protein, 11 aa, Artificial Sequence
  Synthetic Peptide
PVVHFFKNIVT

SEQ ID NO: 10862 - protein, 13 aa, Artificial Sequence
  Synthetic Peptide
PVVHFFKNIVTPA

SEQ ID NO: 10863 - protein, 13 aa, Artificial Sequence
  Synthetic Peptide
PVVHFFKNIVTPR

SEQ ID NO: 10864 - protein, 17 aa, Artificial Sequence
  Synthetic Peptide
PVVHFFKNIVTPRTPPY

SEQ ID NO: 10865 - protein, 20 aa, Artificial Sequence
  Synthetic Peptide
QKSHGRTQDENPVVHFFKNI

SEQ ID NO: 10866 - protein, 20 aa, Artificial Sequence
  Synthetic Peptide
RASDYKSAHKGFKGVDAQGT

SEQ ID NO: 10867 - protein, 20 aa, Artificial Sequence
  Synthetic Peptide
RASDYKSAHKGLKGHDAQGT

SEQ ID NO: 10868 - protein, 20 aa, Artificial Sequence
  Synthetic Peptide
RFFSGDRGAPKRGSGKDSHT

SEQ ID NO: 10869 - protein, 20 aa, Artificial Sequence
  Synthetic Peptide
VDAQGTLSKIFKLGGRDSRS

SEQ ID NO: 10870 - protein, 20 aa, Artificial Sequence
  Synthetic Peptide
VDAQGTLSKLFKLGGRDSRS

SEQ ID NO: 10871 - protein, 19 aa, Artificial Sequence
  Synthetic Peptide
VDAQGTSRIFKLGGRDSRS

SEQ ID NO: 10872 - protein, 20 aa, Artificial Sequence
  Synthetic Peptide
VDAQGTLSRLFKLGGRDSRS

SEQ ID NO: 10873 - protein, 15 aa, Artificial Sequence
  Synthetic Peptide
VHFFKNIVTPRTPPY

SEQ ID NO: 10874 - protein, 16 aa, Artificial Sequence
  Synthetic Peptide
VVHFFKNIVTPRTPPY

SEQ ID NO: 10875 - protein, 20 aa, Artificial Sequence
  Synthetic Peptide
YKSAHKGFKTAYDAQGTLSK

SEQ ID NO: 10876 - protein, 15 aa, Artificial Sequence
  Synthetic Peptide
AKSVTCTYSPALNKM

SEQ ID NO: 10877 - protein, 15 aa, Artificial Sequence
  Synthetic Peptide
APPVAPAPAAPTPAA

SEQ ID NO: 10878 - protein, 15 aa, Artificial Sequence
  Synthetic Peptide
APSWPLSSSVPSQKT

SEQ ID NO: 10879 - protein, 15 aa, Artificial Sequence
  Synthetic Peptide
FCQLAKTCPVQLWVD

SEQ ID NO: 10880 - protein, 15 aa, Artificial Sequence
  Synthetic Peptide
FSDLWKLLPENNVLS

SEQ ID NO: 10881 - protein, 15 aa, Artificial Sequence
  Synthetic Peptide
GTRVRAMAIYKQSQH

SEQ ID NO: 10882 - protein, 15 aa, Artificial Sequence
  Synthetic Peptide
HYNYMCNSSCMGGMN

SEQ ID NO: 10883 - protein, 15 aa, Artificial Sequence
  Synthetic Peptide
LGFLHSGTAKSBTCT

SEQ ID NO: 10884 - protein, 15 aa, Artificial Sequence
  Synthetic Peptide
LSPLPSQAMDDLMLS

SEQ ID NO: 10885 - protein, 16 aa, Artificial Sequence
  Synthetic Peptide
MMNVLSPLPSQAMDDL

SEQ ID NO: 10886 - protein, 15 aa, Artificial Sequence
  Synthetic Peptide
RLGFLHSBTAKSVTC

SEQ ID NO: 10887 - protein, 15 aa, Artificial Sequence
  Synthetic Peptide
TNTFRHSVVVPYEPP

SEQ ID NO: 10888 - protein, 15 aa, Artificial Sequence
  Synthetic Peptide
SWPLSSSVPSQKTYQ

SEQ ID NO: 10889 - protein, 15 aa, Artificial Sequence
  Synthetic Peptide
SYGFRLGFLHSGTAK

SEQ ID NO: 10890 - protein, 15 aa, Artificial Sequence
  Synthetic Peptide
WKLLPENNVLSPLPS

SEQ ID NO: 10891 - protein, 15 aa, Artificial Sequence
  Synthetic Peptide
YNYMCNSSCMGGMNR

SEQ ID NO: 10892 - protein, 13 aa, Artificial Sequence
  Synthetic Peptide
AKFVAAWTLKAAA

SEQ ID NO: 10893 - protein, 14 aa, Artificial Sequence
  Synthetic Peptide
YAKFVAAWTLKAAA

SEQ ID NO: 10894 - protein, 15 aa, Artificial Sequence
  Synthetic Peptide
AGGIAGGLALLACAG

SEQ ID NO: 10895 - protein, 15 aa, Artificial Sequence
  Synthetic Peptide
ATSVLAGLLGNVSTV

SEQ ID NO: 10896 - protein, 15 aa, Artificial Sequence
  Synthetic Peptide
AVPLAMKLIQQLNLN

SEQ ID NO: 10897 - protein, 15 aa, Artificial Sequence
  Synthetic Peptide
FLALFFIIFNKESLA

SEQ ID NO: 10898 - protein, 15 aa, Artificial Sequence
  Synthetic Peptide
GRDVQNNIVDEIKYR

SEQ ID NO: 10899 - protein, 15 aa, Artificial Sequence
  Synthetic Peptide
IFHINGKIIKNSEKD

SEQ ID NO: 10900 - protein, 15 aa, Artificial Sequence
  Synthetic Peptide
KHILYISFYFILVNL

SEQ ID NO: 10901 - protein, 15 aa, Artificial Sequence
  Synthetic Peptide
KYLVIVFLIFFDLFL

SEQ ID NO: 10902 - protein, 15 aa, Artificial Sequence
  Synthetic Peptide
LGNVSTVLLGGVGLV

SEQ ID NO: 10903 - protein, 15 aa, Artificial Sequence
  Synthetic Peptide
LIDVHDLISDMIKKE

SEQ ID NO: 10904 - protein, 15 aa, Artificial Sequence
  Synthetic Peptide
LIFFDLFLVNGRDVQ

SEQ ID NO: 10905 - protein, 16 aa, Artificial Sequence
  Synthetic Peptide
LSVFFLALFFIIFFNK

SEQ ID NO: 10906 - protein, 20 aa, Artificial Sequence
  Synthetic Peptide
NAREIIRLHSDASKNKEKAL

SEQ ID NO: 10907 - protein, 15 aa, Artificial Sequence
  Synthetic Peptide
NDRINRENANQLVVI

SEQ ID NO: 10908 - protein, 15 aa, Artificial Sequence
  Synthetic Peptide
NHAVPLAMKLIQQLN

SEQ ID NO: 10909 - protein, 15 aa, Artificial Sequence
  Synthetic Peptide
SFYFILVNLLIFHIN

SEQ ID NO: 10910 - protein, 15 aa, Artificial Sequence
  Synthetic Peptide
TVLLGGVGLVLYNTE

SEQ ID NO: 10911 - protein, 15 aa, Artificial Sequence
  Synthetic Peptide
VFFLALFFIIFNKES

SEQ ID NO: 10912 - protein, 16 aa, Artificial Sequence
  Synthetic Peptide
VTSTVLLGGVGLVLYN

SEQ ID NO: 10913 - protein, 15 aa, Artificial Sequence
  Synthetic Peptide
VVILTDGIPDSIQDS

SEQ ID NO: 10914 - protein, 20 aa, Artificial Sequence
  Synthetic Peptide
YADSAWENVKNVIGPFMKAV

SEQ ID NO: 10915 - protein, 15 aa, Artificial Sequence
  Synthetic Peptide
YKFVVPGAATPYAGE

SEQ ID NO: 10916 - protein, 15 aa, Artificial Sequence
  Synthetic Peptide
DQSYLQDSDPDSFQD

SEQ ID NO: 10917 - protein, 15 aa, Artificial Sequence
  Synthetic Peptide
DYSFLQDSDPDSFQD

SEQ ID NO: 10918 - protein, 15 aa, Artificial Sequence
  Synthetic Peptide
DYSYFQDSDPDSFQD

SEQ ID NO: 10919 - protein, 15 aa, Artificial Sequence
  Synthetic Peptide
DYSYLQDSDPDSFQD

SEQ ID NO: 10920 - protein, 15 aa, Artificial Sequence
  Synthetic Peptide
DYSYLQDSDPDSFQD

SEQ ID NO: 10921 - protein, 15 aa, Artificial Sequence
  Synthetic Peptide
DYSYLQDSVPDSFQD

SEQ ID NO: 10922 - protein, 15 aa, Artificial Sequence
  Synthetic Peptide
DYSYQQDSDPDSFQD

SEQ ID NO: 10923 - protein, 14 aa, Artificial Sequence
  Synthetic Peptide
NILLSNAPLGPQFP

SEQ ID NO: 10924 - protein, 15 aa, Artificial Sequence
  Synthetic Peptide
QNFLLSNAPLGPQFP

SEQ ID NO: 10925 - protein, 15 aa, Artificial Sequence
  Synthetic Peptide
QNIFLSNAPLGPQFP

SEQ ID NO: 10926 - protein, 15 aa, Artificial Sequence
  Synthetic Peptide
QNILLSNAPLGPQFP

SEQ ID NO: 10927 - protein, 15 aa, Artificial Sequence
  Synthetic Peptide
QNILLSNAQLGPQFP

SEQ ID NO: 10928 - protein, 15 aa, Artificial Sequence
  Synthetic Peptide
QNILLSNAVLGPQFP

SEQ ID NO: 10929 - protein, 15 aa, Artificial Sequence
  Synthetic Peptide
QNILLSNVPLGPQFP

SEQ ID NO: 10930 - protein, 15 aa, Artificial Sequence [sequence omitted]

SEQ ID NO: 10931 - protein, 15 aa, Artificial Sequence [sequence omitted]

SEQ ID NO: 10932 - protein, 15 aa, Artificial Sequence
  Synthetic Peptide
QNIQLSNAPLGPQFP

SEQ ID NO: 10933 - protein, 15 aa, Artificial Sequence
  Synthetic Peptide
QNIVLSNAPLGPQFP

SEQ ID NO: 10934 - protein, 15 aa, Artificial Sequence
  Synthetic Peptide
QNVLLSNAPLGPQFP

SEQ ID NO: 10935 - protein, 13 aa, Artificial Sequence
  Synthetic Peptide
SYLQDSDPDSFQD

SEQ ID NO: 10936 - protein, 13 aa, Artificial Sequence
  Synthetic Peptide
SYLQDSVPDSFQD

SEQ ID NO: 10937 - protein, 12 aa, Artificial Sequence
  Synthetic Peptide
YLQDSDPDSFQD

SEQ ID NO: 10938 - protein, 14 aa, Artificial Sequence
  Synthetic Peptide
YSYLQDSDPDSFQD

SEQ ID NO: 10939 - protein, 15 aa, Artificial Sequence
  Synthetic Peptide
MWDLVLSIALSVGCT

SEQ ID NO: 10940 - protein, 15 aa, Artificial Sequence
  Synthetic Peptide
DLVLSIALSVGCTGA

SEQ ID NO: 10941 - protein, 15 aa, Artificial Sequence
  Synthetic Peptide
HPQWVLTAAHCLKKN

SEQ ID NO: 10942 - protein, 15 aa, Artificial Sequence
  Synthetic Peptide
QWVLTAAHCLKKNSQ

SEQ ID NO: 10943 - protein, 15 aa, Artificial Sequence
  Synthetic Peptide
GQRVPVSHSFPHPLY

SEQ ID NO: 10944 - protein, 15 aa, Artificial Sequence
  Synthetic Peptide
RVPVSHSFPHPLYNM

SEQ ID NO: 10945 - protein, 15 aa, Artificial Sequence
  Synthetic Peptide
HPLYNMSLLKHQSLR

SEQ ID NO: 10946 - protein, 15 aa, Artificial Sequence
  Synthetic Peptide
SHDLMLLRLSEPAKI

SEQ ID NO: 10947 - protein, 15 aa, Artificial Sequence
  Synthetic Peptide
HDLMLLRLSEPAKIT

SEQ ID NO: 10948 - protein, 15 aa, Artificial Sequence
  Synthetic Peptide
NGVLQGITSWGPEPC

SEQ ID NO: 10949 - protein, 15 aa, Artificial Sequence
  Synthetic Peptide
KPAVYTKVVHYRKWI

SEQ ID NO: 10950 - protein, 15 aa, Artificial Sequence
  Synthetic Peptide
AAPLLLARAASLSLG

SEQ ID NO: 10951 - protein, 15 aa, Artificial Sequence
  Synthetic Peptide
APLLLARAASLSLGF

SEQ ID NO: 10952 - protein, 15 aa, Artificial Sequence
  Synthetic Peptide
PLLLARAASLSLGFL

SEQ ID NO: 10953 - protein, 15 aa, Artificial Sequence
  Synthetic Peptide
SLSLGFLFLLFFWLD

SEQ ID NO: 10954 - protein, 15 aa, Artificial Sequence
  Synthetic Peptide
LLFFWLDRSVLAKEL

SEQ ID NO: 10955 - protein, 15 aa, Artificial Sequence
  Synthetic Peptide
DRSVLAKELKFVTLV

SEQ ID NO: 10956 - protein, 15 aa, Artificial Sequence
  Synthetic Peptide
AKELKFVTLVFRHGD

SEQ ID NO: 10957 - protein, 15 aa, Artificial Sequence
  Synthetic Peptide
DRTLMSAMTNLAALF

SEQ ID NO: 10958 - protein, 14 aa, Artificial Sequence
  Synthetic Peptide
MSMTNLAALFPPEG

SEQ ID NO: 10959 - protein, 15 aa, Artificial Sequence
  Synthetic Peptide
MTNLAALFPPEGVSI

SEQ ID NO: 10960 - protein, 15 aa, Artificial Sequence
  Synthetic Peptide
PEGVSIWNPILLWQP

SEQ ID NO: 10961 - protein, 15 aa, Artificial Sequence
  Synthetic Peptide
GVSIWNPILLWQPIP

SEQ ID NO: 10962 - protein, 15 aa, Artificial Sequence
  Synthetic Peptide
WNPILLWQPIPVHTV

SEQ ID NO: 10963 - protein, 15 aa, Artificial Sequence
  Synthetic Peptide
NPILLWQPIPVHTVP

SEQ ID NO: 10964 - protein, 16 aa, Artificial Sequence
  Synthetic Peptide
PILLWQPIPVHTVPLS

SEQ ID NO: 10965 - protein, 15 aa, Artificial Sequence
  Synthetic Peptide
ILLWQPIPVHTVPLS

SEQ ID NO: 10966 - protein, 15 aa, Artificial Sequence
  Synthetic Peptide
WQPIPVHTVPLSEDQ

SEQ ID NO: 10967 - protein, 15 aa, Artificial Sequence
  Synthetic Peptide
LSGLHGQDLFGIWSK

SEQ ID NO: 10968 - protein, 15 aa, Artificial Sequence
  Synthetic Peptide
YDPLYCESVHNFTLP

SEQ ID NO: 10969 - protein, 15 aa, Artificial Sequence
  Synthetic Peptide
LPSWATEDTMTKLRE

SEQ ID NO: 10970 - protein, 15 aa, Artificial Sequence
  Synthetic Peptide
LRELSELSLLSLYGI

SEQ ID NO: 10971 - protein, 15 aa, Artificial Sequence
  Synthetic Peptide
LSELSLLSLYGIHKQ

SEQ ID NO: 10972 - protein, 15 aa, Artificial Sequence
  Synthetic Peptide
LSLLSLYGIHKQKEK

SEQ ID NO: 10973 - protein, 15 aa, Artificial Sequence
  Synthetic Peptide
KSRLQGGVLVNEILN

SEQ ID NO: 10974 - protein, 15 aa, Artificial Sequence
  Synthetic Peptide
GGVLVNEILNHMKRA

SEQ ID NO: 10975 - protein, 15 aa, Artificial Sequence
  Synthetic Peptide
IPSYKKLIMYSAHDT

SEQ ID NO: 10976 - protein, 15 aa, Artificial Sequence
  Synthetic Peptide
YKKLIMYSAHDTTVS

SEQ ID NO: 10977 - protein, 15 aa, Artificial Sequence
  Synthetic Peptide
LIMYSAHDTTVSGLQ

SEQ ID NO: 10978 - protein, 15 aa, Artificial Sequence
  Synthetic Peptide
DTTVSGLQMALDVYN

SEQ ID NO: 10979 - protein, 15 aa, Artificial Sequence
  Synthetic Peptide
ALDVYNGLLPPYASC

SEQ ID NO: 10980 - protein, 15 aa, Artificial Sequence
  Synthetic Peptide
LDVYNGLLPPYASCH

SEQ ID NO: 10981 - protein, 15 aa, Artificial Sequence
  Synthetic Peptide
YNGLLPPYASCHLTR

SEQ ID NO: 10982 - protein, 14 aa, Artificial Sequence
  Synthetic Peptide
PYPMLPGCSPSCPL

SEQ ID NO: 10983 - protein, 15 aa, Artificial Sequence
  Synthetic Peptide
FAELVGPVIPQDWST

SEQ ID NO: 10984 - protein, 15 aa, Artificial Sequence
  Synthetic Peptide
PQDWSTECMTTNSHQ

SEQ ID NO: 10985 - protein, 15 aa, Artificial Sequence
  Synthetic Peptide
TLSVTWIGAAPLILS

SEQ ID NO: 10986 - protein, 15 aa, Artificial Sequence
  Synthetic Peptide
SVTWIGAAPLILSRI

SEQ ID NO: 10987 - protein, 15 aa, Artificial Sequence
  Synthetic Peptide
VTWIGAAPLILSRIV

SEQ ID NO: 10988 - protein, 15 aa, Artificial Sequence
  Synthetic Peptide
SQPWQVLVASRGRAV

SEQ ID NO: 10989 - protein, 15 aa, Artificial Sequence
  Synthetic Peptide
GRAVCGGVLVHPQWV

SEQ ID NO: 10990 - protein, 14 aa, Artificial Sequence
  Synthetic Peptide
GVLHPQWVLTAAHC

SEQ ID NO: 10991 - protein, 15 aa, Artificial Sequence
  Synthetic Peptide
HPQWVLTAAHCIRNK

SEQ ID NO: 10992 - protein, 15 aa, Artificial Sequence
  Synthetic Peptide
QWVLTAAHCIRNKSV

SEQ ID NO: 10993 - protein, 15 aa, Artificial Sequence
  Synthetic Peptide
AHCIRNKSVILLGRH

SEQ ID NO: 10994 - protein, 15 aa, Artificial Sequence
  Synthetic Peptide
SVILLGRHSLFHPED

SEQ ID NO: 10995 - protein, 15 aa, Artificial Sequence
  Synthetic Peptide
VILLGRHSLFHPEDT

SEQ ID NO: 10996 - protein, 15 aa, Artificial Sequence
  Synthetic Peptide
GQVFQVSHSFPHPLY

SEQ ID NO: 10997 - protein, 15 aa, Artificial Sequence
  Synthetic Peptide
VFQVSHSFPHPLYDM

SEQ ID NO: 10998 - protein, 15 aa, Artificial Sequence
  Synthetic Peptide
PHPLYDMSLLKNRFL

SEQ ID NO: 10999 - protein, 15 aa, Artificial Sequence
  Synthetic Peptide
SHDLMLLRLSEPAEL

SEQ ID NO: 11000 - protein, 16 aa, Artificial Sequence
  Synthetic Peptide
HDLMLLRRLSEPAELT

SEQ ID NO: 11001 - protein, 15 aa, Artificial Sequence
  Synthetic Peptide
TDAVKVMDLPTQEPA

SEQ ID NO: 11002 - protein, 15 aa, Artificial Sequence
  Synthetic Peptide
AVKVMDLPTQEPALG

SEQ ID NO: 11003 - protein, 15 aa, Artificial Sequence
  Synthetic Peptide
VMDLPTQEPALGTTS

SEQ ID NO: 11004 - protein, 15 aa, Artificial Sequence
  Synthetic Peptide
LHVISNDVCAQVHPQ

SEQ ID NO: 11005 - protein, 15 aa, Artificial Sequence
  Synthetic Peptide
CAQVHPQKVTKFMLC

SEQ ID NO: 11006 - protein, 15 aa, Artificial Sequence
  Synthetic Peptide
GGPLVCNGVLQGITS

SEQ ID NO: 11007 - protein, 15 aa, Artificial Sequence
  Synthetic Peptide
GPLVCNGVLQGITSW

SEQ ID NO: 11008 - protein, 15 aa, Artificial Sequence
  Synthetic Peptide
NGVLQGITSWGSEPC

SEQ ID NO: 11009 - protein, 15 aa, Artificial Sequence
  Synthetic Peptide
RPSLYTKVVHYRKWI

SEQ ID NO: 11010 - protein, 15 aa, Artificial Sequence
  Synthetic Peptide
PRWLCAGALVLAGGF

SEQ ID NO: 11011 - protein, 15 aa, Artificial Sequence
  Synthetic Peptide
LGFLFGWFIKSSNEA

SEQ ID NO: 11012 - protein, 15 aa, Artificial Sequence
  Synthetic Peptide
LDELKAENIKKFLYN

SEQ ID NO: 11013 - protein, 15 aa, Artificial Sequence
  Synthetic Peptide
IKKFLYNFTQIPHLA

SEQ ID NO: 11014 - protein, 15 aa, Artificial Sequence
  Synthetic Peptide
KFLYNFTQIPHLAGT

SEQ ID NO: 11015 - protein, 15 aa, Artificial Sequence
  Synthetic Peptide
WKEFGLDSVELAHYD

SEQ ID NO: 11016 - protein, 15 aa, Artificial Sequence
  Synthetic Peptide
LAHYDVLLSYPNKTH

SEQ ID NO: 11017 - protein, 15 aa, Artificial Sequence
  Synthetic Peptide
GNEIFNTSLFEPPPP

SEQ ID NO: 11018 - protein, 14 aa, Artificial Sequence
  Synthetic Peptide
NTSLFEPPPGYENV

SEQ ID NO: 11019 - protein, 15 aa, Artificial Sequence
  Synthetic Peptide
YENVSDIVPPSDAFS

SEQ ID NO: 11020 - protein, 15 aa, Artificial Sequence
  Synthetic Peptide
VSDIVPPFSAFSPQG

SEQ ID NO: 11021 - protein, 14 aa, Artificial Sequence
  Synthetic Peptide
VPPFSAFSQGMPEG

SEQ ID NO: 11022 - protein, 15 aa, Artificial Sequence
  Synthetic Peptide
FSAFSPQGMPEGDLV

SEQ ID NO: 11023 - protein, 15 aa, Artificial Sequence
  Synthetic Peptide
GKVFRGNKVKNAQLA

SEQ ID NO: 11024 - protein, 15 aa, Artificial Sequence
  Synthetic Peptide
GNKVKNAQLAGAKGV

SEQ ID NO: 11025 - protein, 15 aa, Artificial Sequence
  Synthetic Peptide
PADYFAPGVKSYPDG

SEQ ID NO: 11026 - protein, 15 aa, Artificial Sequence
  Synthetic Peptide
GWNLPGGGVQRGNIL

SEQ ID NO: 11027 - protein, 15 aa, Artificial Sequence
  Synthetic Peptide
EYAYRRGIAEAVGLP

SEQ ID NO: 11028 - protein, 15 aa, Artificial Sequence
  Synthetic Peptide
AEAVGLPSIPVHPIG

SEQ ID NO: 11029 - protein, 15 aa, Artificial Sequence
  Synthetic Peptide
AVGLPSIPBHPIGYY

SEQ ID NO: 11030 - protein, 15 aa, Artificial Sequence
  Synthetic Peptide
IGYYDAQKLLEKMGG

SEQ ID NO: 11031 - protein, 15 aa, Artificial Sequence
  Synthetic Peptide
GPGFTGNFSTQKVKM

SEQ ID NO: 11032 - protein, 15 aa, Artificial Sequence
  Synthetic Peptide
TGNFSTQKVKMHIHS

SEQ ID NO: 11033 - protein, 15 aa, Artificial Sequence
  Synthetic Peptide
KVKMHIHSTNEVTRI

SEQ ID NO: 11034 - protein, 15 aa, Artificial Sequence
  Synthetic Peptide
TRIYNVIGTLRGAVE

SEQ ID NO: 11035 - protein, 15 aa, Artificial Sequence
  Synthetic Peptide
AEEFGLLGSTEWAEE

SEQ ID NO: 11036 - protein, 15 aa, Artificial Sequence
  Synthetic Peptide
ERGVAYINADSSIEG

SEQ ID NO: 11037 - protein, 15 aa, Artificial Sequence
  Synthetic Peptide
GVAYINADSSIEGNY

SEQ ID NO: 11038 - protein, 15 aa, Artificial Sequence
  Synthetic Peptide
DSSIEGNYTLRVDCT

SEQ ID NO: 11039 - protein, 15 aa, Artificial Sequence
  Synthetic Peptide
NYTLRVDCTPLMYSL

SEQ ID NO: 11040 - protein, 15 aa, Artificial Sequence
  Synthetic Peptide
CTPLMYSLVHNLTKE

SEQ ID NO: 11041 - protein, 15 aa, Artificial Sequence
  Synthetic Peptide
DFEVFFQRLGIASGR

SEQ ID NO: 11042 - protein, 15 aa, Artificial Sequence
  Synthetic Peptide
EVFFQRLGIASGRAR

SEQ ID NO: 11043 - protein, 15 aa, Artificial Sequence
  Synthetic Peptide
TNKFSGYPLYHSVYE

SEQ ID NO: 11044 - protein, 15 aa, Artificial Sequence
  Synthetic Peptide
YDPMFKYHLTVAQVR

SEQ ID NO: 11045 - protein, 15 aa, Artificial Sequence
  Synthetic Peptide
DPMFKYHLTVAQVRG

SEQ ID NO: 11046 - protein, 15 aa, Artificial Sequence
  Synthetic Peptide
MFKYHLTVAQVRGGM

SEQ ID NO: 11047 - protein, 15 aa, Artificial Sequence
  Synthetic Peptide
KYHLTVAQVRGGMVF

SEQ ID NO: 11048 - protein, 15 aa, Artificial Sequence
  Synthetic Peptide
VAQVRGGMVFELANS

SEQ ID NO: 11049 - protein, 15 aa, Artificial Sequence
  Synthetic Peptide
RGGMVFELANSIVLP

SEQ ID NO: 11050 - protein, 15 aa, Artificial Sequence
  Synthetic Peptide
GMVFELANSIVLPFD

SEQ ID NO: 11051 - protein, 15 aa, Artificial Sequence
  Synthetic Peptide
VFELANSIVLPFDCR

SEQ ID NO: 11052 - protein, 15 aa, Artificial Sequence
  Synthetic Peptide
ADKIYSISMKHPQEM

SEQ ID NO: 11053 - protein, 15 aa, Artificial Sequence
  Synthetic Peptide
IYSISMKHPQEMKTY

SEQ ID NO: 11054 - protein, 15 aa, Artificial Sequence
  Synthetic Peptide
PQEMKTYSVSFDSLF

SEQ ID NO: 11055 - protein, 15 aa, Artificial Sequence
  Synthetic Peptide
TYSVSFDSLFSAVKN

SEQ ID NO: 11056 - protein, 15 aa, Artificial Sequence
  Synthetic Peptide
VKNFTEIASKFSERL

SEQ ID NO: 11057 - protein, 15 aa, Artificial Sequence
  Synthetic Peptide
VLRMMNDQLMFLERA

SEQ ID NO: 11058 - protein, 15 aa, Artificial Sequence
  Synthetic Peptide
LRMMNDQLMFLERAF

SEQ ID NO: 11059 - protein, 15 aa, Artificial Sequence
  Synthetic Peptide
YRHVIYAPSSHNKYA

SEQ ID NO: 11060 - protein, 15 aa, Artificial Sequence
  Synthetic Peptide
RHVIYAPSSHNKYAG

SEQ ID NO: 11061 - protein, 15 aa, Artificial Sequence
  Synthetic Peptide
RQIYVAAFTBQAAAE

SEQ ID NO: 11062 - protein, 15 aa, Artificial Sequence
  Synthetic Peptide
QIYVAAFTVQAAAET

SEQ ID NO: 11063 - protein, 15 aa, Artificial Sequence
  Synthetic Peptide
VAAFTVQAAAETLSE

SEQ ID NO: 11064 - protein, 15 aa, Artificial Sequence
  Synthetic Peptide
GGKWSKSSIVGWPAI

SEQ ID NO: 11065 - protein, 15 aa, Artificial Sequence
  Synthetic Peptide
SRDLEKHGAITSSNT

SEQ ID NO: 11066 - protein, 15 aa, Artificial Sequence
  Synthetic Peptide
HGAITSSNTAATNAD

SEQ ID NO: 11067 - protein, 15 aa, Artificial Sequence
  Synthetic Peptide
GFPVRPQVPLRPMTY

SEQ ID NO: 11068 - protein, 15 aa, Artificial Sequence
  Synthetic Peptide
RPQVPLRPMTYKGAF

SEQ ID NO: 11069 - protein, 15 aa, Artificial Sequence
  Synthetic Peptide
RQDILDLWVYHTQGY

SEQ ID NO: 11070 - protein, 15 aa, Artificial Sequence
  Synthetic Peptide
RQEILDLWVYHTQGF

SEQ ID NO: 11071 - protein, 15 aa, Artificial Sequence
  Synthetic Peptide
RQEILDLWVYHTQGY

SEQ ID NO: 11072 - protein, 15 aa, Artificial Sequence
  Synthetic Peptide
RQDILDLWVYNTQGY

SEQ ID NO: 11073 - protein, 15 aa, Artificial Sequence
  Synthetic Peptide
ILDLWVYHTQGYFPD

SEQ ID NO: 11074 - protein, 15 aa, Artificial Sequence
  Synthetic Peptide
ILDLWVYHTQGFFPD

SEQ ID NO: 11075 - protein, 15 aa, Artificial Sequence
  Synthetic Peptide
FPDWQNYTPGPGIRY

SEQ ID NO: 11076 - protein, 15 aa, Artificial Sequence
  Synthetic Peptide
FPDWQNYTPGPGTRF

SEQ ID NO: 11077 - protein, 15 aa, Artificial Sequence
  Synthetic Peptide
GPGIRYPLTFGWCFK

SEQ ID NO: 11078 - protein, 15 aa, Artificial Sequence
  Synthetic Peptide
RFPLTFGWCFKLVPV

SEQ ID NO: 11079 - protein, 15 aa, Artificial Sequence
  Synthetic Peptide
RYPLTFGWCFKLVPV

SEQ ID NO: 11080 - protein, 15 aa, Artificial Sequence
  Synthetic Peptide
TFGWCFKLVPVDPRE

SEQ ID NO: 11081 - protein, 15 aa, Artificial Sequence
  Synthetic Peptide
NNCLLHPMSQHGMDD

SEQ ID NO: 11082 - protein, 15 aa, Artificial Sequence
  Synthetic Peptide
NNSLLHPICQHGMED

SEQ ID NO: 11083 - protein, 15 aa, Artificial Sequence
  Synthetic Peptide
LKAVRIIKILYQSNP

SEQ ID NO: 11084 - protein, 14 aa, Artificial Sequence
  Synthetic Peptide
IKYQSNPPPPSPEG

SEQ ID NO: 11085 - protein, 15 aa, Artificial Sequence
  Synthetic Peptide
AEPVPLQLPPLERLT

SEQ ID NO: 11086 - protein, 15 aa, Artificial Sequence
  Synthetic Peptide
PVPLQLPPLERLTLD

SEQ ID NO: 11087 - protein, 15 aa, Artificial Sequence
  Synthetic Peptide
LEPWNHPGSQPKTAC

SEQ ID NO: 11088 - protein, 15 aa, Artificial Sequence
  Synthetic Peptide
LEPWKHPGSQPKTAC

SEQ ID NO: 11089 - protein, 15 aa, Artificial Sequence
  Synthetic Peptide
LEPWNHPGSQPTTAC

SEQ ID NO: 11090 - protein, 15 aa, Artificial Sequence
  Synthetic Peptide
LEPWNHPGSQPRTPC

SEQ ID NO: 11091 - protein, 15 aa, Artificial Sequence
  Synthetic Peptide
NNCYCKKCCFHCQVC

SEQ ID NO: 11092 - protein, 15 aa, Artificial Sequence
  Synthetic Peptide
TNCYCKKCCYHCQVC

SEQ ID NO: 11093 - protein, 15 aa, Artificial Sequence
  Synthetic Peptide
QVCFLNKGLGISYGR

SEQ ID NO: 11094 - protein, 15 aa, Artificial Sequence
  Synthetic Peptide
QVCFITKGLGISYGR

SEQ ID NO: 11095 - protein, 15 aa, Artificial Sequence
  Synthetic Peptide
QLCFLKKGLGISYGR

SEQ ID NO: 11096 - protein, 15 aa, Artificial Sequence
  Synthetic Peptide
LLFFWLDRSVLAKEL

SEQ ID NO: 11097 - protein, 15 aa, Artificial Sequence
  Synthetic Peptide
IDTFPTDPIKESSWP

SEQ ID NO: 11098 - protein, 15 aa, Artificial Sequence
  Synthetic Peptide
YDPLYCESVHNFTLP

SEQ ID NO: 11099 - protein, 15 aa, Artificial Sequence
  Synthetic Peptide
GGVLVNEILNHMKRA

SEQ ID NO: 11100 - protein, 15 aa, Artificial Sequence
  Synthetic Peptide
LHVISNDVCAQVHPQ

SEQ ID NO: 11101 - protein, 15 aa, Artificial Sequence
  Synthetic Peptide
LDELKAENIKKFLYN

SEQ ID NO: 11102 - protein, 15 aa, Artificial Sequence
  Synthetic Peptide
WKEFGLDSVELAHYD

SEQ ID NO: 11103 - protein, 15 aa, Artificial Sequence
  Synthetic Peptide
NYTLRVDCTPLMYSL

SEQ ID NO: 11104 - protein, 15 aa, Artificial Sequence
  Synthetic Peptide
RGGMVFELANSIVLP

SEQ ID NO: 11105 - protein, 15 aa, Artificial Sequence
  Synthetic Peptide
TYSVSFDSLFSAVKN

SEQ ID NO: 11106 - protein, 15 aa, Artificial Sequence
  Synthetic Peptide
VLRMMNDQLMFLERA

SEQ ID NO: 11107 - protein, 15 aa, Artificial Sequence
  Synthetic Peptide
HNLFEPEDTGQRVPV

SEQ ID NO: 11108 - protein, 15 aa, Artificial Sequence
  Synthetic Peptide
HQSLRPDEDSSHDLM

SEQ ID NO: 11109 - protein, 15 aa, Artificial Sequence
  Synthetic Peptide
WGSIEPEEFLRPRSL

SEQ ID NO: 11110 - protein, 15 aa, Artificial Sequence
  Synthetic Peptide
LHLLSNDMCARAYSE

SEQ ID NO: 11111 - protein, 15 aa, Artificial Sequence
  Synthetic Peptide
RSVLAKELKFVTLVF

SEQ ID NO: 11112 - protein, 15 aa, Artificial Sequence
  Synthetic Peptide
LTQLGMEQHYELGEY

SEQ ID NO: 11113 - protein, 15 aa, Artificial Sequence
  Synthetic Peptide
RYKFLNESYKHEQVY

SEQ ID NO: 11114 - protein, 15 aa, Artificial Sequence
  Synthetic Peptide
RKFLNESYKHEQVYI

SEQ ID NO: 11115 - protein, 15 aa, Artificial Sequence
  Synthetic Peptide
NESYKHEQVYIRSTD

SEQ ID NO: 11116 - protein, 15 aa, Artificial Sequence
  Synthetic Peptide
AALFPPEGVSIWNPI

SEQ ID NO: 11117 - protein, 15 aa, Artificial Sequence
  Synthetic Peptide
TVPLSEDQLLYLPFR

SEQ ID NO: 11118 - protein, 15 aa, Artificial Sequence
  Synthetic Peptide
FQELESETLKSEEFQ

SEQ ID NO: 11119 - protein, 15 aa, Artificial Sequence
  Synthetic Peptide
SETLKSEEFQKRLHP

SEQ ID NO: 11120 - protein, 15 aa, Artificial Sequence
  Synthetic Peptide
DPLYCESVHNFTLPS

SEQ ID NO: 11121 - protein, 15 aa, Artificial Sequence
  Synthetic Peptide
KKLIMYSAHDTTVSG

SEQ ID NO: 11122 - protein, 15 aa, Artificial Sequence
  Synthetic Peptide
GLQMALDVYNGLLPP

SEQ ID NO: 11123 - protein, 15 aa, Artificial Sequence
  Synthetic Peptide
LTELYFEKGEYFVEM

SEQ ID NO: 11124 - protein, 15 aa, Artificial Sequence
  Synthetic Peptide
KGEYFVEMYYRNETQ

SEQ ID NO: 11125 - protein, 15 aa, Artificial Sequence
  Synthetic Peptide
EMYYRNETQHEPYPL

SEQ ID NO: 11126 - protein, 15 aa, Artificial Sequence
  Synthetic Peptide
GPVIPQDWSTECMTT

SEQ ID NO: 11127 - protein, 15 aa, Artificial Sequence
  Synthetic Peptide
TECMTTNSHQGTEDS

SEQ ID NO: 11128 - protein, 15 aa, Artificial Sequence
  Synthetic Peptide
HSLFHPEDTGQVFQV

SEQ ID NO: 11129 - protein, 15 aa, Artificial Sequence
  Synthetic Peptide
WGSIEPEEFLTPKKL

SEQ ID NO: 11130 - protein, 15 aa, Artificial Sequence
  Synthetic Peptide
SNDVCAQVHPQKVTK

SEQ ID NO: 11131 - protein, 15 aa, Artificial Sequence
  Synthetic Peptide
MWNLLHETDSAVATA

SEQ ID NO: 11132 - protein, 15 aa, Artificial Sequence
  Synthetic Peptide
TDSAVATARRPRWLC

SEQ ID NO: 11133 - protein, 15 aa, Artificial Sequence
  Synthetic Peptide
MKAFLDELKAENIKK

SEQ ID NO: 11134 - protein, 15 aa, Artificial Sequence
  Synthetic Peptide
AKQIQSQWKEFGLDS

SEQ ID NO: 11135 - protein, 15 aa, Artificial Sequence
  Synthetic Peptide
YISIINEDGNEIFNT

SEQ ID NO: 11136 - protein, 15 aa, Artificial Sequence
  Synthetic Peptide
ISIINEDGNEIFNTS

SEQ ID NO: 11137 - protein, 15 aa, Artificial Sequence
  Synthetic Peptide
EDFFKLERDMKINCS

SEQ ID NO: 11138 - protein, 15 aa, Artificial Sequence
  Synthetic Peptide
FFKLERDMKINCSGK

SEQ ID NO: 11139 - protein, 15 aa, Artificial Sequence
  Synthetic Peptide
DMKINCSGKIVIARY

SEQ ID NO: 11140 - protein, 15 aa, Artificial Sequence
  Synthetic Peptide
GVILYSDPADYFAPG

SEQ ID NO: 11141 - protein, 15 aa, Artificial Sequence
  Synthetic Peptide
IYNVIGTLRGAVEPD

SEQ ID NO: 11142 - protein, 15 aa, Artificial Sequence
  Synthetic Peptide
RGAVEPDRYVILGGH

SEQ ID NO: 11143 - protein, 15 aa, Artificial Sequence
  Synthetic Peptide
GAAVVHEIVRSFGTL

SEQ ID NO: 11144 - protein, 15 aa, Artificial Sequence
  Synthetic Peptide
FGTLKKEGWRPRRTI

SEQ ID NO: 11145 - protein, 15 aa, Artificial Sequence
  Synthetic Peptide
TEWAEENSRLLQERG

SEQ ID NO: 11146 - protein, 15 aa, Artificial Sequence
  Synthetic Peptide
NSRLLQERCVAYINA

SEQ ID NO: 11147 - protein, 15 aa, Artificial Sequence
  Synthetic Peptide
VAYINADSSIEGNYT

SEQ ID NO: 11148 - protein, 15 aa, Artificial Sequence
  Synthetic Peptide
VHNLTKELKSPDEGT

SEQ ID NO: 11149 - protein, 15 aa, Artificial Sequence
  Synthetic Peptide
SIVLPFDCRDYAVVL

SEQ ID NO: 11150 - protein, 15 aa, Artificial Sequence
  Synthetic Peptide
DKIYSISMKHPQEMK

SEQ ID NO: 11151 - protein, 15 aa, Artificial Sequence
  Synthetic Peptide
DQLMFLERAFIDPLG

SEQ ID NO: 11152 - protein, 15 aa, Artificial Sequence
  Synthetic Peptide
HVIYAPSSHNKYAGE

SEQ ID NO: 11153 - protein, 15 aa, Artificial Sequence
  Synthetic Peptide
HNKYAGESFPGIYDA

SEQ ID NO: 11154 - protein, 15 aa, Artificial Sequence
  Synthetic Peptide
DALFDIESKVDPSKA

SEQ ID NO: 11155 - protein, 15 aa, Artificial Sequence
  Synthetic Peptide
PSKAWGEVKRQIYVA

SEQ ID NO: 11156 - protein, 15 aa, Artificial Sequence
  Synthetic Peptide
QADVSQDLDKCGAAA

SEQ ID NO: 11157 - protein, 15 aa, Artificial Sequence
  Synthetic Peptide
LSHFLKEKGGLEGLI

SEQ ID NO: 11158 - protein, 15 aa, Artificial Sequence
  Synthetic Peptide
LSFFLKEKGGLDGLI

SEQ ID NO: 11159 - protein, 15 aa, Artificial Sequence
  Synthetic Peptide
TQGYFPDWQNYTPGP

SEQ ID NO: 11160 - protein, 15 aa, Artificial Sequence
  Synthetic Peptide
TQGFFPDWQNYTPGP

SEQ ID NO: 11161 - protein, 15 aa, Artificial Sequence
  Synthetic Peptide
LDGLIYSKKRQEILD

SEQ ID NO: 11162 - protein, 15 aa, Artificial Sequence
  Synthetic Peptide
TRQARRNRRRRWRAR

SEQ ID NO: 11163 - protein, 15 aa, Artificial Sequence
  Synthetic Peptide
TRQARRNRRRRWRER

SEQ ID NO: 11164 - protein, 15 aa, Artificial Sequence
  Synthetic Peptide
TRQARKNRRRRWRAR

SEQ ID NO: 11165 - protein, 15 aa, Artificial Sequence
  Synthetic Peptide
KEKVERETETDPAVQ

SEQ ID NO: 11166 - protein, 15 aa, Artificial Sequence
  Synthetic Peptide
QDAVSQDLDKCGAAA

SEQ ID NO: 11167 - protein, 15 aa, Artificial Sequence
  Synthetic Peptide
FPDWQNTYPGPGIRY

SEQ ID NO: 11168 - protein, 16 aa, Artificial Sequence
  Synthetic Peptide
FPDWQNTYTPGPGTRF

SEQ ID NO: 11169 - protein, 15 aa, Artificial Sequence
  Synthetic Peptide
GFPVRPQVPLRLMTY

SEQ ID NO: 11170 - protein, 15 aa, Artificial Sequence
  Synthetic Peptide
RPQVPLRMMTYKGAF

SEQ ID NO: 11171 - protein, 14 aa, Artificial Sequence
  Synthetic Peptide
RFPTFGWCFKLVPV

SEQ ID NO: 11172 - protein, 14 aa, Artificial Sequence
  Synthetic Peptide
RYPTFGWCFKLVPV

SEQ ID NO: 11173 - protein, 15 aa, Artificial Sequence
  Synthetic Peptide
TQGYFPDWQNTYPGP

SEQ ID NO: 11174 - protein, 15 aa, Artificial Sequence
  Synthetic Peptide
RQDILDLWVYHTQGY

SEQ ID NO: 11175 - protein, 15 aa, Artificial Sequence
  Synthetic Peptide
RQEILDLWVYHTQGF

SEQ ID NO: 11176 - protein, 14 aa, Artificial Sequence
  Synthetic Peptide
RQEKDKWVYHTQGY

SEQ ID NO: 11177 - protein, 14 aa, Artificial Sequence
  Synthetic Peptide
LSHFLKEKGGLGLI

SEQ ID NO: 11178 - protein, 15 aa, Artificial Sequence
  Synthetic Peptide
LSHFLKEKGGLEGLI

SEQ ID NO: 11179 - protein, 16 aa, Artificial Sequence
  Synthetic Peptide
TTFGACFKLVPVDPRE

SEQ ID NO: 11180 - protein, 15 aa, Artificial Sequence
  Synthetic Peptide
ILDLWVYHTQGYFPD

SEQ ID NO: 11181 - protein, 15 aa, Artificial Sequence
  Synthetic Peptide
GGKWSKSSIVGWPAI

SEQ ID NO: 11182 - protein, 15 aa, Artificial Sequence
  Synthetic Peptide
RQDILDLWVYNTGGY

SEQ ID NO: 11183 - protein, 15 aa, Artificial Sequence
  Synthetic Peptide
LDGLIYSKKRQEILD

SEQ ID NO: 11184 - protein, 15 aa, Artificial Sequence
  Synthetic Peptide
TQGFFPDWQNTYPGP

SEQ ID NO: 11185 - protein, 14 aa, Artificial Sequence
  Synthetic Peptide
NNCLHPMSQHGMDD

SEQ ID NO: 11186 - protein, 15 aa, Artificial Sequence
  Synthetic Peptide
NNSLLHPICQHGMED

SEQ ID NO: 11187 - protein, 15 aa, Artificial Sequence
  Synthetic Peptide
GPGIRYPLTFGWCFK

SEQ ID NO: 11188 - protein, 15 aa, Artificial Sequence
  Synthetic Peptide
HGAITSSNTAATNAD

SEQ ID NO: 11189 - protein, 15 aa, Artificial Sequence
  Synthetic Peptide
SRDLEKHGAITSSNT

SEQ ID NO: 11190 - protein, 15 aa, Artificial Sequence
  Synthetic Peptide
ILDLWVYHTQGFFPD

SEQ ID NO: 11191 - protein, 15 aa, Artificial Sequence
  Synthetic Peptide
TRQARRNRRRRWRAR

SEQ ID NO: 11192 - protein, 15 aa, Artificial Sequence
  Synthetic Peptide
TRQARRNRRRRWRER

SEQ ID NO: 11193 - protein, 15 aa, Artificial Sequence
  Synthetic Peptide
PVPLQLPPLERLTLD

SEQ ID NO: 11194 - protein, 15 aa, Artificial Sequence
  Synthetic Peptide
AEPVPLQLPPLERLT

SEQ ID NO: 11195 - protein, 14 aa, Artificial Sequence
  Synthetic Peptide
TRQARKNRRRWRAR

SEQ ID NO: 11196 - protein, 14 aa, Artificial Sequence
  Synthetic Peptide
IKFYQSNPPPSPEG

SEQ ID NO: 11197 - protein, 15 aa, Artificial Sequence
  Synthetic Peptide
LKAVRIIKILYQSNP

SEQ ID NO: 11198 - protein, 15 aa, Artificial Sequence
  Synthetic Peptide
LEPWNHPGSQPKTAC

SEQ ID NO: 11199 - protein, 15 aa, Artificial Sequence
  Synthetic Peptide
QVCFLNKGLGISYGR

SEQ ID NO: 11200 - protein, 15 aa, Artificial Sequence
  Synthetic Peptide
LEPWKHPGSQPKTAC

SEQ ID NO: 11201 - protein, 15 aa, Artificial Sequence
  Synthetic Peptide
KEKVERETETDPAVQ

SEQ ID NO: 11202 - protein, 15 aa, Artificial Sequence
  Synthetic Peptide
NNCYCKKCCFHCQVC

SEQ ID NO: 11203 - protein, 15 aa, Artificial Sequence
  Synthetic Peptide
TNCYCKKCCYHCQVC

SEQ ID NO: 11204 - protein, 15 aa, Artificial Sequence
  Synthetic Peptide
LEPWNHPGSQPTTAC

SEQ ID NO: 11205 - protein, 15 aa, Artificial Sequence
  Synthetic Peptide
QVCFIGKGLGISYGR

SEQ ID NO: 11206 - protein, 15 aa, Artificial Sequence
  Synthetic Peptide
LEPWNHPGSQPRTPC

SEQ ID NO: 11207 - protein, 15 aa, Artificial Sequence
  Synthetic Peptide
QLCFLKKGLGISYGR

SEQ ID NO: 11208 - protein, 9 aa, Artificial Sequence
  Synthetic Peptide
YLAWVPAHK

SEQ ID NO: 11209 - protein, 9 aa, Artificial Sequence
  Synthetic Peptide
ISYPPLHER

SEQ ID NO: 11210 - protein, 9 aa, Artificial Sequence
  Synthetic Peptide
IVIWGKTPK

SEQ ID NO: 11211 - protein, 9 aa, Artificial Sequence
  Synthetic Peptide
AVFIHNFKR

SEQ ID NO: 11212 - protein, 9 aa, Artificial Sequence
  Synthetic Peptide
IMPARFYPK

SEQ ID NO: 11213 - protein, 9 aa, Artificial Sequence
  Synthetic Peptide
RLADEGLNR

SEQ ID NO: 11214 - protein, 9 aa, Artificial Sequence
  Synthetic Peptide
KVFVLGGCR

SEQ ID NO: 11215 - protein, 9 aa, Artificial Sequence
  Synthetic Peptide
LACAGLAYK

SEQ ID NO: 11216 - protein, 9 aa, Artificial Sequence
  Synthetic Peptide
NVSIPWTHK

SEQ ID NO: 11217 - protein, 9 aa, Artificial Sequence
  Synthetic Peptide
SLFRAVITK

SEQ ID NO: 11218 - protein, 9 aa, Artificial Sequence
  Synthetic Peptide
QTNFKSLLR

SEQ ID NO: 11219 - protein, 9 aa, Artificial Sequence
  Synthetic Peptide
GSTHVSWPK

SEQ ID NO: 11220 - protein, 9 aa, Artificial Sequence
  Synthetic Peptide
RAKWNNTLK

SEQ ID NO: 11221 - protein, 9 aa, Artificial Sequence
  Synthetic Peptide
YTKVVHYRK

SEQ ID NO: 11222 - protein, 9 aa, Artificial Sequence
  Synthetic Peptide
TTINFTRQR

SEQ ID NO: 11223 - protein, 9 aa, Artificial Sequence
  Synthetic Peptide
CALPFTSAR

SEQ ID NO: 11224 - protein, 9 aa, Artificial Sequence
  Synthetic Peptide
AVNHYFKTR

SEQ ID NO: 11225 - protein, 9 aa, Artificial Sequence
  Synthetic Peptide
MTKILEPFR

SEQ ID NO: 11226 - protein, 9 aa, Artificial Sequence
  Synthetic Peptide
VVFGILIKR

SEQ ID NO: 11227 - protein, 9 aa, Artificial Sequence
  Synthetic Peptide
LMQGSTLPR

SEQ ID NO: 11228 - protein, 9 aa, Artificial Sequence
  Synthetic Peptide
TTINFTRQR

SEQ ID NO: 11229 - protein, 9 aa, Artificial Sequence
  Synthetic Peptide
TTINYTLWR

SEQ ID NO: 11230 - protein, 9 aa, Artificial Sequence
  Synthetic Peptide
QLFTFSPRR

SEQ ID NO: 11231 - protein, 9 aa, Artificial Sequence
  Synthetic Peptide
SVLEVFEGR

SEQ ID NO: 11232 - protein, 9 aa, Artificial Sequence
  Synthetic Peptide
KTSERSQPR

SEQ ID NO: 11233 - protein, 9 aa, Artificial Sequence
  Synthetic Peptide
HLYPVARQR

SEQ ID NO: 11234 - protein, 9 aa, Artificial Sequence
  Synthetic Peptide
VLRENTSPK

SEQ ID NO: 11235 - protein, 9 aa, Artificial Sequence
  Synthetic Peptide
LVKSPNHVK

SEQ ID NO: 11236 - protein, 11 aa, Artificial Sequence
  Synthetic Peptide
STLPETTVVRR

SEQ ID NO: 11237 - protein, 10 aa, Artificial Sequence
  Synthetic Peptide
QVPLRPMTYK

SEQ ID NO: 11238 - protein, 9 aa, Artificial Sequence
  Synthetic Peptide
SLFRAVITK

SEQ ID NO: 11239 - protein, 10 aa, Artificial Sequence
  Synthetic Peptide
TVYYGVPVWK

SEQ ID NO: 11240 - protein, 10 aa, Artificial Sequence
  Synthetic Peptide
GVAGALVAFK

SEQ ID NO: 11241 - protein, 11 aa, Artificial Sequence
  Synthetic Peptide
VTVYYGVPVWK

SEQ ID NO: 11242 - protein, 10 aa, Artificial Sequence
  Synthetic Peptide
TLWKAGILYK

SEQ ID NO: 11243 - protein, 9 aa, Artificial Sequence
  Synthetic Peptide
FPVRPQVPL

SEQ ID NO: 11244 - protein, 9 aa, Artificial Sequence
  Synthetic Peptide
FPVRPQFPL

SEQ ID NO: 11245 - protein, 9 aa, Artificial Sequence
  Synthetic Peptide
FPVRPQVPI

SEQ ID NO: 11246 - skipped
  Synthetic Peptide

SEQ ID NO: 11247 - protein, 9 aa, Artificial Sequence
  Synthetic Peptide
IPIPSSWAF

SEQ ID NO: 11248 - protein, 9 aa, Artificial Sequence
  Synthetic Peptide
FPIPSSWAF

SEQ ID NO: 11249 - protein, 9 aa, Artificial Sequence
  Synthetic Peptide
IPIPMSWAF

SEQ ID NO: 11250 - protein, 9 aa, Artificial Sequence
  Synthetic Peptide
IPFPSSWAF

SEQ ID NO: 11251 - protein, 9 aa, Artificial Sequence
  Synthetic Peptide
IPIPSSWAI

SEQ ID NO: 11252 - skipped
  Synthetic Peptide

SEQ ID NO: 11253 - protein, 9 aa, Artificial Sequence
  Synthetic Peptide
FPHCLAFSY

SEQ ID NO: 11254 - protein, 9 aa, Artificial Sequence
  Synthetic Peptide
FPHCLAFAL

SEQ ID NO: 11255 - protein, 9 aa, Artificial Sequence
  Synthetic Peptide
FPHCLAFSL

SEQ ID NO: 11256 - protein, 9 aa, Artificial Sequence
  Synthetic Peptide
FPFCLAFSY

SEQ ID NO: 11257 - protein, 9 aa, Artificial Sequence
  Synthetic Peptide
FPHCLAFSI

SEQ ID NO: 11258 - protein, 9 aa, Artificial Sequence
  Synthetic Peptide
FPHCLAFSA

SEQ ID NO: 11259 - skipped
  Synthetic Peptide

SEQ ID NO: 11260 - protein, 9 aa, Artificial Sequence
  Synthetic Peptide
LPGCSFSIF

SEQ ID NO: 11261 - protein, 9 aa, Artificial Sequence
  Synthetic Peptide
FPGCSFSIF

SEQ ID NO: 11262 - protein, 9 aa, Artificial Sequence
  Synthetic Peptide
LPVCSFSIF

SEQ ID NO: 11263 - protein, 9 aa, Artificial Sequence
  Synthetic Peptide
LPGCMFSIF

SEQ ID NO: 11264 - skipped
  Synthetic Peptide

SEQ ID NO: 11265 - protein, 9 aa, Artificial Sequence
  Synthetic Peptide
VPISHLYIL

SEQ ID NO: 11266 - protein, 9 aa, Artificial Sequence
  Synthetic Peptide
FPISHLYIL

SEQ ID NO: 11267 - protein, 9 aa, Artificial Sequence
  Synthetic Peptide
VPISMLYIL

SEQ ID NO: 11268 - protein, 9 aa, Artificial Sequence
  Synthetic Peptide
VPISHLYII

SEQ ID NO: 11269 - skipped
  Synthetic Peptide

SEQ ID NO: 11270 - protein, 9 aa, Artificial Sequence
  Synthetic Peptide
MPKAGLLII

SEQ ID NO: 11271 - protein, 9 aa, Artificial Sequence
  Synthetic Peptide
FPKAGLLII

SEQ ID NO: 11272 - protein, 9 aa, Artificial Sequence
  Synthetic Peptide
MPVAGLLII

SEQ ID NO: 11273 - protein, 9 aa, Artificial Sequence
  Synthetic Peptide
MPKAMLLII

SEQ ID NO: 11274 - protein, 9 aa, Artificial Sequence
  Synthetic Peptide
MPFAGLLII

SEQ ID NO: 11275 - protein, 11 aa, Artificial Sequence
  Synthetic Peptide
STLPETTVVRR

SEQ ID NO: 11276 - protein, 10 aa, Artificial Sequence
  Synthetic Peptide
QVPLRPMTYK

SEQ ID NO: 11277 - protein, 9 aa, Artificial Sequence
  Synthetic Peptide
SLFRAVITK

SEQ ID NO: 11278 - protein, 10 aa, Artificial Sequence
  Synthetic Peptide
TVYYGVPVWK

SEQ ID NO: 11279 - protein, 10 aa, Artificial Sequence
  Synthetic Peptide
GVAGALVAFK

SEQ ID NO: 11280 - protein, 11 aa, Artificial Sequence
  Synthetic Peptide
VTVYYGVPVWK

SEQ ID NO: 11281 - protein, 10 aa, Artificial Sequence
  Synthetic Peptide
TLWKAGILYK

SEQ ID NO: 11282 - protein, 9 aa, Artificial Sequence
  Synthetic Peptide
IPIPSSWAF

SEQ ID NO: 11283 - protein, 9 aa, Artificial Sequence
  Synthetic Peptide
FPIPSSWAF

SEQ ID NO: 11284 - protein, 9 aa, Artificial Sequence
  Synthetic Peptide
IPIPSSWAI

SEQ ID NO: 11285 - protein, 9 aa, Artificial Sequence
  Synthetic Peptide
FPHCLAFSY

SEQ ID NO: 11286 - protein, 9 aa, Artificial Sequence
  Synthetic Peptide
FPHCLAFAL

SEQ ID NO: 11287 - protein, 9 aa, Artificial Sequence
  Synthetic Peptide
FPHCLAFSL

SEQ ID NO: 11288 - protein, 9 aa, Artificial Sequence
  Synthetic Peptide
FPFCLAFSY

SEQ ID NO: 11289 - protein, 9 aa, Artificial Sequence
  Synthetic Peptide
FPHCLAFSI

SEQ ID NO: 11290 - protein, 9 aa, Artificial Sequence
  Synthetic Peptide
FPHCLAFSA

SEQ ID NO: 11291 - protein, 9 aa, Artificial Sequence
  Synthetic Peptide
LPGCSFSIF

SEQ ID NO: 11292 - protein, 9 aa, Artificial Sequence
  Synthetic Peptide
FPGCSFSIF

SEQ ID NO: 11293 - protein, 9 aa, Artificial Sequence
  Synthetic Peptide
VPISHLYIL

SEQ ID NO: 11294 - protein, 9 aa, Artificial Sequence
  Synthetic Peptide
FPISHLYIL

SEQ ID NO: 11295 - protein, 9 aa, Artificial Sequence
  Synthetic Peptide
MPKAGLLII

SEQ ID NO: 11296 - protein, 9 aa, Artificial Sequence
  Synthetic Peptide
FPKAGLLII

SEQ ID NO: 11297 - protein, 9 aa, Artificial Sequence
  Synthetic Peptide
MPFAGLLII

SEQ ID NO: 11298 - protein, 9 aa, Artificial Sequence
  Synthetic Peptide
RVTGGVFLV

SEQ ID NO: 11299 - protein, 9 aa, Artificial Sequence
  Synthetic Peptide
RLTGGVFLV

SEQ ID NO: 11300 - protein, 9 aa, Artificial Sequence
  Synthetic Peptide
SLDSWWTSL

SEQ ID NO: 11301 - protein, 9 aa, Artificial Sequence
  Synthetic Peptide
SLDSWWTSV

SEQ ID NO: 11302 - protein, 9 aa, Artificial Sequence
  Synthetic Peptide
WILRGTSFV

SEQ ID NO: 11303 - protein, 9 aa, Artificial Sequence
  Synthetic Peptide
WLLRGTSFV

SEQ ID NO: 11304 - protein, 9 aa, Artificial Sequence
  Synthetic Peptide
IVGLLGFAA

SEQ ID NO: 11305 - protein, 9 aa, Artificial Sequence
  Synthetic Peptide
ILGLLGFAV

SEQ ID NO: 11306 - protein, 9 aa, Artificial Sequence
  Synthetic Peptide
RILTIPQSL

SEQ ID NO: 11307 - protein, 9 aa, Artificial Sequence
  Synthetic Peptide
RMLTIPQSV

SEQ ID NO: 11308 - protein, 9 aa, Artificial Sequence
  Synthetic Peptide
GLCQVFADA

SEQ ID NO: 11309 - protein, 9 aa, Artificial Sequence
  Synthetic Peptide
GLCAVFADV

SEQ ID NO: 11310 - protein, 9 aa, Artificial Sequence
  Synthetic Peptide
RVSWPKFAV

SEQ ID NO: 11311 - protein, 9 aa, Artificial Sequence
  Synthetic Peptide
RLSWPKFAV

SEQ ID NO: 11312 - protein, 10 aa, Artificial Sequence
  Synthetic Peptide
SILSPFLPLL

SEQ ID NO: 11313 - protein, 10 aa, Artificial Sequence
  Synthetic Peptide
SMLSPFLPLV

SEQ ID NO: 11314 - protein, 10 aa, Artificial Sequence
  Synthetic Peptide
LVLQAGFFLL

SEQ ID NO: 11315 - protein, 10 aa, Artificial Sequence
  Synthetic Peptide
LMLQAGFFLV

SEQ ID NO: 11316 - protein, 10 aa, Artificial Sequence
  Synthetic Peptide
FILLLCLIFL

SEQ ID NO: 11317 - protein, 10 aa, Artificial Sequence
  Synthetic Peptide
FMLLLCLIFL

SEQ ID NO: 11318 - protein, 10 aa, Artificial Sequence
  Synthetic Peptide
FVGLSPTVWL

SEQ ID NO: 11319 - protein, 10 aa, Artificial Sequence
  Synthetic Peptide
FLGLSPTVWV

SEQ ID NO: 11320 - protein, 10 aa, Artificial Sequence
  Synthetic Peptide
LVLLDYQGML

SEQ ID NO: 11321 - protein, 10 aa, Artificial Sequence
  Synthetic Peptide
LMLLDYQGMV

SEQ ID NO: 11322 - protein, 9 aa, Artificial Sequence
  Synthetic Peptide
LVPFVQWFV

SEQ ID NO: 11323 - protein, 9 aa, Artificial Sequence
  Synthetic Peptide
LVPFVQWFA

SEQ ID NO: 11324 - protein, 9 aa, Artificial Sequence
  Synthetic Peptide
LLPFVQWFV

SEQ ID NO: 11325 - protein, 9 aa, Artificial Sequence
  Synthetic Peptide
LMPFVQWFV

SEQ ID NO: 11326 - protein, 9 aa, Artificial Sequence
  Synthetic Peptide
RVTGGVFLV

SEQ ID NO: 11327 - protein, 9 aa, Artificial Sequence
  Synthetic Peptide
RLTGGVFLV

SEQ ID NO: 11328 - protein, 9 aa, Artificial Sequence
  Synthetic Peptide
RMTGGVFLV

SEQ ID NO: 11329 - protein, 10 aa, Artificial Sequence
  Synthetic Peptide
YLHTLWKAGI

SEQ ID NO: 11330 - protein, 10 aa, Artificial Sequence
  Synthetic Peptide
YLHTLWKAGV

SEQ ID NO: 11331 - protein, 9 aa, Artificial Sequence
  Synthetic Peptide
YMLDLQPET

SEQ ID NO: 11332 - protein, 9 aa, Artificial Sequence
  Synthetic Peptide
YMLDLQPEV

SEQ ID NO: 11333 - protein, 9 aa, Artificial Sequence
  Synthetic Peptide
YLLDLQEPV

SEQ ID NO: 11334 - protein, 9 aa, Artificial Sequence
  Synthetic Peptide
YEFLWGPRA

SEQ ID NO: 11335 - protein, 9 aa, Artificial Sequence
  Synthetic Peptide
YMFLWGPRV

SEQ ID NO: 11336 - protein, 9 aa, Artificial Sequence
  Synthetic Peptide
LVLGTLEEV

SEQ ID NO: 11337 - protein, 9 aa, Artificial Sequence
  Synthetic Peptide
LMLGTLEEV

SEQ ID NO: 11338 - protein, 9 aa, Artificial Sequence
  Synthetic Peptide
LLGDNQIMP

SEQ ID NO: 11339 - protein, 9 aa, Artificial Sequence
  Synthetic Peptide
LLGDNQIMV

SEQ ID NO: 11340 - protein, 9 aa, Artificial Sequence
  Synthetic Peptide
WEELSVMEV

SEQ ID NO: 11341 - protein, 9 aa, Artificial Sequence
  Synthetic Peptide
WMELSVMEV

SEQ ID NO: 11342 - protein, 9 aa, Artificial Sequence
  Synthetic Peptide
SLHCKPEEA

SEQ ID NO: 11343 - protein, 9 aa, Artificial Sequence
  Synthetic Peptide
SMHCKPEEV

SEQ ID NO: 11344 - protein, 9 aa, Artificial Sequence
  Synthetic Peptide
ALGLVCVQA

SEQ ID NO: 11345 - protein, 9 aa, Artificial Sequence
  Synthetic Peptide
AMGLVCVQV

SEQ ID NO: 11346 - protein, 9 aa, Artificial Sequence
  Synthetic Peptide
GLSYDGLLG

SEQ ID NO: 11347 - protein, 9 aa, Artificial Sequence
  Synthetic Peptide
GLSYDGLLV

SEQ ID NO: 11348 - protein, 9 aa, Artificial Sequence
  Synthetic Peptide
GVWIRTPPA

SEQ ID NO: 11349 - protein, 9 aa, Artificial Sequence
  Synthetic Peptide
GLWIRTPPV

SEQ ID NO: 11350 - protein, 9 aa, Artificial Sequence
  Synthetic Peptide
YVPSALNPA

SEQ ID NO: 11351 - protein, 9 aa, Artificial Sequence
  Synthetic Peptide
YLPSALNPV

SEQ ID NO: 11352 - protein, 9 aa, Artificial Sequence
  Synthetic Peptide
FLYNRPLSV

SEQ ID NO: 11353 - protein, 9 aa, Artificial Sequence
  Synthetic Peptide
VLLPSLFLL

SEQ ID NO: 11354 - protein, 9 aa, Artificial Sequence
  Synthetic Peptide
LLPSLFLLL

SEQ ID NO: 11355 - protein, 9 aa, Artificial Sequence
  Synthetic Peptide
FVDYNFTIV

SEQ ID NO: 11356 - protein, 9 aa, Artificial Sequence
  Synthetic Peptide
KLFPEVIDL

SEQ ID NO: 11357 - protein, 10 aa, Artificial Sequence
  Synthetic Peptide
FLLLGLWGFA

SEQ ID NO: 11358 - protein, 10 aa, Artificial Sequence
  Synthetic Peptide
VLLPSLFLLL

SEQ ID NO: 11359 - protein, 10 aa, Artificial Sequence
  Synthetic Peptide
LLYSDDALHL

SEQ ID NO: 11360 - protein, 9 aa, Artificial Sequence
  Synthetic Peptide
AIYHPQQFV

SEQ ID NO: 11361 - protein, 9 aa, Artificial Sequence
  Synthetic Peptide
AMKADIQHV

SEQ ID NO: 11362 - protein, 9 aa, Artificial Sequence
  Synthetic Peptide
AMLQDMAIL

SEQ ID NO: 11363 - protein, 9 aa, Artificial Sequence
  Synthetic Peptide
DMWEHAFYL

SEQ ID NO: 11364 - protein, 9 aa, Artificial Sequence
  Synthetic Peptide
GLFLTTEAV

SEQ ID NO: 11365 - protein, 9 aa, Artificial Sequence
  Synthetic Peptide
ILFTFLHLA

SEQ ID NO: 11366 - protein, 9 aa, Artificial Sequence
  Synthetic Peptide
KLAGGVAVI

SEQ ID NO: 11367 - protein, 9 aa, Artificial Sequence
  Synthetic Peptide
LMIGTAAAV

SEQ ID NO: 11368 - protein, 9 aa, Artificial Sequence
  Synthetic Peptide
MLQDMAILT

SEQ ID NO: 11369 - protein, 9 aa, Artificial Sequence
  Synthetic Peptide
RLMIGTAAA

SEQ ID NO: 11370 - protein, 9 aa, Artificial Sequence
  Synthetic Peptide
RLVSGLVGA

SEQ ID NO: 11371 - protein, 9 aa, Artificial Sequence
  Synthetic Peptide
RMPAVTDLV

SEQ ID NO: 11372 - protein, 9 aa, Artificial Sequence
  Synthetic Peptide
SLLEIGEGV

SEQ ID NO: 11373 - protein, 9 aa, Artificial Sequence
  Synthetic Peptide
VLLLDVTPL

SEQ ID NO: 11374 - protein, 9 aa, Artificial Sequence
  Synthetic Peptide
YTYKWETFL

SEQ ID NO: 11375 - protein, 9 aa, Artificial Sequence
  Synthetic Peptide
ALINDQLIM

SEQ ID NO: 11376 - protein, 9 aa, Artificial Sequence
  Synthetic Peptide
AMLQLDPNA

SEQ ID NO: 11377 - protein, 9 aa, Artificial Sequence
  Synthetic Peptide
FVFSTSFYL

SEQ ID NO: 11378 - protein, 9 aa, Artificial Sequence
  Synthetic Peptide
GLTSAVIDA

SEQ ID NO: 11379 - protein, 9 aa, Artificial Sequence
  Synthetic Peptide
GLVGLVTFL

SEQ ID NO: 11380 - protein, 9 aa, Artificial Sequence
  Synthetic Peptide
IISTFHLSI

SEQ ID NO: 11381 - protein, 9 aa, Artificial Sequence
  Synthetic Peptide
ILAADLEKL

SEQ ID NO: 11382 - protein, 9 aa, Artificial Sequence
  Synthetic Peptide
IMTSYQYLI

SEQ ID NO: 11383 - protein, 9 aa, Artificial Sequence
  Synthetic Peptide
LIALSVLAV

SEQ ID NO: 11384 - protein, 9 aa, Artificial Sequence
  Synthetic Peptide
LISIFLHLV

SEQ ID NO: 11385 - protein, 9 aa, Artificial Sequence
  Synthetic Peptide
LLGTFTWTL

SEQ ID NO: 11386 - protein, 9 aa, Artificial Sequence
  Synthetic Peptide
LMDCIMFDA

SEQ ID NO: 11387 - protein, 9 aa, Artificial Sequence
  Synthetic Peptide
LTYSQLMTL

SEQ ID NO: 11388 - protein, 9 aa, Artificial Sequence
  Synthetic Peptide
MAWGGSYIA

SEQ ID NO: 11389 - protein, 9 aa, Artificial Sequence
  Synthetic Peptide
NISGYNFSL

SEQ ID NO: 11390 - protein, 9 aa, Artificial Sequence
  Synthetic Peptide
RLFDFNKQA

SEQ ID NO: 11391 - protein, 9 aa, Artificial Sequence
  Synthetic Peptide
RLLGTFTWT

SEQ ID NO: 11392 - protein, 9 aa, Artificial Sequence
  Synthetic Peptide
RLRDLNQAV

SEQ ID NO: 11393 - protein, 9 aa, Artificial Sequence
  Synthetic Peptide
RMAWGGSYI

SEQ ID NO: 11394 - protein, 9 aa, Artificial Sequence
  Synthetic Peptide
STSFYLISI

SEQ ID NO: 11395 - protein, 9 aa, Artificial Sequence
  Synthetic Peptide
VLIALSVLA

SEQ ID NO: 11396 - protein, 9 aa, Artificial Sequence
  Synthetic Peptide
YLISIFLHL

SEQ ID NO: 11397 - protein, 10 aa, Artificial Sequence
  Synthetic Peptide
ALYLLDGLRA

SEQ ID NO: 11398 - protein, 10 aa, Artificial Sequence
  Synthetic Peptide
AVHDTLFYCV

SEQ ID NO: 11399 - protein, 10 aa, Artificial Sequence
  Synthetic Peptide
GLFLTTEAVV

SEQ ID NO: 11400 - protein, 10 aa, Artificial Sequence
  Synthetic Peptide
LLAAGVADPV

SEQ ID NO: 11401 - protein, 10 aa, Artificial Sequence
  Synthetic Peptide
LLGSFELTGI

SEQ ID NO: 11402 - protein, 10 aa, Artificial Sequence
  Synthetic Peptide
LLLDVTPLSL

SEQ ID NO: 11403 - protein, 10 aa, Artificial Sequence
  Synthetic Peptide
LMIGTAAAVV

SEQ ID NO: 11404 - protein, 10 aa, Artificial Sequence
  Synthetic Peptide
RIANGMGATV

SEQ ID NO: 11405 - protein, 10 aa, Artificial Sequence
  Synthetic Peptide
SLLEIGEGVV

SEQ ID NO: 11406 - protein, 10 aa, Artificial Sequence
  Synthetic Peptide
ALMDCIMFDA

SEQ ID NO: 11407 - protein, 10 aa, Artificial Sequence
  Synthetic Peptide
GLVGLVTFLL

SEQ ID NO: 11408 - protein, 10 aa, Artificial Sequence
  Synthetic Peptide
GLYKQPGVPV

SEQ ID NO: 11409 - protein, 10 aa, Artificial Sequence
  Synthetic Peptide
GLYNFATCGL

SEQ ID NO: 11410 - protein, 10 aa, Artificial Sequence
  Synthetic Peptide
LLHGLDFSEV

SEQ ID NO: 11411 - protein, 10 aa, Artificial Sequence
  Synthetic Peptide
LMSIISTFHL

SEQ ID NO: 11412 - protein, 10 aa, Artificial Sequence
  Synthetic Peptide
NLYDHALMSI

SEQ ID NO: 11413 - protein, 10 aa, Artificial Sequence
  Synthetic Peptide
RLLGTFTWTL

SEQ ID NO: 11414 - protein, 10 aa, Artificial Sequence
  Synthetic Peptide
VLIALSVLAV

SEQ ID NO: 11415 - protein, 10 aa, Artificial Sequence
  Synthetic Peptide
YLISIFLHLV

SEQ ID NO: 11416 - protein, 9 aa, Artificial Sequence
  Synthetic Peptide
LLDEGKQSL

SEQ ID NO: 11417 - protein, 9 aa, Artificial Sequence
  Synthetic Peptide
LMTFWNPPV

SEQ ID NO: 11418 - protein, 9 aa, Artificial Sequence
  Synthetic Peptide
VLYGPDTPV

SEQ ID NO: 11419 - protein, 9 aa, Artificial Sequence
  Synthetic Peptide
LLTFWNPPV

SEQ ID NO: 11420 - protein, 10 aa, Artificial Sequence
  Synthetic Peptide
VLYGPDAPTV

SEQ ID NO: 11421 - protein, 9 aa, Artificial Sequence
  Synthetic Peptide
KLSEYLQLV

SEQ ID NO: 11422 - protein, 11 aa, Artificial Sequence
  Synthetic Peptide
LLPENNVLSPL

SEQ ID NO: 11423 - protein, 9 aa, Artificial Sequence
  Synthetic Peptide
RMPEAAPPV

SEQ ID NO: 11424 - protein, 11 aa, Artificial Sequence
  Synthetic Peptide
GLAPPQHLIRV

SEQ ID NO: 11425 - protein, 10 aa, Artificial Sequence
  Synthetic Peptide
NLLGRNSFEV

SEQ ID NO: 11426 - protein, 9 aa, Artificial Sequence
  Synthetic Peptide
LLGRNSFEV

SEQ ID NO: 11427 - protein, 9 aa, Artificial Sequence
  Synthetic Peptide
SLYKGVYEL

SEQ ID NO: 11428 - protein, 9 aa, Artificial Sequence
  Synthetic Peptide
YMDDVVLGV

SEQ ID NO: 11429 - protein, 9 aa, Artificial Sequence
  Synthetic Peptide
LLFLLLADA

SEQ ID NO: 11430 - protein, 9 aa, Artificial Sequence
  Synthetic Peptide
VLVGGVLAA

SEQ ID NO: 11431 - protein, 9 aa, Artificial Sequence
  Synthetic Peptide
HMWNFISGI

SEQ ID NO: 11432 - protein, 9 aa, Artificial Sequence
  Synthetic Peptide
WMNRLIAFA

SEQ ID NO: 11433 - protein, 9 aa, Artificial Sequence
  Synthetic Peptide
YTAFTIPSI

SEQ ID NO: 11434 - protein, 10 aa, Artificial Sequence
  Synthetic Peptide
LTFGWCFKLV

SEQ ID NO: 11435 - protein, 10 aa, Artificial Sequence
  Synthetic Peptide
MASDFNLPPV

SEQ ID NO: 11436 - protein, 10 aa, Artificial Sequence
  Synthetic Peptide
CTLNFPISPI

SEQ ID NO: 11437 - protein, 9 aa, Artificial Sequence
  Synthetic Peptide
KLVGKLNWA

SEQ ID NO: 11438 - protein, 9 aa, Artificial Sequence
  Synthetic Peptide
LLQLTVWGI

SEQ ID NO: 11439 - protein, 9 aa, Artificial Sequence
  Synthetic Peptide
LTFGWCFKL

SEQ ID NO: 11440 - protein, 9 aa, Artificial Sequence
  Synthetic Peptide
ALVEICTEM

SEQ ID NO: 11441 - protein, 9 aa, Artificial Sequence
  Synthetic Peptide
LVGPTPVNI

SEQ ID NO: 11442 - protein, 9 aa, Artificial Sequence
  Synthetic Peptide
AIIRILQQL

SEQ ID NO: 11443 - protein, 10 aa, Artificial Sequence
  Synthetic Peptide
KMIGGIGGFI

SEQ ID NO: 11444 - protein, 9 aa, Artificial Sequence
  Synthetic Peptide
MTNNPPIPV

SEQ ID NO: 11445 - protein, 9 aa, Artificial Sequence
  Synthetic Peptide
TLNFPISPI

SEQ ID NO: 11446 - protein, 9 aa, Artificial Sequence
  Synthetic Peptide
KAACWWAGI

SEQ ID NO: 11447 - protein, 9 aa, Artificial Sequence
  Synthetic Peptide
RAMASDFNL

SEQ ID NO: 11448 - protein, 9 aa, Artificial Sequence
  Synthetic Peptide
RILQQLLFI

SEQ ID NO: 11449 - protein, 9 aa, Artificial Sequence
  Synthetic Peptide
SIISAVVGI

SEQ ID NO: 11450 - protein, 10 aa, Artificial Sequence
  Synthetic Peptide
QLFEDNYALA

SEQ ID NO: 11451 - protein, 10 aa, Artificial Sequence
  Synthetic Peptide
YLWWVNNQSL

SEQ ID NO: 11452 - protein, 9 aa, Artificial Sequence
  Synthetic Peptide
IMIGVLVGV

SEQ ID NO: 11453 - protein, 10 aa, Artificial Sequence
  Synthetic Peptide
GIMIGVLVGV

SEQ ID NO: 11454 - protein, 10 aa, Artificial Sequence
  Synthetic Peptide
YLWWVNGQSL

SEQ ID NO: 11455 - protein, 10 aa, Artificial Sequence
  Synthetic Peptide
VLYGPDAPTI

SEQ ID NO: 11456 - protein, 10 aa, Artificial Sequence
  Synthetic Peptide
IMIGVLVGVA

SEQ ID NO: 11457 - protein, 9 aa, Artificial Sequence
  Synthetic Peptide
YLSGANLNL

SEQ ID NO: 11458 - protein, 8 aa, Artificial Sequence
  Synthetic Peptide
ALPPVAPV

SEQ ID NO: 11459 - protein, 11 aa, Artificial Sequence
  Synthetic Peptide
LLPENNVLSPV

SEQ ID NO: 11460 - protein, 9 aa, Artificial Sequence
  Synthetic Peptide
SLYNTITVL

SEQ ID NO: 11461 - protein, 9 aa, Artificial Sequence
  Synthetic Peptide
SLYNTISVL

SEQ ID NO: 11462 - protein, 9 aa, Artificial Sequence
  Synthetic Peptide
SLYNTVSTL

SEQ ID NO: 11463 - protein, 9 aa, Artificial Sequence
  Synthetic Peptide
AIYGRPVSA

SEQ ID NO: 11464 - protein, 9 aa, Artificial Sequence
  Synthetic Peptide
ALIGTMCGI

SEQ ID NO: 11465 - protein, 9 aa, Artificial Sequence
  Synthetic Peptide
ATLGTVILL

SEQ ID NO: 11466 - protein, 9 aa, Artificial Sequence
  Synthetic Peptide
FIALNLSFI

SEQ ID NO: 11467 - protein, 9 aa, Artificial Sequence
  Synthetic Peptide
FIQNIDFKA

SEQ ID NO: 11468 - protein, 9 aa, Artificial Sequence
  Synthetic Peptide
FLNSSNLFT

SEQ ID NO: 11469 - protein, 9 aa, Artificial Sequence
  Synthetic Peptide
FLYVVCSLA

SEQ ID NO: 11470 - protein, 9 aa, Artificial Sequence
  Synthetic Peptide
FVAVHVPDV

SEQ ID NO: 11471 - protein, 9 aa, Artificial Sequence
  Synthetic Peptide
GILGTIIFA

SEQ ID NO: 11472 - protein, 9 aa, Artificial Sequence
  Synthetic Peptide
HLDFWHHEV

SEQ ID NO: 11473 - protein, 9 aa, Artificial Sequence
  Synthetic Peptide
ITATFTAPL

SEQ ID NO: 11474 - protein, 9 aa, Artificial Sequence
  Synthetic Peptide
LLGTWMFSV

SEQ ID NO: 11475 - protein, 9 aa, Artificial Sequence
  Synthetic Peptide
LMWYELSKI

SEQ ID NO: 11476 - protein, 9 aa, Artificial Sequence
  Synthetic Peptide
MIIIVIAII

SEQ ID NO: 11477 - protein, 9 aa, Artificial Sequence
  Synthetic Peptide
NLLDRLLLI

SEQ ID NO: 11478 - protein, 9 aa, Artificial Sequence
  Synthetic Peptide
RIFYNILEI

SEQ ID NO: 11479 - protein, 9 aa, Artificial Sequence
  Synthetic Peptide
RLASSVFDL

SEQ ID NO: 11480 - protein, 9 aa, Artificial Sequence
  Synthetic Peptide
RLGAIPPLV

SEQ ID NO: 11481 - protein, 9 aa, Artificial Sequence
  Synthetic Peptide
RLYQASAVM

SEQ ID NO: 11482 - protein, 9 aa, Artificial Sequence
  Synthetic Peptide
SILGCDVSV

SEQ ID NO: 11483 - protein, 9 aa, Artificial Sequence
  Synthetic Peptide
SVDFYQFRV

SEQ ID NO: 11484 - protein, 9 aa, Artificial Sequence
  Synthetic Peptide
SVSDFDLRI

SEQ ID NO: 11485 - protein, 9 aa, Artificial Sequence
  Synthetic Peptide
TLGTVILLV

SEQ ID NO: 11486 - protein, 9 aa, Artificial Sequence
  Synthetic Peptide
YLVWQPMSA

SEQ ID NO: 11487 - protein, 10 aa, Artificial Sequence
  Synthetic Peptide
AAVEQILTSV

SEQ ID NO: 11488 - protein, 10 aa, Artificial Sequence
  Synthetic Peptide
ALIGTMCGIL

SEQ ID NO: 11489 - protein, 10 aa, Artificial Sequence
  Synthetic Peptide
ATLGTVILLV

SEQ ID NO: 11490 - protein, 10 aa, Artificial Sequence
  Synthetic Peptide
FLYVVCSLAV

SEQ ID NO: 11491 - protein, 10 aa, Artificial Sequence
  Synthetic Peptide
GALPICSFVV

SEQ ID NO: 11492 - protein, 10 aa, Artificial Sequence
  Synthetic Peptide
KLLGTWMFSV

SEQ ID NO: 11493 - protein, 10 aa, Artificial Sequence
  Synthetic Peptide
QLASILGCDV

SEQ ID NO: 11494 - protein, 10 aa, Artificial Sequence
  Synthetic Peptide
RLSNRICFWA

SEQ ID NO: 11495 - protein, 10 aa, Artificial Sequence
  Synthetic Peptide
SLVTGFINFI

SEQ ID NO: 11496 - protein, 10 aa, Artificial Sequence
  Synthetic Peptide
VLATDVTSFL

SEQ ID NO: 11497 - protein, 10 aa, Artificial Sequence
  Synthetic Peptide
VLLNGWRWRL

SEQ ID NO: 11498 - protein, 10 aa, Artificial Sequence
  Synthetic Peptide
YLVWQPMSAI

SEQ ID NO: 11499 - protein, 8 aa, Artificial Sequence
  Synthetic Peptide
QLAKTCPV

SEQ ID NO: 11500 - protein, 9 aa, Artificial Sequence
  Synthetic Peptide
ALBRWGLLV

SEQ ID NO: 11501 - protein, 9 aa, Artificial Sequence
  Synthetic Peptide
ALCRWGLLV

SEQ ID NO: 11502 - protein, 9 aa, Artificial Sequence
  Synthetic Peptide
AMCRWGLLV

SEQ ID NO: 11503 - protein, 9 aa, Artificial Sequence
  Synthetic Peptide
KLFGSLAFL

SEQ ID NO: 11504 - protein, 9 aa, Artificial Sequence
  Synthetic Peptide
KLFGSLAFV

SEQ ID NO: 11505 - protein, 9 aa, Artificial Sequence
  Synthetic Peptide
KMFGSLAFL

SEQ ID NO: 11506 - protein, 9 aa, Artificial Sequence
  Synthetic Peptide
KMFGSLAFV

SEQ ID NO: 11507 - protein, 9 aa, Artificial Sequence
  Synthetic Peptide
KMFBQLAKV

SEQ ID NO: 11508 - protein, 9 aa, Artificial Sequence
  Synthetic Peptide
KMFCQLAKV

SEQ ID NO: 11509 - protein, 10 aa, Artificial Sequence
  Synthetic Peptide
RMPEAAPPVV

SEQ ID NO: 11510 - protein, 10 aa, Artificial Sequence
  Synthetic Peptide
ALNKMFCQLV

SEQ ID NO: 11511 - protein, 9 aa, Artificial Sequence
  Synthetic Peptide
VLLVSLGAI

SEQ ID NO: 11512 - protein, 9 aa, Artificial Sequence
  Synthetic Peptide
LLTEVETPI

SEQ ID NO: 11513 - protein, 9 aa, Artificial Sequence
  Synthetic Peptide
RLIQNSLTI

SEQ ID NO: 11514 - protein, 9 aa, Artificial Sequence
  Synthetic Peptide
KMNIQFTAV

SEQ ID NO: 11515 - protein, 10 aa, Artificial Sequence
  Synthetic Peptide
GLFGAIAGFI

SEQ ID NO: 11516 - protein, 10 aa, Artificial Sequence
  Synthetic Peptide
KLESMGIYQI

SEQ ID NO: 11517 - protein, 10 aa, Artificial Sequence
  Synthetic Peptide
SLPFQNIHPV

SEQ ID NO: 11518 - protein, 8 aa, Artificial Sequence
  Synthetic Peptide
ALPPVAPV

SEQ ID NO: 11519 - protein, 9 aa, Artificial Sequence
  Synthetic Peptide
ALNKMFCQV

SEQ ID NO: 11520 - protein, 9 aa, Artificial Sequence
  Synthetic Peptide
KLFCQLAKV

SEQ ID NO: 11521 - protein, 9 aa, Artificial Sequence
  Synthetic Peptide
KLCPVQLWV

SEQ ID NO: 11522 - protein, 9 aa, Artificial Sequence
  Synthetic Peptide
CLTIHYNYV

SEQ ID NO: 11523 - protein, 10 aa, Artificial Sequence
  Synthetic Peptide
ALNKMFCQLV

SEQ ID NO: 11524 - protein, 10 aa, Artificial Sequence
  Synthetic Peptide
VLVPYEPPEV

SEQ ID NO: 11525 - protein, 10 aa, Artificial Sequence
  Synthetic Peptide
RLPEAAPPVV

SEQ ID NO: 11526 - protein, 10 aa, Artificial Sequence
  Synthetic Peptide
LLPPQHLIRV

SEQ ID NO: 11527 - protein, 11 aa, Artificial Sequence
  Synthetic Peptide
ILLEDSSGNLV

SEQ ID NO: 11528 - protein, 10 aa, Artificial Sequence
  Synthetic Peptide
KLVALGINAV

SEQ ID NO: 11529 - protein, 9 aa, Artificial Sequence
  Synthetic Peptide
SLMAFTAAV

SEQ ID NO: 11530 - protein, 9 aa, Artificial Sequence
  Synthetic Peptide
CINGVCWTV

SEQ ID NO: 11531 - protein, 9 aa, Artificial Sequence
  Synthetic Peptide
TISGVLWQV

SEQ ID NO: 11532 - protein, 9 aa, Artificial Sequence
  Synthetic Peptide
SISGVLWQV

SEQ ID NO: 11533 - protein, 9 aa, Artificial Sequence
  Synthetic Peptide
SLMAFTASV

SEQ ID NO: 11534 - protein, 9 aa, Artificial Sequence
  Synthetic Peptide
GLRDCTMLV

SEQ ID NO: 11535 - protein, 10 aa, Artificial Sequence
  Synthetic Peptide
KLVALGVNAV

SEQ ID NO: 11536 - protein, 10 aa, Artificial Sequence
  Synthetic Peptide
KLSGLGLNAV

SEQ ID NO: 11537 - protein, 10 aa, Artificial Sequence
  Synthetic Peptide
KLVSLGVNAV

SEQ ID NO: 11538 - protein, 10 aa, Artificial Sequence
  Synthetic Peptide
LLALLSCLTV

SEQ ID NO: 11539 - protein, 9 aa, Artificial Sequence
  Synthetic Peptide
LLCPAGHAV

SEQ ID NO: 11540 - protein, 10 aa, Artificial Sequence
  Synthetic Peptide
KLVALGINAV

SEQ ID NO: 11541 - protein, 9 aa, Artificial Sequence
  Synthetic Peptide
SLMAFTAAV

SEQ ID NO: 11542 - protein, 9 aa, Artificial Sequence
  Synthetic Peptide
LLFNILGWV

SEQ ID NO: 11543 - protein, 9 aa, Artificial Sequence
  Synthetic Peptide
  VARIANT 3, 6: Xaa = Any Amino Acid
ALXGGXVNV

SEQ ID NO: 11544 - protein, 9 aa, Artificial Sequence
  Synthetic Peptide
LLDVPTAAV

SEQ ID NO: 11545 - protein, 9 aa, Artificial Sequence
  Synthetic Peptide
  VARIANT 2, 6: Xaa = Any Amino Acid
GXVPFXVSV

SEQ ID NO: 11546 - protein, 9 aa, Artificial Sequence
  Synthetic Peptide
SLLPAIVEL

SEQ ID NO: 11547 - protein, 9 aa, Artificial Sequence
  Synthetic Peptide
  VARIANT 2, 3, 7: Xaa = Any Amino Acid
SXXVRAXEV

SEQ ID NO: 11548 - protein, 9 aa, Artificial Sequence
  Synthetic Peptide
YMNGTMSQV

SEQ ID NO: 11549 - protein, 9 aa, Artificial Sequence
  Synthetic Peptide
  VARIANT 2, 7, 8, 9: Xaa = Any Amino Acid
KXNEPVXXX

SEQ ID NO: 11550 - protein, 9 aa, Artificial Sequence
  Synthetic Peptide
YLLPAIVHI

SEQ ID NO: 11551 - protein, 9 aa, Artificial Sequence
  Synthetic Peptide
  VARIANT 2, 9: Xaa = Any Amino Acid
AXWGFFPVX

SEQ ID NO: 11552 - protein, 9 aa, Artificial Sequence
  Synthetic Peptide
TLWVDPYEV

SEQ ID NO: 11553 - protein, 9 aa, Artificial Sequence
  Synthetic Peptide
  VARIANT 2, 6: Xaa = Any Amino Acid
GXVPFXVSV

SEQ ID NO: 11554 - protein, 9 aa, Artificial Sequence
  Synthetic Peptide
ALEAQQEAL

SEQ ID NO: 11555 - protein, 9 aa, Artificial Sequence
  Synthetic Peptide
ILESLFRAV

SEQ ID NO: 11556 - protein, 9 aa, Artificial Sequence
  Synthetic Peptide
VITKKVADL

SEQ ID NO: 11557 - protein, 9 aa, Artificial Sequence
  Synthetic Peptide
CLGLSYDGL

SEQ ID NO: 11558 - protein, 9 aa, Artificial Sequence
  Synthetic Peptide
QIMPKTGFL

SEQ ID NO: 11559 - protein, 10 aa, Artificial Sequence
  Synthetic Peptide
SLHCKPEEAL

SEQ ID NO: 11560 - protein, 10 aa, Artificial Sequence
  Synthetic Peptide
PLVLGTLEEV

SEQ ID NO: 11561 - protein, 10 aa, Artificial Sequence
  Synthetic Peptide
CILESLFRAV

SEQ ID NO: 11562 - protein, 10 aa, Artificial Sequence
  Synthetic Peptide
AVITKKVADL

SEQ ID NO: 11563 - protein, 10 aa, Artificial Sequence
  Synthetic Peptide
VITKKVADLV

SEQ ID NO: 11564 - protein, 10 aa, Artificial Sequence
  Synthetic Peptide
LLKYRAREPV

SEQ ID NO: 11565 - protein, 10 aa, Artificial Sequence
  Synthetic Peptide
EIFGKASESL

SEQ ID NO: 11566 - protein, 10 aa, Artificial Sequence
  Synthetic Peptide
CLGLSYDGLL

SEQ ID NO: 11567 - protein, 9 aa, Artificial Sequence
  Synthetic Peptide
AISRKMVEL

SEQ ID NO: 11568 - protein, 9 aa, Artificial Sequence
  Synthetic Peptide
KMVELVHFL

SEQ ID NO: 11569 - protein, 9 aa, Artificial Sequence
  Synthetic Peptide
MVELVHFLL

SEQ ID NO: 11570 - protein, 9 aa, Artificial Sequence
  Synthetic Peptide
DLQQSLRVL

SEQ ID NO: 11571 - protein, 9 aa, Artificial Sequence
  Synthetic Peptide
SLRVLAAGL

SEQ ID NO: 11572 - protein, 9 aa, Artificial Sequence
  Synthetic Peptide
ALSRKVAEL

SEQ ID NO: 11573 - protein, 9 aa, Artificial Sequence
  Synthetic Peptide
HLYIFATCL

SEQ ID NO: 11574 - protein, 9 aa, Artificial Sequence
  Synthetic Peptide
YIFATCLGL

SEQ ID NO: 11575 - protein, 9 aa, Artificial Sequence
  Synthetic Peptide
QIMPKAGLL

SEQ ID NO: 11576 - protein, 10 aa, Artificial Sequence
  Synthetic Peptide
AISRKMVELV

SEQ ID NO: 11577 - protein, 10 aa, Artificial Sequence
  Synthetic Peptide
MVELVHFLLL

SEQ ID NO: 11578 - protein, 10 aa, Artificial Sequence
  Synthetic Peptide
KLPGLLSRDL

SEQ ID NO: 11579 - protein, 10 aa, Artificial Sequence
  Synthetic Peptide
LLSRDLQQSL

SEQ ID NO: 11580 - protein, 10 aa, Artificial Sequence
  Synthetic Peptide
SLPTTMNYPL

SEQ ID NO: 11581 - protein, 10 aa, Artificial Sequence
  Synthetic Peptide
DLESEFQAAL

SEQ ID NO: 11582 - protein, 10 aa, Artificial Sequence
  Synthetic Peptide
ALSRKVAELV

SEQ ID NO: 11583 - protein, 10 aa, Artificial Sequence
  Synthetic Peptide
KVAELVHFLL

SEQ ID NO: 11584 - protein, 10 aa, Artificial Sequence
  Synthetic Peptide
VIFSKASSSL

SEQ ID NO: 11585 - protein, 10 aa, Artificial Sequence
  Synthetic Peptide
SLQLVFGIEL

SEQ ID NO: 11586 - protein, 10 aa, Artificial Sequence
  Synthetic Peptide
LMEVDPIGHL

SEQ ID NO: 11587 - protein, 9 aa, Artificial Sequence
  Synthetic Peptide
FLIIVLVMI

SEQ ID NO: 11588 - protein, 9 aa, Artificial Sequence
  Synthetic Peptide
GLLGDNQIM

SEQ ID NO: 11589 - protein, 9 aa, Artificial Sequence
  Synthetic Peptide
SLHCKPEEA

SEQ ID NO: 11590 - protein, 9 aa, Artificial Sequence
  Synthetic Peptide
ALGLVCVQA

SEQ ID NO: 11591 - protein, 9 aa, Artificial Sequence
  Synthetic Peptide
CKPEEALEA

SEQ ID NO: 11592 - protein, 9 aa, Artificial Sequence
  Synthetic Peptide
QQEALGLVC

SEQ ID NO: 11593 - protein, 9 aa, Artificial Sequence
  Synthetic Peptide
VQAATSSSS

SEQ ID NO: 11594 - protein, 9 aa, Artificial Sequence
  Synthetic Peptide
PLVLGTLEE

SEQ ID NO: 11595 - protein, 9 aa, Artificial Sequence
  Synthetic Peptide
VPTAGSTDP

SEQ ID NO: 11596 - protein, 9 aa, Artificial Sequence
  Synthetic Peptide
PQSPQGASA

SEQ ID NO: 11597 - protein, 9 aa, Artificial Sequence
  Synthetic Peptide
FPTTINFTR

SEQ ID NO: 11598 - protein, 9 aa, Artificial Sequence
  Synthetic Peptide
QRQPSEGSS

SEQ ID NO: 11599 - protein, 9 aa, Artificial Sequence
  Synthetic Peptide
SREEEGPST

SEQ ID NO: 11600 - protein, 9 aa, Artificial Sequence
  Synthetic Peptide
AVITKKVAD

SEQ ID NO: 11601 - protein, 9 aa, Artificial Sequence
  Synthetic Peptide
EMLESVIKN

SEQ ID NO: 11602 - protein, 9 aa, Artificial Sequence
  Synthetic Peptide
YKHCFPEIF

SEQ ID NO: 11603 - protein, 9 aa, Artificial Sequence
  Synthetic Peptide
GKASESLQL

SEQ ID NO: 11604 - protein, 9 aa, Artificial Sequence
  Synthetic Peptide
VFGIDVKEA

SEQ ID NO: 11605 - protein, 9 aa, Artificial Sequence
  Synthetic Peptide
DPTGHSYVL

SEQ ID NO: 11606 - protein, 9 aa, Artificial Sequence
  Synthetic Peptide
VTCLGLSYD

SEQ ID NO: 11607 - protein, 9 aa, Artificial Sequence
  Synthetic Peptide
PKTGFLIIV

SEQ ID NO: 11608 - protein, 9 aa, Artificial Sequence
  Synthetic Peptide
LVMIAMEGG

SEQ ID NO: 11609 - protein, 9 aa, Artificial Sequence
  Synthetic Peptide
HAPEEEIWE

SEQ ID NO: 11610 - protein, 9 aa, Artificial Sequence
  Synthetic Peptide
ELSVMEVYD

SEQ ID NO: 11611 - protein, 9 aa, Artificial Sequence
  Synthetic Peptide
GREHSAYGE

SEQ ID NO: 11612 - protein, 9 aa, Artificial Sequence
  Synthetic Peptide
PRKLLTQDL

SEQ ID NO: 11613 - protein, 9 aa, Artificial Sequence
  Synthetic Peptide
VQEKYLEYG

SEQ ID NO: 11614 - protein, 9 aa, Artificial Sequence
  Synthetic Peptide
RCRTVIPHA

SEQ ID NO: 11615 - protein, 9 aa, Artificial Sequence
  Synthetic Peptide
MSSCGVQGP

SEQ ID NO: 11616 - protein, 10 aa, Artificial Sequence
  Synthetic Peptide
ILESLFRAVI

SEQ ID NO: 11617 - protein, 10 aa, Artificial Sequence
  Synthetic Peptide
FLIIVLVMIA

SEQ ID NO: 11618 - protein, 10 aa, Artificial Sequence
  Synthetic Peptide
LVFGIDVKEA

SEQ ID NO: 11619 - protein, 10 aa, Artificial Sequence
  Synthetic Peptide
EVYDGREHSA

SEQ ID NO: 11620 - protein, 10 aa, Artificial Sequence
  Synthetic Peptide
GVQGPSLKPA

SEQ ID NO: 11621 - protein, 8 aa, Artificial Sequence
  Synthetic Peptide
QLVFGIDV

SEQ ID NO: 11622 - protein, 8 aa, Artificial Sequence
  Synthetic Peptide
KLLTQDLV

SEQ ID NO: 11623 - protein, 8 aa, Artificial Sequence
  Synthetic Peptide
GLLGDNQI

SEQ ID NO: 11624 - protein, 8 aa, Artificial Sequence
  Synthetic Peptide
DLVGFLLL

SEQ ID NO: 11625 - protein, 8 aa, Artificial Sequence
  Synthetic Peptide
GLSYDGLL

SEQ ID NO: 11626 - protein, 8 aa, Artificial Sequence
  Synthetic Peptide
DLVQEKYL

SEQ ID NO: 11627 - protein, 8 aa, Artificial Sequence
  Synthetic Peptide
LLGDNQIM

SEQ ID NO: 11628 - protein, 8 aa, Artificial Sequence
  Synthetic Peptide
FLIIVLVM

SEQ ID NO: 11629 - protein, 8 aa, Artificial Sequence
  Synthetic Peptide
ALEAQQEA

SEQ ID NO: 11630 - protein, 8 aa, Artificial Sequence
  Synthetic Peptide
TLEEVPTA

SEQ ID NO: 11631 - protein, 8 aa, Artificial Sequence
  Synthetic Peptide
IMPKTGFL

SEQ ID NO: 11632 - protein, 8 aa, Artificial Sequence
  Synthetic Peptide
PVTKAEML

SEQ ID NO: 11633 - protein, 8 aa, Artificial Sequence
  Synthetic Peptide
IVLVMIAM

SEQ ID NO: 11634 - protein, 8 aa, Artificial Sequence
  Synthetic Peptide
AVITKKVA

SEQ ID NO: 11635 - protein, 8 aa, Artificial Sequence
  Synthetic Peptide
EIWEELSV

SEQ ID NO: 11636 - protein, 8 aa, Artificial Sequence
  Synthetic Peptide
LIIVLVMI

SEQ ID NO: 11637 - protein, 8 aa, Artificial Sequence
  Synthetic Peptide
IIVLVMIA

SEQ ID NO: 11638 - protein, 11 aa, Artificial Sequence
  Synthetic Peptide
SLFRAVITKKV

SEQ ID NO: 11639 - protein, 11 aa, Artificial Sequence
  Synthetic Peptide
LLLKYRAREPV

SEQ ID NO: 11640 - protein, 11 aa, Artificial Sequence
  Synthetic Peptide
YLEYGRCRTVI

SEQ ID NO: 11641 - protein, 11 aa, Artificial Sequence
  Synthetic Peptide
ALEAQQEALGL

SEQ ID NO: 11642 - protein, 11 aa, Artificial Sequence
  Synthetic Peptide
FLIIVLVMIAM

SEQ ID NO: 11643 - protein, 11 aa, Artificial Sequence
  Synthetic Peptide
VLGTLEEVPTA

SEQ ID NO: 11644 - protein, 11 aa, Artificial Sequence
  Synthetic Peptide
QLVFGIDVKEA

SEQ ID NO: 11645 - protein, 11 aa, Artificial Sequence
  Synthetic Peptide
AVITKKVADLV

SEQ ID NO: 11646 - protein, 11 aa, Artificial Sequence
  Synthetic Peptide
PVTKAEMLESV

SEQ ID NO: 11647 - protein, 11 aa, Artificial Sequence
  Synthetic Peptide
KVADLVGFLLL

SEQ ID NO: 11648 - protein, 11 aa, Artificial Sequence
  Synthetic Peptide
GVQGPSLKPAM

SEQ ID NO: 11649 - protein, 11 aa, Artificial Sequence
  Synthetic Peptide
LVGFLLLKYRA

SEQ ID NO: 11650 - protein, 11 aa, Artificial Sequence
  Synthetic Peptide
LVMIAMEGGHA

SEQ ID NO: 11651 - protein, 11 aa, Artificial Sequence
  Synthetic Peptide
CILESLFRAVI

SEQ ID NO: 11652 - protein, 9 aa, Artificial Sequence
  Synthetic Peptide
EALEAQQEA

SEQ ID NO: 11653 - protein, 9 aa, Artificial Sequence
  Synthetic Peptide
EAQQEALGL

SEQ ID NO: 11654 - protein, 9 aa, Artificial Sequence
  Synthetic Peptide
AATSSSSPL

SEQ ID NO: 11655 - protein, 9 aa, Artificial Sequence
  Synthetic Peptide
ATSSSSPLV

SEQ ID NO: 11656 - protein, 9 aa, Artificial Sequence
  Synthetic Peptide
GTLEEVPTA

SEQ ID NO: 11657 - protein, 9 aa, Artificial Sequence
  Synthetic Peptide
GASAFPTTI

SEQ ID NO: 11658 - protein, 9 aa, Artificial Sequence
  Synthetic Peptide
STSCILESL

SEQ ID NO: 11659 - protein, 9 aa, Artificial Sequence
  Synthetic Peptide
RAVITKKVA

SEQ ID NO: 11660 - protein, 9 aa, Artificial Sequence
  Synthetic Peptide
ITKKVADLV

SEQ ID NO: 11661 - protein, 9 aa, Artificial Sequence
  Synthetic Peptide
RAREPVTKA

SEQ ID NO: 11662 - protein, 9 aa, Artificial Sequence
  Synthetic Peptide
KAEMLESVI

SEQ ID NO: 11663 - protein, 9 aa, Artificial Sequence
  Synthetic Peptide
KASESLQLV

SEQ ID NO: 11664 - protein, 9 aa, Artificial Sequence
  Synthetic Peptide
PTGHSYVLV

SEQ ID NO: 11665 - protein, 9 aa, Artificial Sequence
  Synthetic Peptide
KTGFLIIVL

SEQ ID NO: 11666 - protein, 9 aa, Artificial Sequence
  Synthetic Peptide
LIIVLVMIA

SEQ ID NO: 11667 - protein, 9 aa, Artificial Sequence
  Synthetic Peptide
IIVLVMIAM

SEQ ID NO: 11668 - protein, 9 aa, Artificial Sequence
  Synthetic Peptide
MIAMEGGHA

SEQ ID NO: 11669 - protein, 9 aa, Artificial Sequence
  Synthetic Peptide
EIWEELSVM

SEQ ID NO: 11670 - protein, 9 aa, Artificial Sequence
  Synthetic Peptide
SAYGEPRKL

SEQ ID NO: 11671 - protein, 9 aa, Artificial Sequence
  Synthetic Peptide
YLEYGRCRT

SEQ ID NO: 11672 - protein, 10 aa, Artificial Sequence
  Synthetic Peptide
EALGLVCVQA

SEQ ID NO: 11673 - protein, 10 aa, Artificial Sequence
  Synthetic Peptide
QAATSSSSPL

SEQ ID NO: 11674 - protein, 10 aa, Artificial Sequence
  Synthetic Peptide
VTKAEMLESV

SEQ ID NO: 11675 - protein, 10 aa, Artificial Sequence
  Synthetic Peptide
EADPTGHSYV

SEQ ID NO: 11676 - protein, 10 aa, Artificial Sequence
  Synthetic Peptide
VLGTLEEVPT

SEQ ID NO: 11677 - protein, 10 aa, Artificial Sequence
  Synthetic Peptide
SAFPTTINFT

SEQ ID NO: 11678 - protein, 10 aa, Artificial Sequence
  Synthetic Peptide
GIDVKEADPT

SEQ ID NO: 11679 - protein, 10 aa, Artificial Sequence
  Synthetic Peptide
PTGHSYVLVT

SEQ ID NO: 11680 - protein, 9 aa, Artificial Sequence
  Synthetic Peptide
FLWGPRALA

SEQ ID NO: 11681 - protein, 9 aa, Artificial Sequence
  Synthetic Peptide
LAETSYVKV

SEQ ID NO: 11682 - protein, 9 aa, Artificial Sequence
  Synthetic Peptide
YVKVLEYVI

SEQ ID NO: 11683 - protein, 9 aa, Artificial Sequence
  Synthetic Peptide
RVRFFFPSL

SEQ ID NO: 11684 - protein, 10 aa, Artificial Sequence
  Synthetic Peptide
LAETSYVKVL

SEQ ID NO: 11685 - protein, 10 aa, Artificial Sequence
  Synthetic Peptide
VLEYVIKVSA

SEQ ID NO: 11686 - protein, 10 aa, Artificial Sequence
  Synthetic Peptide
AALREEEEGV

SEQ ID NO: 11687 - protein, 9 aa, Artificial Sequence
  Synthetic Peptide
SMHCKPEEV

SEQ ID NO: 11688 - protein, 9 aa, Artificial Sequence
  Synthetic Peptide
AMGLVCVQV

SEQ ID NO: 11689 - protein, 9 aa, Artificial Sequence
  Synthetic Peptide
LMLGTLEEV

SEQ ID NO: 11690 - protein, 9 aa, Artificial Sequence
  Synthetic Peptide
LQLVFGIDV

SEQ ID NO: 11691 - protein, 9 aa, Artificial Sequence
  Synthetic Peptide
GLSYDGLLG

SEQ ID NO: 11692 - protein, 9 aa, Artificial Sequence
  Synthetic Peptide
GLSYDGLLV

SEQ ID NO: 11693 - protein, 9 aa, Artificial Sequence
  Synthetic Peptide
LLGDNQIMP

SEQ ID NO: 11694 - protein, 9 aa, Artificial Sequence
  Synthetic Peptide
LLGDNQIMV

SEQ ID NO: 11695 - protein, 9 aa, Artificial Sequence
  Synthetic Peptide
WEELSVMEV

SEQ ID NO: 11696 - protein, 9 aa, Artificial Sequence
  Synthetic Peptide
WMELSVMEV

SEQ ID NO: 11697 - protein, 9 aa, Artificial Sequence
  Synthetic Peptide
RKLLTQDLV

SEQ ID NO: 11698 - protein, 9 aa, Artificial Sequence
  Synthetic Peptide
YEFLWGPRA

SEQ ID NO: 11699 - protein, 9 aa, Artificial Sequence
  Synthetic Peptide
YMFLWGPRV

SEQ ID NO: 11700 - protein, 10 aa, Artificial Sequence
  Synthetic Peptide
AATSSSSPLV

SEQ ID NO: 11701 - protein, 10 aa, Artificial Sequence
  Synthetic Peptide
ATSSSSPLVL

SEQ ID NO: 11702 - protein, 10 aa, Artificial Sequence
  Synthetic Peptide
KMADLVGFLV

SEQ ID NO: 11703 - protein, 10 aa, Artificial Sequence
  Synthetic Peptide
VADLVGFLLL

SEQ ID NO: 11704 - protein, 10 aa, Artificial Sequence
  Synthetic Peptide
SESLQLVFGI

SEQ ID NO: 11705 - protein, 10 aa, Artificial Sequence
  Synthetic Peptide
VMVTCLGLSV

SEQ ID NO: 11706 - protein, 10 aa, Artificial Sequence
  Synthetic Peptide
QIMPKTGFLI

SEQ ID NO: 11707 - protein, 10 aa, Artificial Sequence
  Synthetic Peptide
QMMPKTGFLV

SEQ ID NO: 11708 - protein, 10 aa, Artificial Sequence
  Synthetic Peptide
KTGFLIIVLV

SEQ ID NO: 11709 - protein, 10 aa, Artificial Sequence
  Synthetic Peptide
LIIVLVMIAM

SEQ ID NO: 11710 - protein, 10 aa, Artificial Sequence
  Synthetic Peptide
VMIAMEGGHV

SEQ ID NO: 11711 - protein, 10 aa, Artificial Sequence
  Synthetic Peptide
SAYGEPRKLL

SEQ ID NO: 11712 - protein, 11 aa, Artificial Sequence
  Synthetic Peptide
ALAETSYVKVL

SEQ ID NO: 11713 - protein, 11 aa, Artificial Sequence
  Synthetic Peptide
KMVELVHFLLL

SEQ ID NO: 11714 - protein, 11 aa, Artificial Sequence
  Synthetic Peptide
ELMEVDPIGHL

SEQ ID NO: 11715 - protein, 11 aa, Artificial Sequence
  Synthetic Peptide
HLYIFATCLGL

SEQ ID NO: 11716 - protein, 11 aa, Artificial Sequence
  Synthetic Peptide
LLLKYRAREPV

SEQ ID NO: 11717 - protein, 11 aa, Artificial Sequence
  Synthetic Peptide
QLVFGIELMEV

SEQ ID NO: 11718 - protein, 11 aa, Artificial Sequence
  Synthetic Peptide
IMPKAGLLIIV

SEQ ID NO: 11719 - protein, 13 aa, Artificial Sequence
  Synthetic Peptide
VLVTCLGLSYDGL

SEQ ID NO: 11720 - protein, 13 aa, Artificial Sequence
  Synthetic Peptide
KLLTQDLVQEKYL

SEQ ID NO: 11721 - protein, 13 aa, Artificial Sequence
  Synthetic Peptide
DLVQEKYLEYRQV

SEQ ID NO: 11722 - protein, 15 aa, Artificial Sequence
  Synthetic Peptide
SLFRAVITKKVADLV

SEQ ID NO: 11723 - protein, 15 aa, Artificial Sequence
  Synthetic Peptide
DLESEFQAAISRKMV

SEQ ID NO: 11724 - protein, 15 aa, Artificial Sequence
  Synthetic Peptide
MLGSVVGNWQYFFPV

SEQ ID NO: 11725 - protein, 9 aa, Artificial Sequence
  Synthetic Peptide
GASSFSTTI

SEQ ID NO: 11726 - protein, 9 aa, Artificial Sequence
  Synthetic Peptide
DLESEFQAA

SEQ ID NO: 11727 - protein, 9 aa, Artificial Sequence
  Synthetic Peptide
QAAISRKMV

SEQ ID NO: 11728 - protein, 9 aa, Artificial Sequence
  Synthetic Peptide
KAEMLESVL

SEQ ID NO: 11729 - protein, 9 aa, Artificial Sequence
  Synthetic Peptide
KASEYLQLV

SEQ ID NO: 11730 - protein, 9 aa, Artificial Sequence
  Synthetic Peptide
QLVFGIEVV

SEQ ID NO: 11731 - protein, 9 aa, Artificial Sequence
  Synthetic Peptide
VVPISHLYI

SEQ ID NO: 11732 - protein, 9 aa, Artificial Sequence
  Synthetic Peptide
PISHLYILV

SEQ ID NO: 11733 - protein, 9 aa, Artificial Sequence
  Synthetic Peptide
HLYILVTCL

SEQ ID NO: 11734 - protein, 9 aa, Artificial Sequence
  Synthetic Peptide
YILVTCLGL

SEQ ID NO: 11735 - protein, 9 aa, Artificial Sequence
  Synthetic Peptide
GLLGDNQVM

SEQ ID NO: 11736 - protein, 9 aa, Artificial Sequence
  Synthetic Peptide
QVMPKTGLL

SEQ ID NO: 11737 - protein, 9 aa, Artificial Sequence
  Synthetic Peptide
VMPKTGLLI

SEQ ID NO: 11738 - protein, 9 aa, Artificial Sequence
  Synthetic Peptide
KTGLLIIVL

SEQ ID NO: 11739 - protein, 9 aa, Artificial Sequence
  Synthetic Peptide
GLLIIVLAI

SEQ ID NO: 11740 - protein, 9 aa, Artificial Sequence
  Synthetic Peptide
LLIIVLAII

SEQ ID NO: 11741 - protein, 9 aa, Artificial Sequence
  Synthetic Peptide
LIIVLAIIA

SEQ ID NO: 11742 - protein, 9 aa, Artificial Sequence
  Synthetic Peptide
IIVLAIIAI

SEQ ID NO: 11743 - protein, 9 aa, Artificial Sequence
  Synthetic Peptide
IIAIEGDCA

SEQ ID NO: 11744 - protein, 9 aa, Artificial Sequence
  Synthetic Peptide
GASSLPTTM

SEQ ID NO: 11745 - protein, 9 aa, Artificial Sequence
  Synthetic Peptide
QAALSRKVA

SEQ ID NO: 11746 - protein, 9 aa, Artificial Sequence
  Synthetic Peptide
VAELVHFLL

SEQ ID NO: 11747 - protein, 9 aa, Artificial Sequence
  Synthetic Peptide
KAEMLGSVV

SEQ ID NO: 11748 - protein, 9 aa, Artificial Sequence
  Synthetic Peptide
KASSSLQLV

SEQ ID NO: 11749 - protein, 9 aa, Artificial Sequence
  Synthetic Peptide
QLVFGIELM

SEQ ID NO: 11750 - protein, 9 aa, Artificial Sequence
  Synthetic Peptide
PIGHLYIFA

SEQ ID NO: 11751 - protein, 9 aa, Artificial Sequence
  Synthetic Peptide
IMPKAGLLI

SEQ ID NO: 11752 - protein, 9 aa, Artificial Sequence
  Synthetic Peptide
KAGLLIIVL

SEQ ID NO: 11753 - protein, 9 aa, Artificial Sequence
  Synthetic Peptide
IIAREGDCA

SEQ ID NO: 11754 - protein, 10 aa, Artificial Sequence
  Synthetic Peptide
EALEAQQEAL

SEQ ID NO: 11755 - protein, 10 aa, Artificial Sequence
  Synthetic Peptide
EAQQEALGLV

SEQ ID NO: 11756 - protein, 10 aa, Artificial Sequence
  Synthetic Peptide
DLESEFQAAI

SEQ ID NO: 11757 - protein, 10 aa, Artificial Sequence
  Synthetic Peptide
AAISRKMVEL

SEQ ID NO: 11758 - protein, 10 aa, Artificial Sequence
  Synthetic Peptide
VIFSKASEYL

SEQ ID NO: 11759 - protein, 10 aa, Artificial Sequence
  Synthetic Peptide
YLQLVFGIEV

SEQ ID NO: 11760 - protein, 10 aa, Artificial Sequence
  Synthetic Peptide
LVFGIEVVEV

SEQ ID NO: 11761 - protein, 10 aa, Artificial Sequence
  Synthetic Peptide
GIEVVEVVPI

SEQ ID NO: 11762 - protein, 10 aa, Artificial Sequence
  Synthetic Peptide
VVEVVPISHL

SEQ ID NO: 11763 - protein, 10 aa, Artificial Sequence
  Synthetic Peptide
EVVPISHLYI

SEQ ID NO: 11764 - protein, 10 aa, Artificial Sequence
  Synthetic Peptide
VVPISHLYIL

SEQ ID NO: 11765 - protein, 10 aa, Artificial Sequence
  Synthetic Peptide
PISHLYILVT

SEQ ID NO: 11766 - protein, 10 aa, Artificial Sequence
  Synthetic Peptide
QVMPKTGLLI

SEQ ID NO: 11767 - protein, 10 aa, Artificial Sequence
  Synthetic Peptide
VMPKTGLLII

SEQ ID NO: 11768 - protein, 10 aa, Artificial Sequence
  Synthetic Peptide
KTGLLIIVLA

SEQ ID NO: 11769 - protein, 10 aa, Artificial Sequence
  Synthetic Peptide
GLLIIVLAII

SEQ ID NO: 11770 - protein, 10 aa, Artificial Sequence
  Synthetic Peptide
LLIIVLAIIA

SEQ ID NO: 11771 - protein, 10 aa, Artificial Sequence
  Synthetic Peptide
LIIVLAIIAI

SEQ ID NO: 11772 - protein, 10 aa, Artificial Sequence
  Synthetic Peptide
AIIAIEGDCA

SEQ ID NO: 11773 - protein, 10 aa, Artificial Sequence
  Synthetic Peptide
AALSRKVAEL

SEQ ID NO: 11774 - protein, 10 aa, Artificial Sequence
  Synthetic Peptide
VAELVHFLLL

SEQ ID NO: 11775 - protein, 10 aa, Artificial Sequence
  Synthetic Peptide
VTKAEMLGSV

SEQ ID NO: 11776 - protein, 10 aa, Artificial Sequence
  Synthetic Peptide
GIELMEVDPI

SEQ ID NO: 11777 - protein, 10 aa, Artificial Sequence
  Synthetic Peptide
EVDPIGHLYI

SEQ ID NO: 11778 - protein, 10 aa, Artificial Sequence
  Synthetic Peptide
PIGHLYIFAT

SEQ ID NO: 11779 - protein, 10 aa, Artificial Sequence
  Synthetic Peptide
QIMPKAGLLI

SEQ ID NO: 11780 - protein, 10 aa, Artificial Sequence
  Synthetic Peptide
IMPKAGLLII

SEQ ID NO: 11781 - protein, 10 aa, Artificial Sequence
  Synthetic Peptide
KAGLLIIVLA

SEQ ID NO: 11782 - protein, 10 aa, Artificial Sequence
  Synthetic Peptide
AIIAREGDCA

SEQ ID NO: 11783 - protein, 9 aa, Artificial Sequence
  Synthetic Peptide
FLWGPRALI

SEQ ID NO: 11784 - protein, 9 aa, Artificial Sequence
  Synthetic Peptide
GLEARGEAL

SEQ ID NO: 11785 - protein, 9 aa, Artificial Sequence
  Synthetic Peptide
EARGEALGL

SEQ ID NO: 11786 - protein, 9 aa, Artificial Sequence
  Synthetic Peptide
ALGLVGAQA

SEQ ID NO: 11787 - protein, 9 aa, Artificial Sequence
  Synthetic Peptide
GLVGAQAPA

SEQ ID NO: 11788 - protein, 9 aa, Artificial Sequence
  Synthetic Peptide
LVGAQAPAT

SEQ ID NO: 11789 - protein, 9 aa, Artificial Sequence
  Synthetic Peptide
PATEEQEAA

SEQ ID NO: 11790 - protein, 9 aa, Artificial Sequence
  Synthetic Peptide
EAASSSSTL

SEQ ID NO: 11791 - protein, 9 aa, Artificial Sequence
  Synthetic Peptide
AASSSSTLV

SEQ ID NO: 11792 - protein, 9 aa, Artificial Sequence
  Synthetic Peptide
LVEVTLGEV

SEQ ID NO: 11793 - protein, 9 aa, Artificial Sequence
  Synthetic Peptide
EVTLGEVPA

SEQ ID NO: 11794 - protein, 8 aa, Artificial Sequence
  Synthetic Peptide
VTLEVPAA

SEQ ID NO: 11795 - protein, 9 aa, Artificial Sequence
  Synthetic Peptide
KIWEELSVL

SEQ ID NO: 11796 - protein, 9 aa, Artificial Sequence
  Synthetic Peptide
SILGDPKKL

SEQ ID NO: 11797 - protein, 9 aa, Artificial Sequence
  Synthetic Peptide
ILGDPKKLL

SEQ ID NO: 11798 - protein, 9 aa, Artificial Sequence
  Synthetic Peptide
FLWGPRALV

SEQ ID NO: 11799 - protein, 9 aa, Artificial Sequence
  Synthetic Peptide
RALVETSYV

SEQ ID NO: 11800 - protein, 9 aa, Artificial Sequence
  Synthetic Peptide
LVETSYVKV

SEQ ID NO: 11801 - protein, 9 aa, Artificial Sequence
  Synthetic Peptide
YVKVLHHMV

SEQ ID NO: 11802 - protein, 9 aa, Artificial Sequence
  Synthetic Peptide
KVLHHMVKI

SEQ ID NO: 11803 - protein, 10 aa, Artificial Sequence
  Synthetic Peptide
EARGEALGLV

SEQ ID NO: 11804 - protein, 10 aa, Artificial Sequence
  Synthetic Peptide
EALGLVGAQA

SEQ ID NO: 11805 - protein, 10 aa, Artificial Sequence
  Synthetic Peptide
GLVGAQAPAT

SEQ ID NO: 11806 - protein, 10 aa, Artificial Sequence
  Synthetic Peptide
QAPATEEQEA

SEQ ID NO: 11807 - protein, 10 aa, Artificial Sequence
  Synthetic Peptide
EAASSSSTLV

SEQ ID NO: 11808 - protein, 10 aa, Artificial Sequence
  Synthetic Peptide
TLVEVTLGEV

SEQ ID NO: 11809 - protein, 10 aa, Artificial Sequence
  Synthetic Peptide
EVTLGEVPAA

SEQ ID NO: 11810 - protein, 10 aa, Artificial Sequence
  Synthetic Peptide
EVFEGREDSI

SEQ ID NO: 11811 - protein, 10 aa, Artificial Sequence
  Synthetic Peptide
SILGDPKKLL

SEQ ID NO: 11812 - protein, 10 aa, Artificial Sequence
  Synthetic Peptide
ILGDPKKLLT

SEQ ID NO: 11813 - protein, 10 aa, Artificial Sequence
  Synthetic Peptide
ALVETSYVKV

SEQ ID NO: 11814 - protein, 10 aa, Artificial Sequence
  Synthetic Peptide
LVETSYVKVL

SEQ ID NO: 11815 - protein, 10 aa, Artificial Sequence
  Synthetic Peptide
MVKISGGPHI

SEQ ID NO: 11816 - protein, 9 aa, Artificial Sequence
  Synthetic Peptide
LVLGTLEEV

SEQ ID NO: 11817 - protein, 10 aa, Artificial Sequence
  Synthetic Peptide
KVADLVGFLL

SEQ ID NO: 11818 - protein, 10 aa, Artificial Sequence
  Synthetic Peptide
LVFGIELMEV

SEQ ID NO: 11819 - protein, 9 aa, Artificial Sequence
  Synthetic Peptide
ILLWQPIPV

SEQ ID NO: 11820 - protein, 9 aa, Artificial Sequence
  Synthetic Peptide
EVDPIGHLY

SEQ ID NO: 11821 - protein, 9 aa, Artificial Sequence
  Synthetic Peptide
KMVELVHFL

SEQ ID NO: 11822 - protein, 10 aa, Artificial Sequence
  Synthetic Peptide
KMVELVHFLL

SEQ ID NO: 11823 - protein, 10 aa, Artificial Sequence
  Synthetic Peptide
LVFGIELMEV

SEQ ID NO: 11824 - protein, 9 aa, Artificial Sequence
  Synthetic Peptide
KVAELVHFL

SEQ ID NO: 11825 - protein, 9 aa, Artificial Sequence
  Synthetic Peptide
CILESLFRA

SEQ ID NO: 11826 - protein, 10 aa, Artificial Sequence
  Synthetic Peptide
VMIAMEGGHA

SEQ ID NO: 11827 - protein, 10 aa, Artificial Sequence
  Synthetic Peptide
MLESVIKNYK

SEQ ID NO: 11828 - protein, 10 aa, Artificial Sequence
  Synthetic Peptide
ETSYVKVLEY

SEQ ID NO: 11829 - protein, 9 aa, Artificial Sequence
  Synthetic Peptide
KVLEYVIKV

SEQ ID NO: 11830 - protein, 9 aa, Artificial Sequence
  Synthetic Peptide
FLWGPRALA

SEQ ID NO: 11831 - protein, 9 aa, Artificial Sequence
  Synthetic Peptide
ALREEEEGV

SEQ ID NO: 11832 - protein, 10 aa, Artificial Sequence
  Synthetic Peptide
ALAETSYVKV

SEQ ID NO: 11833 - protein, 9 aa, Artificial Sequence
  Synthetic Peptide
YVIKVSARV

SEQ ID NO: 11834 - protein, 9 aa, Artificial Sequence
  Synthetic Peptide
RALAETSYV

SEQ ID NO: 11835 - protein, 9 aa, Artificial Sequence
  Synthetic Peptide
ALAETSYVK

SEQ ID NO: 11836 - protein, 8 aa, Artificial Sequence
  Synthetic Peptide
VLGTLEEV

SEQ ID NO: 11837 - protein, 8 aa, Artificial Sequence
  Synthetic Peptide
SLQLVFGI

SEQ ID NO: 11838 - protein, 8 aa, Artificial Sequence
  Synthetic Peptide
ILESLFRA

SEQ ID NO: 11839 - protein, 8 aa, Artificial Sequence
  Synthetic Peptide
FLLLKYRA

SEQ ID NO: 11840 - protein, 8 aa, Artificial Sequence
  Synthetic Peptide
GLVCVQAA

SEQ ID NO: 11841 - protein, 8 aa, Artificial Sequence
  Synthetic Peptide
VLVTCLGL

SEQ ID NO: 11842 - protein, 9 aa, Artificial Sequence
  Synthetic Peptide
KVADLVGFL

SEQ ID NO: 11843 - protein, 9 aa, Artificial Sequence
  Synthetic Peptide
YVLVTCLGL

SEQ ID NO: 11844 - protein, 9 aa, Artificial Sequence
  Synthetic Peptide
IMPKTGFLI

SEQ ID NO: 11845 - protein, 9 aa, Artificial Sequence
  Synthetic Peptide
GLLGDNQIM

SEQ ID NO: 11846 - protein, 9 aa, Artificial Sequence
  Synthetic Peptide
GLVCVQAAT

SEQ ID NO: 11847 - protein, 9 aa, Artificial Sequence
  Synthetic Peptide
VADLVGFLL

SEQ ID NO: 11848 - protein, 10 aa, Artificial Sequence
  Synthetic Peptide
YLEYGRCRTV

SEQ ID NO: 11849 - protein, 10 aa, Artificial Sequence
  Synthetic Peptide
SLQLVFGIDV

SEQ ID NO: 11850 - protein, 10 aa, Artificial Sequence
  Synthetic Peptide
IMPKTGFLII

SEQ ID NO: 11851 - protein, 10 aa, Artificial Sequence
  Synthetic Peptide
ALGLVCVQAA

SEQ ID NO: 11852 - protein, 11 aa, Artificial Sequence
  Synthetic Peptide
EIWEELSVMEV

SEQ ID NO: 11853 - protein, 11 aa, Artificial Sequence
  Synthetic Peptide
FLIIVLVMIAM

SEQ ID NO: 11854 - protein, 11 aa, Artificial Sequence
  Synthetic Peptide
VIPHAMSSCGV

SEQ ID NO: 11855 - protein, 11 aa, Artificial Sequence
  Synthetic Peptide
CILESCFRAVI

SEQ ID NO: 11856 - protein, 11 aa, Artificial Sequence
  Synthetic Peptide
QIMPKTGFLII

SEQ ID NO: 11857 - protein, 9 aa, Artificial Sequence
  Synthetic Peptide
GFLLLKYRA

SEQ ID NO: 11858 - protein, 9 aa, Artificial Sequence
  Synthetic Peptide
CFPEIFGKA

SEQ ID NO: 11859 - protein, 9 aa, Artificial Sequence
  Synthetic Peptide
FFFPSLREA

SEQ ID NO: 11860 - protein, 9 aa, Artificial Sequence
  Synthetic Peptide
FFPSLREAA

SEQ ID NO: 11861 - protein, 10 aa, Artificial Sequence
  Synthetic Peptide
RSLHCKPEEA

SEQ ID NO: 11862 - protein, 10 aa, Artificial Sequence
  Synthetic Peptide
EFLWGPRALA

SEQ ID NO: 11863 - protein, 10 aa, Artificial Sequence
  Synthetic Peptide
RFFFPSLREA

SEQ ID NO: 11864 - protein, 10 aa, Artificial Sequence
  Synthetic Peptide
FFFPSLREAA

SEQ ID NO: 11865 - protein, 10 aa, Artificial Sequence
  Synthetic Peptide
ALFLGFLGAA

SEQ ID NO: 11866 - protein, 9 aa, Artificial Sequence
  Synthetic Peptide
MLQLTVWGI

SEQ ID NO: 11867 - protein, 9 aa, Artificial Sequence
  Synthetic Peptide
RVIEVLQRA

SEQ ID NO: 11868 - protein, 9 aa, Artificial Sequence
  Synthetic Peptide
KLTPLCVTL

SEQ ID NO: 11869 - protein, 10 aa, Artificial Sequence
  Synthetic Peptide
LLIAARIVEL

SEQ ID NO: 11870 - protein, 10 aa, Artificial Sequence
  Synthetic Peptide
SLLNATDIAV

SEQ ID NO: 11871 - protein, 9 aa, Artificial Sequence
  Synthetic Peptide
ALFLGFLGA

SEQ ID NO: 11872 - protein, 10 aa, Artificial Sequence
  Synthetic Peptide
HMLQLTVWGI

SEQ ID NO: 11873 - protein, 9 aa, Artificial Sequence
  Synthetic Peptide
LLNATDIAV

SEQ ID NO: 11874 - protein, 9 aa, Artificial Sequence
  Synthetic Peptide
ALLYKLDIV

SEQ ID NO: 11875 - protein, 9 aa, Artificial Sequence
  Synthetic Peptide
WLWYIKIFI

SEQ ID NO: 11876 - protein, 10 aa, Artificial Sequence
  Synthetic Peptide
TIIVHLNESV

SEQ ID NO: 11877 - protein, 9 aa, Artificial Sequence
  Synthetic Peptide
LLQYWSQEL

SEQ ID NO: 11878 - protein, 10 aa, Artificial Sequence
  Synthetic Peptide
IMIVGGLVGL

SEQ ID NO: 11879 - protein, 10 aa, Artificial Sequence
  Synthetic Peptide
LLYKLDIVSI

SEQ ID NO: 11880 - protein, 9 aa, Artificial Sequence
  Synthetic Peptide
FLAIIWVDL

SEQ ID NO: 11881 - protein, 10 aa, Artificial Sequence
  Synthetic Peptide
TLQCKIKQII

SEQ ID NO: 11882 - protein, 10 aa, Artificial Sequence
  Synthetic Peptide
GLVGLRIVFA

SEQ ID NO: 11883 - protein, 9 aa, Artificial Sequence
  Synthetic Peptide
FLGAAGSTM

SEQ ID NO: 11884 - protein, 9 aa, Artificial Sequence
  Synthetic Peptide
IISLWDQSL

SEQ ID NO: 11885 - protein, 10 aa, Artificial Sequence
  Synthetic Peptide
TVWGIKQLQA

SEQ ID NO: 11886 - protein, 9 aa, Artificial Sequence
  Synthetic Peptide
LLGRRGWEV

SEQ ID NO: 11887 - protein, 9 aa, Artificial Sequence
  Synthetic Peptide
AVLSIVNRV

SEQ ID NO: 11888 - protein, 9 aa, Artificial Sequence
  Synthetic Peptide
FIMIVGGLV

SEQ ID NO: 11889 - protein, 10 aa, Artificial Sequence
  Synthetic Peptide
LLNATDIAVA

SEQ ID NO: 11890 - protein, 9 aa, Artificial Sequence
  Synthetic Peptide
FLYGALLLA

SEQ ID NO: 11891 - protein, 9 aa, Artificial Sequence
  Synthetic Peptide
SLLTFMIAA

SEQ ID NO: 11892 - protein, 11 aa, Artificial Sequence
  Synthetic Peptide
FMIAATYNFAV

SEQ ID NO: 11893 - protein, 9 aa, Artificial Sequence
  Synthetic Peptide
RMYGVLPWI

SEQ ID NO: 11894 - protein, 9 aa, Artificial Sequence
  Synthetic Peptide
IAATYNFAV

SEQ ID NO: 11895 - protein, 11 aa, Artificial Sequence
  Synthetic Peptide
GLLECCARCLV

SEQ ID NO: 11896 - protein, 9 aa, Artificial Sequence
  Synthetic Peptide
WALTVVWLL

SEQ ID NO: 11897 - protein, 9 aa, Artificial Sequence
  Synthetic Peptide
ALTVVWLLV

SEQ ID NO: 11898 - protein, 8 aa, Artificial Sequence
  Synthetic Peptide
FLYGALLL

SEQ ID NO: 11899 - protein, 11 aa, Artificial Sequence
  Synthetic Peptide
SLCADARMYGV

SEQ ID NO: 11900 - protein, 9 aa, Artificial Sequence
  Synthetic Peptide
LLVFACSAV

SEQ ID NO: 11901 - protein, 9 aa, Artificial Sequence
  Synthetic Peptide
MMWFVVLTV

SEQ ID NO: 11902 - protein, 9 aa, Artificial Sequence
  Synthetic Peptide
YLLLYFSPV

SEQ ID NO: 11903 - protein, 9 aa, Artificial Sequence
  Synthetic Peptide
YLYRLNFCL

SEQ ID NO: 11904 - protein, 9 aa, Artificial Sequence
  Synthetic Peptide
FMQTYLVTL

SEQ ID NO: 11905 - protein, 9 aa, Artificial Sequence
  Synthetic Peptide
LLWWITILL

SEQ ID NO: 11906 - protein, 9 aa, Artificial Sequence
  Synthetic Peptide
GLWCVLFFV

SEQ ID NO: 11907 - protein, 9 aa, Artificial Sequence
  Synthetic Peptide
LMIRGVLEV

SEQ ID NO: 11908 - protein, 9 aa, Artificial Sequence
  Synthetic Peptide
LLLCRLPFL

SEQ ID NO: 11909 - protein, 10 aa, Artificial Sequence
  Synthetic Peptide
RLLLTSLFFL

SEQ ID NO: 11910 - protein, 9 aa, Artificial Sequence
  Synthetic Peptide
LLLYYDYSL

SEQ ID NO: 11911 - protein, 9 aa, Artificial Sequence
  Synthetic Peptide
AMSRNLFRV

SEQ ID NO: 11912 - protein, 9 aa, Artificial Sequence
  Synthetic Peptide
AMLTACVEV

SEQ ID NO: 11913 - protein, 9 aa, Artificial Sequence
  Synthetic Peptide
RLQPNVPLV

SEQ ID NO: 11914 - protein, 9 aa, Artificial Sequence
  Synthetic Peptide
VLARTFTPV

SEQ ID NO: 11915 - protein, 7 aa, Artificial Sequence
  Synthetic Peptide
RLLRGRL

SEQ ID NO: 11916 - protein, 9 aa, Artificial Sequence
  Synthetic Peptide
WMWFPSVLL

SEQ ID NO: 11917 - protein, 9 aa, Artificial Sequence
  Synthetic Peptide
YLCCGITLL

SEQ ID NO: 11918 - protein, 9 aa, Artificial Sequence
  Synthetic Peptide
DMLGRVFFV

SEQ ID NO: 11919 - protein, 9 aa, Artificial Sequence
  Synthetic Peptide
ALBRYQQLV

SEQ ID NO: 11920 - protein, 9 aa, Artificial Sequence
  Synthetic Peptide
LMPPPVAEL

SEQ ID NO: 11921 - protein, 9 aa, Artificial Sequence
  Synthetic Peptide
LMCRYTPRL

SEQ ID NO: 11922 - protein, 9 aa, Artificial Sequence
  Synthetic Peptide
RLTWRLTWL

SEQ ID NO: 11923 - protein, 9 aa, Artificial Sequence
  Synthetic Peptide
AMPRRVLHA

SEQ ID NO: 11924 - protein, 9 aa, Artificial Sequence
  Synthetic Peptide
ALLLVLALL

SEQ ID NO: 11925 - protein, 9 aa, Artificial Sequence
  Synthetic Peptide
AMSFTFTTL

SEQ ID NO: 11926 - protein, 9 aa, Artificial Sequence
  Synthetic Peptide
MLNVMKEAV

SEQ ID NO: 11927 - protein, 9 aa, Artificial Sequence
  Synthetic Peptide
TMELMIRTV

SEQ ID NO: 11928 - protein, 10 aa, Artificial Sequence
  Synthetic Peptide
TLAAMHYSKL

SEQ ID NO: 11929 - protein, 9 aa, Artificial Sequence
  Synthetic Peptide
TLNIVRDHV

SEQ ID NO: 11930 - protein, 9 aa, Artificial Sequence
  Synthetic Peptide
ELSIFRERL

SEQ ID NO: 11931 - protein, 9 aa, Artificial Sequence
  Synthetic Peptide
FLRVQQKAL

SEQ ID NO: 11932 - protein, 9 aa, Artificial Sequence
  Synthetic Peptide
ELQMMQDWV

SEQ ID NO: 11933 - protein, 9 aa, Artificial Sequence
  Synthetic Peptide
QLNAMKPDL

SEQ ID NO: 11934 - protein, 9 aa, Artificial Sequence
  Synthetic Peptide
GLRQLKGAL

SEQ ID NO: 11935 - protein, 9 aa, Artificial Sequence
  Synthetic Peptide
TLRMSSKAV

SEQ ID NO: 11936 - protein, 9 aa, Artificial Sequence
  Synthetic Peptide
SLRIKRELL

SEQ ID NO: 11937 - protein, 9 aa, Artificial Sequence
  Synthetic Peptide
DLKQMERVV

SEQ ID NO: 11938 - protein, 9 aa, Artificial Sequence
  Synthetic Peptide
PLRVTPSDL

SEQ ID NO: 11939 - protein, 9 aa, Artificial Sequence
  Synthetic Peptide
QLDYEKQVL

SEQ ID NO: 11940 - protein, 9 aa, Artificial Sequence
  Synthetic Peptide
WLKLLRDAL

SEQ ID NO: 11941 - protein, 9 aa, Artificial Sequence
  Synthetic Peptide
PMEAVRHPL

SEQ ID NO: 11942 - protein, 9 aa, Artificial Sequence
  Synthetic Peptide
ELKQTRVNL

SEQ ID NO: 11943 - protein, 9 aa, Artificial Sequence
  Synthetic Peptide
NLEVIHDAL

SEQ ID NO: 11944 - protein, 8 aa, Artificial Sequence
  Synthetic Peptide
ELKKVSVL

SEQ ID NO: 11945 - protein, 9 aa, Artificial Sequence
  Synthetic Peptide
PLAYERDKL

SEQ ID NO: 11946 - protein, 9 aa, Artificial Sequence
  Synthetic Peptide
FLLSLGIHL

SEQ ID NO: 11947 - protein, 9 aa, Artificial Sequence
  Synthetic Peptide
GLYSSTVPV

SEQ ID NO: 11948 - protein, 9 aa, Artificial Sequence
  Synthetic Peptide
HLYSHPIIL

SEQ ID NO: 11949 - protein, 9 aa, Artificial Sequence
  Synthetic Peptide
WILRGTSFV

SEQ ID NO: 11950 - protein, 9 aa, Artificial Sequence
  Synthetic Peptide
NLSWLSLDV

SEQ ID NO: 11951 - protein, 9 aa, Artificial Sequence
  Synthetic Peptide
LLSSNLSWL

SEQ ID NO: 11952 - protein, 9 aa, Artificial Sequence
  Synthetic Peptide
NLQSLTNLL

SEQ ID NO: 11953 - protein, 9 aa, Artificial Sequence
  Synthetic Peptide
HLLVGSSGL

SEQ ID NO: 11954 - protein, 9 aa, Artificial Sequence
  Synthetic Peptide
LLDDEAGPL

SEQ ID NO: 11955 - protein, 9 aa, Artificial Sequence
  Synthetic Peptide
PLEEELPRL

SEQ ID NO: 11956 - protein, 9 aa, Artificial Sequence
  Synthetic Peptide
DLNLGNLNV

SEQ ID NO: 11957 - protein, 9 aa, Artificial Sequence
  Synthetic Peptide
NLYVSLLLL

SEQ ID NO: 11958 - protein, 9 aa, Artificial Sequence
  Synthetic Peptide
PLPIHTAEL

SEQ ID NO: 11959 - protein, 9 aa, Artificial Sequence
  Synthetic Peptide
FLLSLGIHL

SEQ ID NO: 11960 - protein, 9 aa, Artificial Sequence
  Synthetic Peptide
GLYSSTVPV

SEQ ID NO: 11961 - protein, 9 aa, Artificial Sequence
  Synthetic Peptide
HLYSHPIIL

SEQ ID NO: 11962 - protein, 9 aa, Artificial Sequence
  Synthetic Peptide
WILRGTSFV

SEQ ID NO: 11963 - protein, 9 aa, Artificial Sequence
  Synthetic Peptide
NLSWLSLDV

SEQ ID NO: 11964 - protein, 9 aa, Artificial Sequence
  Synthetic Peptide
LLSSNLSWL

SEQ ID NO: 11965 - protein, 9 aa, Artificial Sequence
  Synthetic Peptide
NLQSLTNLL

SEQ ID NO: 11966 - protein, 9 aa, Artificial Sequence
  Synthetic Peptide
HLLVGSSGL

SEQ ID NO: 11967 - protein, 9 aa, Artificial Sequence
  Synthetic Peptide
LLDDEAGPL

SEQ ID NO: 11968 - protein, 9 aa, Artificial Sequence
  Synthetic Peptide
PLEEELPRL

SEQ ID NO: 11969 - protein, 9 aa, Artificial Sequence
  Synthetic Peptide
DLNLGNLNV

SEQ ID NO: 11970 - protein, 9 aa, Artificial Sequence
  Synthetic Peptide
NLYVSLLLL

SEQ ID NO: 11971 - protein, 9 aa, Artificial Sequence
  Synthetic Peptide
PLPIHTAEL

SEQ ID NO: 11972 - protein, 9 aa, Artificial Sequence
  Synthetic Peptide
KIFGSLAFL

SEQ ID NO: 11973 - protein, 10 aa, Artificial Sequence
  Synthetic Peptide
RILHNGAYSL

SEQ ID NO: 11974 - protein, 10 aa, Artificial Sequence
  Synthetic Peptide
IISAVVGILL

SEQ ID NO: 11975 - protein, 9 aa, Artificial Sequence
  Synthetic Peptide
MMWFVVLTV

SEQ ID NO: 11976 - protein, 9 aa, Artificial Sequence
  Synthetic Peptide
YLLLYFSPV

SEQ ID NO: 11977 - protein, 9 aa, Artificial Sequence
  Synthetic Peptide
YLYRLNFCL

SEQ ID NO: 11978 - protein, 9 aa, Artificial Sequence
  Synthetic Peptide
FMWTYLVTL

SEQ ID NO: 11979 - protein, 9 aa, Artificial Sequence
  Synthetic Peptide
LLWWITILL

SEQ ID NO: 11980 - protein, 9 aa, Artificial Sequence
  Synthetic Peptide
GLWCVLFFV

SEQ ID NO: 11981 - protein, 9 aa, Artificial Sequence
  Synthetic Peptide
LMIRGVLEV

SEQ ID NO: 11982 - protein, 9 aa, Artificial Sequence
  Synthetic Peptide
LLLCRLPFL

SEQ ID NO: 11983 - protein, 9 aa, Artificial Sequence
  Synthetic Peptide
AMSRNLFRV

SEQ ID NO: 11984 - protein, 9 aa, Artificial Sequence
  Synthetic Peptide
AMLTACVEV

SEQ ID NO: 11985 - protein, 9 aa, Artificial Sequence
  Synthetic Peptide
RLQPNVPLV

SEQ ID NO: 11986 - protein, 9 aa, Artificial Sequence
  Synthetic Peptide
VLARTFTPV

SEQ ID NO: 11987 - protein, 9 aa, Artificial Sequence
  Synthetic Peptide
RLLRGLIRL

SEQ ID NO: 11988 - protein, 9 aa, Artificial Sequence
  Synthetic Peptide
WMWFPSVLL

SEQ ID NO: 11989 - protein, 9 aa, Artificial Sequence
  Synthetic Peptide
YLCCGITLL

SEQ ID NO: 11990 - protein, 10 aa, Artificial Sequence
  Synthetic Peptide
SLLTEVETYV

SEQ ID NO: 11991 - protein, 9 aa, Artificial Sequence
  Synthetic Peptide
LLTEVETYV

SEQ ID NO: 11992 - protein, 10 aa, Artificial Sequence
  Synthetic Peptide
LLTEVETYVL

SEQ ID NO: 11993 - protein, 9 aa, Artificial Sequence
  Synthetic Peptide
GILGFVFTL

SEQ ID NO: 11994 - protein, 10 aa, Artificial Sequence
  Synthetic Peptide
GILGFVFTLT

SEQ ID NO: 11995 - protein, 9 aa, Artificial Sequence
  Synthetic Peptide
ILGFVFTLT

SEQ ID NO: 11996 - protein, 10 aa, Artificial Sequence
  Synthetic Peptide
ILGFVFTLTV

SEQ ID NO: 11997 - protein, 9 aa, Artificial Sequence
  Synthetic Peptide
ALASCMGLI

SEQ ID NO: 11998 - protein, 9 aa, Artificial Sequence
  Synthetic Peptide
RMGAVTTEV

SEQ ID NO: 11999 - protein, 9 aa, Artificial Sequence
  Synthetic Peptide
VTTEVAFGL

SEQ ID NO: 12000 - protein, 9 aa, Artificial Sequence
  Synthetic Peptide
MVTTTNPLI

SEQ ID NO: 12001 - protein, 9 aa, Artificial Sequence
  Synthetic Peptide
FTFSPTYKA

SEQ ID NO: 12002 - protein, 10 aa, Artificial Sequence
  Synthetic Peptide
YLHTLWKAGI

SEQ ID NO: 12003 - protein, 10 aa, Artificial Sequence
  Synthetic Peptide
LMLQAGFFLV

SEQ ID NO: 12004 - protein, 9 aa, Artificial Sequence
  Synthetic Peptide
RMLTIPQSV

SEQ ID NO: 12005 - protein, 9 aa, Artificial Sequence
  Synthetic Peptide
SLDSWWTSV

SEQ ID NO: 12006 - protein, 10 aa, Artificial Sequence
  Synthetic Peptide
FMLLLCLIFL

SEQ ID NO: 12007 - protein, 9 aa, Artificial Sequence
  Synthetic Peptide
LLPFVQWFV

SEQ ID NO: 12008 - protein, 9 aa, Artificial Sequence
  Synthetic Peptide
LMPFVQWFV

SEQ ID NO: 12009 - protein, 10 aa, Artificial Sequence
  Synthetic Peptide
FLGLSPTVWV

SEQ ID NO: 12010 - protein, 10 aa, Artificial Sequence
  Synthetic Peptide
SMLSPFLPLV

SEQ ID NO: 12011 - protein, 9 aa, Artificial Sequence
  Synthetic Peptide
GLWIRTPPV

SEQ ID NO: 12012 - protein, 9 aa, Artificial Sequence
  Synthetic Peptide
NLGNLNVSV

SEQ ID NO: 12013 - protein, 10 aa, Artificial Sequence
  Synthetic Peptide
YLHTLWKAGV

SEQ ID NO: 12014 - protein, 9 aa, Artificial Sequence
  Synthetic Peptide
RLTGGVFLV

SEQ ID NO: 12015 - protein, 9 aa, Artificial Sequence
  Synthetic Peptide
RMTGGVFLV

SEQ ID NO: 12016 - protein, 9 aa, Artificial Sequence
  Synthetic Peptide
RLTGGVFLV

SEQ ID NO: 12017 - protein, 9 aa, Artificial Sequence
  Synthetic Peptide
ILGLLGFAV

SEQ ID NO: 12018 - protein, 9 aa, Artificial Sequence
  Synthetic Peptide
GLCQVFADV

SEQ ID NO: 12019 - protein, 9 aa, Artificial Sequence
  Synthetic Peptide
WLLRGTSFV

SEQ ID NO: 12020 - protein, 9 aa, Artificial Sequence
  Synthetic Peptide
YLPSALNPV

SEQ ID NO: 12021 - protein, 10 aa, Artificial Sequence
  Synthetic Peptide
LLVPFVQWFA

SEQ ID NO: 12022 - protein, 10 aa, Artificial Sequence
  Synthetic Peptide
FLPSDFFPSI

SEQ ID NO: 12023 - protein, 9 aa, Artificial Sequence
  Synthetic Peptide
VVSYVNVNM

SEQ ID NO: 12024 - protein, 9 aa, Artificial Sequence
  Synthetic Peptide
HLPDRVHFA

SEQ ID NO: 12025 - protein, 9 aa, Artificial Sequence
  Synthetic Peptide
SLAFSAVPA

SEQ ID NO: 12026 - protein, 9 aa, Artificial Sequence
  Synthetic Peptide
FLLTKILTI

SEQ ID NO: 12027 - protein, 10 aa, Artificial Sequence
  Synthetic Peptide
SLYNILSPFM

SEQ ID NO: 12028 - protein, 9 aa, Artificial Sequence
  Synthetic Peptide
CLFHIVNLI

SEQ ID NO: 12029 - protein, 9 aa, Artificial Sequence
  Synthetic Peptide
RLPDRVHFA

SEQ ID NO: 12030 - protein, 9 aa, Artificial Sequence
  Synthetic Peptide
ALPPASPSA

SEQ ID NO: 12031 - protein, 9 aa, Artificial Sequence
  Synthetic Peptide
GLLGWSPQA

SEQ ID NO: 12032 - protein, 10 aa, Artificial Sequence
  Synthetic Peptide
FLGPLLVLQA

SEQ ID NO: 12033 - protein, 9 aa, Artificial Sequence
  Synthetic Peptide
FLLTRILTI

SEQ ID NO: 12034 - protein, 9 aa, Artificial Sequence
  Synthetic Peptide
GMLPVCPLI

SEQ ID NO: 12035 - protein, 9 aa, Artificial Sequence
  Synthetic Peptide
QLFHLCLII

SEQ ID NO: 12036 - protein, 10 aa, Artificial Sequence
  Synthetic Peptide
KLCLGWLWGM

SEQ ID NO: 12037 - protein, 10 aa, Artificial Sequence
  Synthetic Peptide
LLWFHISCLI

SEQ ID NO: 12038 - protein, 9 aa, Artificial Sequence
  Synthetic Peptide
YLVSFGVWI

SEQ ID NO: 12039 - protein, 9 aa, Artificial Sequence
  Synthetic Peptide
LLEDWGPCA

SEQ ID NO: 12040 - protein, 9 aa, Artificial Sequence
  Synthetic Peptide
KLHLYSHPI

SEQ ID NO: 12041 - protein, 9 aa, Artificial Sequence
  Synthetic Peptide
FLLAQFTSA

SEQ ID NO: 12042 - protein, 9 aa, Artificial Sequence
  Synthetic Peptide
LLAQFTSAI

SEQ ID NO: 12043 - protein, 9 aa, Artificial Sequence
  Synthetic Peptide
YMDDVVLGA

SEQ ID NO: 12044 - protein, 9 aa, Artificial Sequence
  Synthetic Peptide
ALMPLYACI

SEQ ID NO: 12045 - protein, 9 aa, Artificial Sequence
  Synthetic Peptide
GLCQVFADA

SEQ ID NO: 12046 - protein, 9 aa, Artificial Sequence
  Synthetic Peptide
HLPDLVHFA

SEQ ID NO: 12047 - protein, 9 aa, Artificial Sequence
  Synthetic Peptide
RLCCQLDPA

SEQ ID NO: 12048 - protein, 9 aa, Artificial Sequence
  Synthetic Peptide
ALMPLYACI

SEQ ID NO: 12049 - protein, 9 aa, Artificial Sequence
  Synthetic Peptide
FLCKQYLNL

SEQ ID NO: 12050 - protein, 9 aa, Artificial Sequence
  Synthetic Peptide
SLYADSPSV

SEQ ID NO: 12051 - protein, 9 aa, Artificial Sequence
  Synthetic Peptide
ALMPLYASI

SEQ ID NO: 12052 - protein, 9 aa, Artificial Sequence
  Synthetic Peptide
NLNNLNVSI

SEQ ID NO: 12053 - protein, 9 aa, Artificial Sequence
  Synthetic Peptide
ALSLIVNLL

SEQ ID NO: 12054 - protein, 9 aa, Artificial Sequence
  Synthetic Peptide
KLHLYSHPI

SEQ ID NO: 12055 - protein, 9 aa, Artificial Sequence
  Synthetic Peptide
WILRGTSFV

SEQ ID NO: 12056 - protein, 10 aa, Artificial Sequence
  Synthetic Peptide
LVLQAGFFLL

SEQ ID NO: 12057 - protein, 10 aa, Artificial Sequence
  Synthetic Peptide
FILLLCLIFL

SEQ ID NO: 12058 - protein, 9 aa, Artificial Sequence
  Synthetic Peptide
WILRGTSFV

SEQ ID NO: 12059 - protein, 9 aa, Artificial Sequence
  Synthetic Peptide
IISCTCPTV

SEQ ID NO: 12060 - protein, 9 aa, Artificial Sequence
  Synthetic Peptide
LVPFVQWFV

SEQ ID NO: 12061 - protein, 10 aa, Artificial Sequence
  Synthetic Peptide
LIISCSCPTV

SEQ ID NO: 12062 - protein, 10 aa, Artificial Sequence
  Synthetic Peptide
FLPSDFFPSI

SEQ ID NO: 12063 - protein, 10 aa, Artificial Sequence
  Synthetic Peptide
LLCLGWLWGM

SEQ ID NO: 12064 - protein, 9 aa, Artificial Sequence
  Synthetic Peptide
QLFHLCLII

SEQ ID NO: 12065 - protein, 10 aa, Artificial Sequence
  Synthetic Peptide
CLGWLTGMDI

SEQ ID NO: 12066 - protein, 9 aa, Artificial Sequence
  Synthetic Peptide
FLGGTTVCL

SEQ ID NO: 12067 - protein, 10 aa, Artificial Sequence
  Synthetic Peptide
SLYSILSPFL

SEQ ID NO: 12068 - protein, 10 aa, Artificial Sequence
  Synthetic Peptide
FLPSDFFPSV

SEQ ID NO: 12069 - protein, 10 aa, Artificial Sequence
  Synthetic Peptide
ILCWGELMTL

SEQ ID NO: 12070 - protein, 10 aa, Artificial Sequence
  Synthetic Peptide
LMTLATWVGV

SEQ ID NO: 12071 - protein, 10 aa, Artificial Sequence
  Synthetic Peptide
TLATWVGVNL

SEQ ID NO: 12072 - protein, 9 aa, Artificial Sequence
  Synthetic Peptide
GLSRYVARL

SEQ ID NO: 12073 - protein, 9 aa, Artificial Sequence
  Synthetic Peptide
FLCKQYLNL

SEQ ID NO: 12074 - protein, 10 aa, Artificial Sequence
  Synthetic Peptide
RMRGTFSAPL

SEQ ID NO: 12075 - protein, 9 aa, Artificial Sequence
  Synthetic Peptide
SLYADSPSV

SEQ ID NO: 12076 - protein, 9 aa, Artificial Sequence
  Synthetic Peptide
YLYGVGSAV

SEQ ID NO: 12077 - protein, 9 aa, Artificial Sequence
  Synthetic Peptide
LLSTTEWQV

SEQ ID NO: 12078 - protein, 9 aa, Artificial Sequence
  Synthetic Peptide
IIGAETFYV

SEQ ID NO: 12079 - protein, 10 aa, Artificial Sequence
  Synthetic Peptide
QLWVTVYYGV

SEQ ID NO: 12080 - protein, 10 aa, Artificial Sequence
  Synthetic Peptide
NLWVTVYYGV

SEQ ID NO: 12081 - protein, 10 aa, Artificial Sequence
  Synthetic Peptide
KLWVTVYYGV

SEQ ID NO: 12082 - protein, 10 aa, Artificial Sequence
  Synthetic Peptide
KLWVTVYYGV

SEQ ID NO: 12083 - protein, 9 aa, Artificial Sequence
  Synthetic Peptide
YMLDLQPET

SEQ ID NO: 12084 - protein, 8 aa, Artificial Sequence
  Synthetic Peptide
TLGIVCPI

SEQ ID NO: 12085 - protein, 9 aa, Artificial Sequence
  Synthetic Peptide
YLLDLQEPV

SEQ ID NO: 12086 - protein, 9 aa, Artificial Sequence
  Synthetic Peptide
YMLDLQPEV

SEQ ID NO: 12087 - protein, 9 aa, Artificial Sequence
  Synthetic Peptide
MLDLQPETT

SEQ ID NO: 12088 - protein, 15 aa, Artificial Sequence
  Synthetic Peptide
SLQDIEITCVYCKTV

SEQ ID NO: 12089 - protein, 9 aa, Artificial Sequence
  Synthetic Peptide
RLLTSLFFL

SEQ ID NO: 12090 - protein, 9 aa, Artificial Sequence
  Synthetic Peptide
RLLTSLFFL

SEQ ID NO: 12091 - protein, 9 aa, Artificial Sequence
  Synthetic Peptide
LLLYYDYSL

SEQ ID NO: 12092 - protein, 9 aa, Artificial Sequence
  Synthetic Peptide
DMLGRVFFV

SEQ ID NO: 12093 - protein, 9 aa, Artificial Sequence
  Synthetic Peptide
TMFEALPHI

SEQ ID NO: 12094 - protein, 9 aa, Artificial Sequence
  Synthetic Peptide
ALISFLLLA

SEQ ID NO: 12095 - protein, 9 aa, Artificial Sequence
  Synthetic Peptide
TLMSIVSSL

SEQ ID NO: 12096 - protein, 9 aa, Artificial Sequence
  Synthetic Peptide
NISGYNFSL

SEQ ID NO: 12097 - protein, 9 aa, Artificial Sequence
  Synthetic Peptide
ALLDGGNML

SEQ ID NO: 12098 - protein, 9 aa, Artificial Sequence
  Synthetic Peptide
ALHLFKTTV

SEQ ID NO: 12099 - protein, 9 aa, Artificial Sequence
  Synthetic Peptide
SLISDQLLM

SEQ ID NO: 12100 - protein, 9 aa, Artificial Sequence
  Synthetic Peptide
WLVTNGSYL

SEQ ID NO: 12101 - protein, 9 aa, Artificial Sequence
  Synthetic Peptide
ALMDLLMFS

SEQ ID NO: 12102 - protein, 9 aa, Artificial Sequence
  Synthetic Peptide
LMDLLMFST

SEQ ID NO: 12103 - protein, 9 aa, Artificial Sequence
  Synthetic Peptide
LMFSTSAYL

SEQ ID NO: 12104 - protein, 9 aa, Artificial Sequence
  Synthetic Peptide
YLVSIFLHL

SEQ ID NO: 12105 - protein, 9 aa, Artificial Sequence
  Synthetic Peptide
SLHCKPEEA

SEQ ID NO: 12106 - protein, 9 aa, Artificial Sequence
  Synthetic Peptide
ALGLVCVQA

SEQ ID NO: 12107 - protein, 9 aa, Artificial Sequence
  Synthetic Peptide
LVLGTLEEV

SEQ ID NO: 12108 - protein, 9 aa, Artificial Sequence
  Synthetic Peptide
GTLEEVPTA

SEQ ID NO: 12109 - protein, 9 aa, Artificial Sequence
  Synthetic Peptide
CILESLFRA

SEQ ID NO: 12110 - protein, 10 aa, Artificial Sequence
  Synthetic Peptide
KVADLVGFLL

SEQ ID NO: 12111 - protein, 11 aa, Artificial Sequence
  Synthetic Peptide
KVADLVGFLLL

SEQ ID NO: 12112 - protein, 10 aa, Artificial Sequence
  Synthetic Peptide
VMIAMEGGHA

SEQ ID NO: 12113 - protein, 9 aa, Artificial Sequence
  Synthetic Peptide
SMHCKPEEV

SEQ ID NO: 12114 - protein, 9 aa, Artificial Sequence
  Synthetic Peptide
AMGLVCVQV

SEQ ID NO: 12115 - protein, 9 aa, Artificial Sequence
  Synthetic Peptide
LMLGTLEEV

SEQ ID NO: 12116 - protein, 10 aa, Artificial Sequence
  Synthetic Peptide
KMADLVGFLV

SEQ ID NO: 12117 - protein, 10 aa, Artificial Sequence
  Synthetic Peptide
VMVTCLGLSV

SEQ ID NO: 12118 - protein, 9 aa, Artificial Sequence
  Synthetic Peptide
LLGDNQIMV

SEQ ID NO: 12119 - protein, 10 aa, Artificial Sequence
  Synthetic Peptide
QMMPKTGFLV

SEQ ID NO: 12120 - protein, 10 aa, Artificial Sequence
  Synthetic Peptide
VMIAMEGGHV

SEQ ID NO: 12121 - protein, 9 aa, Artificial Sequence
  Synthetic Peptide
WMELSVMEV

SEQ ID NO: 12122 - protein, 9 aa, Artificial Sequence
  Synthetic Peptide
FLWGPRALA

SEQ ID NO: 12123 - protein, 9 aa, Artificial Sequence
  Synthetic Peptide
RALAETSYV

SEQ ID NO: 12124 - protein, 11 aa, Artificial Sequence
  Synthetic Peptide
ALAETSYVKVL

SEQ ID NO: 12125 - protein, 10 aa, Artificial Sequence
  Synthetic Peptide
ALAETSYVKV

SEQ ID NO: 12126 - protein, 9 aa, Artificial Sequence
  Synthetic Peptide
KVLEYVIKV

SEQ ID NO: 12127 - protein, 9 aa, Artificial Sequence
  Synthetic Peptide
YVIKVSARV

SEQ ID NO: 12128 - protein, 9 aa, Artificial Sequence
  Synthetic Peptide
ALREEEEGV

SEQ ID NO: 12129 - protein, 9 aa, Artificial Sequence
  Synthetic Peptide
YMFLWGPRV

SEQ ID NO: 12130 - protein, 11 aa, Artificial Sequence
  Synthetic Peptide
KMVELVHFLLL

SEQ ID NO: 12131 - protein, 9 aa, Artificial Sequence
  Synthetic Peptide
KMVELVHFL

SEQ ID NO: 12132 - protein, 10 aa, Artificial Sequence
  Synthetic Peptide
KMVELVHFLL

SEQ ID NO: 12133 - protein, 9 aa, Artificial Sequence
  Synthetic Peptide
KASEYLQLV

SEQ ID NO: 12134 - protein, 10 aa, Artificial Sequence
  Synthetic Peptide
YLQLVFGIEV

SEQ ID NO: 12135 - protein, 10 aa, Artificial Sequence
  Synthetic Peptide
LVFGIEVVEV

SEQ ID NO: 12136 - protein, 11 aa, Artificial Sequence
  Synthetic Peptide
QLVFGIELMEV

SEQ ID NO: 12137 - protein, 9 aa, Artificial Sequence
  Synthetic Peptide
KVAELVHFL

SEQ ID NO: 12138 - protein, 10 aa, Artificial Sequence
  Synthetic Peptide
KVAELVHFLL

SEQ ID NO: 12139 - protein, 11 aa, Artificial Sequence
  Synthetic Peptide
ELMEVDPIGHL

SEQ ID NO: 12140 - protein, 11 aa, Artificial Sequence
  Synthetic Peptide
HLYIFATCLGL

SEQ ID NO: 12141 - protein, 11 aa, Artificial Sequence
  Synthetic Peptide
IMPKAGLLIIV

SEQ ID NO: 12142 - protein, 10 aa, Artificial Sequence
  Synthetic Peptide
LVFGIELMEV

SEQ ID NO: 12143 - protein, 9 aa, Artificial Sequence
  Synthetic Peptide
ALGRNSFEV

SEQ ID NO: 12144 - protein, 9 aa, Artificial Sequence
  Synthetic Peptide
LLGANSFEV

SEQ ID NO: 12145 - protein, 9 aa, Artificial Sequence
  Synthetic Peptide
LLGRASFEV

SEQ ID NO: 12146 - protein, 9 aa, Artificial Sequence
  Synthetic Peptide
LLGRNAFEV

SEQ ID NO: 12147 - protein, 9 aa, Artificial Sequence
  Synthetic Peptide
LLGRNSFAV

SEQ ID NO: 12148 - protein, 9 aa, Artificial Sequence
  Synthetic Peptide
RLGRNSFEV

SEQ ID NO: 12149 - protein, 9 aa, Artificial Sequence
  Synthetic Peptide
LLGRRSFEV

SEQ ID NO: 12150 - protein, 9 aa, Artificial Sequence
  Synthetic Peptide
LLGRNSFRV

SEQ ID NO: 12151 - protein, 10 aa, Artificial Sequence
  Synthetic Peptide
LLFFWLDRSV

SEQ ID NO: 12152 - protein, 9 aa, Artificial Sequence
  Synthetic Peptide
VLAKELKFV

SEQ ID NO: 12153 - protein, 9 aa, Artificial Sequence
  Synthetic Peptide
ILLWQPIPV

SEQ ID NO: 12154 - protein, 10 aa, Artificial Sequence
  Synthetic Peptide
IMYSAHDTTV

SEQ ID NO: 12155 - protein, 9 aa, Artificial Sequence
  Synthetic Peptide
FLTLSVTWI

SEQ ID NO: 12156 - protein, 11 aa, Artificial Sequence
  Synthetic Peptide
FLTLSVTWIGA

SEQ ID NO: 12157 - protein, 9 aa, Artificial Sequence
  Synthetic Peptide
FLTLSVTWI

SEQ ID NO: 12158 - protein, 11 aa, Artificial Sequence
  Synthetic Peptide
VLVHPQWVLTA

SEQ ID NO: 12159 - protein, 11 aa, Artificial Sequence
  Synthetic Peptide
SLFHPEDTGQV

SEQ ID NO: 12160 - protein, 11 aa, Artificial Sequence
  Synthetic Peptide
MLLRLSEPAEL

SEQ ID NO: 12161 - protein, 8 aa, Artificial Sequence
  Synthetic Peptide
ALGTTCYA

SEQ ID NO: 12162 - protein, 10 aa, Artificial Sequence
  Synthetic Peptide
KLQCVDLHVI

SEQ ID NO: 12163 - protein, 10 aa, Artificial Sequence
  Synthetic Peptide
FLPSDYFPSV

SEQ ID NO: 12164 - protein, 12 aa, Artificial Sequence
  Synthetic Peptide
YSFLPSDFFPSV

SEQ ID NO: 12165 - protein, 10 aa, Artificial Sequence
  Synthetic Peptide
ALFLGFLGAA

SEQ ID NO: 12166 - protein, 9 aa, Artificial Sequence
  Synthetic Peptide
MLQLTVWGI

SEQ ID NO: 12167 - protein, 9 aa, Artificial Sequence
  Synthetic Peptide
RVIEVLQRA

SEQ ID NO: 12168 - protein, 9 aa, Artificial Sequence
  Synthetic Peptide
KLTPLCVTL

SEQ ID NO: 12169 - protein, 10 aa, Artificial Sequence
  Synthetic Peptide
LLIAARIVEL

SEQ ID NO: 12170 - protein, 10 aa, Artificial Sequence
  Synthetic Peptide
SLLNATDIAV

SEQ ID NO: 12171 - protein, 9 aa, Artificial Sequence
  Synthetic Peptide
ALFLGFLGA

SEQ ID NO: 12172 - protein, 10 aa, Artificial Sequence
  Synthetic Peptide
HMLQLTVWGI

SEQ ID NO: 12173 - protein, 9 aa, Artificial Sequence
  Synthetic Peptide
LLNATDIAV

SEQ ID NO: 12174 - protein, 9 aa, Artificial Sequence
  Synthetic Peptide
ALLYKLDIV

SEQ ID NO: 12175 - protein, 9 aa, Artificial Sequence
  Synthetic Peptide
WLWYIKIFI

SEQ ID NO: 12176 - protein, 10 aa, Artificial Sequence
  Synthetic Peptide
TIIVHLNESV

SEQ ID NO: 12177 - protein, 9 aa, Artificial Sequence
  Synthetic Peptide
LLQYWSQEL

SEQ ID NO: 12178 - protein, 10 aa, Artificial Sequence
  Synthetic Peptide
IMIVGGLVGL

SEQ ID NO: 12179 - protein, 10 aa, Artificial Sequence
  Synthetic Peptide
LLYKLDIVSI

SEQ ID NO: 12180 - protein, 9 aa, Artificial Sequence
  Synthetic Peptide
FLAIIWVDL

SEQ ID NO: 12181 - protein, 10 aa, Artificial Sequence
  Synthetic Peptide
TLQCKIKQII

SEQ ID NO: 12182 - protein, 10 aa, Artificial Sequence
  Synthetic Peptide
GLVGLRIVFA

SEQ ID NO: 12183 - protein, 9 aa, Artificial Sequence
  Synthetic Peptide
FLGAAGSTM

SEQ ID NO: 12184 - protein, 9 aa, Artificial Sequence
  Synthetic Peptide
IISLWDQSL

SEQ ID NO: 12185 - protein, 10 aa, Artificial Sequence
  Synthetic Peptide
TVWGIKQLQA

SEQ ID NO: 12186 - protein, 9 aa, Artificial Sequence
  Synthetic Peptide
LLGRRGWEV

SEQ ID NO: 12187 - protein, 9 aa, Artificial Sequence
  Synthetic Peptide
AVLSIVNRV

SEQ ID NO: 12188 - protein, 9 aa, Artificial Sequence
  Synthetic Peptide
FIMIVGGLV

SEQ ID NO: 12189 - protein, 10 aa, Artificial Sequence
  Synthetic Peptide
LLNATDIAVA

SEQ ID NO: 12190 - protein, 9 aa, Artificial Sequence
  Synthetic Peptide
FLYGALLLA

SEQ ID NO: 12191 - protein, 9 aa, Artificial Sequence
  Synthetic Peptide
SLLTFMIAA

SEQ ID NO: 12192 - protein, 11 aa, Artificial Sequence
  Synthetic Peptide
FMIAATYNFAV

SEQ ID NO: 12193 - protein, 9 aa, Artificial Sequence
  Synthetic Peptide
RMYGVLPWI

SEQ ID NO: 12194 - protein, 9 aa, Artificial Sequence
  Synthetic Peptide
IAATYNFAV

SEQ ID NO: 12195 - protein, 11 aa, Artificial Sequence
  Synthetic Peptide
GLLECCARCLV

SEQ ID NO: 12196 - protein, 9 aa, Artificial Sequence
  Synthetic Peptide
YALTVVWLL

SEQ ID NO: 12197 - protein, 9 aa, Artificial Sequence
  Synthetic Peptide
ALTVVWLLV

SEQ ID NO: 12198 - protein, 8 aa, Artificial Sequence
  Synthetic Peptide
FLYGALLL

SEQ ID NO: 12199 - protein, 11 aa, Artificial Sequence
  Synthetic Peptide
SLCADARMYGV

SEQ ID NO: 12200 - protein, 9 aa, Artificial Sequence
  Synthetic Peptide
LLVFACSAV

SEQ ID NO: 12201 - protein, 10 aa, Artificial Sequence
  Synthetic Peptide
KMVELVHFLL

SEQ ID NO: 12202 - protein, 9 aa, Artificial Sequence
  Synthetic Peptide
KVAELVHFL

SEQ ID NO: 12203 - protein, 9 aa, Artificial Sequence
  Synthetic Peptide
RALAETSYV

SEQ ID NO: 12204 - protein, 10 aa, Artificial Sequence
  Synthetic Peptide
LVFGIELMEV

SEQ ID NO: 12205 - protein, 9 aa, Artificial Sequence
  Synthetic Peptide
FLWGPRALA

SEQ ID NO: 12206 - protein, 10 aa, Artificial Sequence
  Synthetic Peptide
ALAETSYVKV

SEQ ID NO: 12207 - protein, 9 aa, Artificial Sequence
  Synthetic Peptide
LVLGTLEEV

SEQ ID NO: 12208 - protein, 10 aa, Artificial Sequence
  Synthetic Peptide
LLWKGEGAVV

SEQ ID NO: 12209 - protein, 9 aa, Artificial Sequence
  Synthetic Peptide
IIGAETFYV

SEQ ID NO: 12210 - protein, 9 aa, Artificial Sequence
  Synthetic Peptide
LMVTVYYGV

SEQ ID NO: 12211 - protein, 10 aa, Artificial Sequence
  Synthetic Peptide
LLFNILGGWV

SEQ ID NO: 12212 - protein, 10 aa, Artificial Sequence
  Synthetic Peptide
LLALLSCLTV

SEQ ID NO: 12213 - protein, 9 aa, Artificial Sequence
  Synthetic Peptide
YLVAYQATV

SEQ ID NO: 12214 - protein, 9 aa, Artificial Sequence
  Synthetic Peptide
FLLLADARV

SEQ ID NO: 12215 - protein, 9 aa, Artificial Sequence
  Synthetic Peptide
ILAGYGAGV

SEQ ID NO: 12216 - protein, 10 aa, Artificial Sequence
  Synthetic Peptide
YLLPRRGPRL

SEQ ID NO: 12217 - protein, 10 aa, Artificial Sequence
  Synthetic Peptide
GLLGCIITSL

SEQ ID NO: 12218 - protein, 9 aa, Artificial Sequence
  Synthetic Peptide
DLMGYIPLV

SEQ ID NO: 12219 - protein, 10 aa, Artificial Sequence
  Synthetic Peptide
LLALLSCLTI

SEQ ID NO: 12220 - protein, 10 aa, Artificial Sequence
  Synthetic Peptide
VLAALAAYCL

SEQ ID NO: 12221 - protein, 10 aa, Artificial Sequence
  Synthetic Peptide
LLVPFVQWFV

SEQ ID NO: 12222 - protein, 9 aa, Artificial Sequence
  Synthetic Peptide
FLLAQFTSA

SEQ ID NO: 12223 - protein, 9 aa, Artificial Sequence
  Synthetic Peptide
FLLSLGIHL

SEQ ID NO: 12224 - protein, 9 aa, Artificial Sequence
  Synthetic Peptide
ALMPLYACI

SEQ ID NO: 12225 - protein, 10 aa, Artificial Sequence
  Synthetic Peptide
ILLLCLIFLL

SEQ ID NO: 12226 - protein, 10 aa, Artificial Sequence
  Synthetic Peptide
LLPIFFCLWV

SEQ ID NO: 12227 - protein, 10 aa, Artificial Sequence
  Synthetic Peptide
YLHTLWKAGI

SEQ ID NO: 12228 - protein, 10 aa, Artificial Sequence
  Synthetic Peptide
YLHTLWKAGV

SEQ ID NO: 12229 - protein, 9 aa, Artificial Sequence
  Synthetic Peptide
LLECCARCL

SEQ ID NO: 12230 - protein, 9 aa, Artificial Sequence
  Synthetic Peptide
GLCFFGVAL

SEQ ID NO: 12231 - protein, 9 aa, Artificial Sequence
  Synthetic Peptide
ALTGTEKLI

SEQ ID NO: 12232 - protein, 9 aa, Artificial Sequence
  Synthetic Peptide
SLERVCHCL

SEQ ID NO: 12233 - protein, 10 aa, Artificial Sequence
  Synthetic Peptide
LWLGHPDKFV

SEQ ID NO: 12234 - protein, 9 aa, Artificial Sequence
  Synthetic Peptide
ALTVVWLLV

SEQ ID NO: 12235 - protein, 9 aa, Artificial Sequence
  Synthetic Peptide
LLVFACSAV

SEQ ID NO: 12236 - protein, 9 aa, Artificial Sequence
  Synthetic Peptide
RMYGVLPWI

SEQ ID NO: 12237 - protein, 10 aa, Artificial Sequence
  Synthetic Peptide
GLLECCARCL

SEQ ID NO: 12238 - protein, 10 aa, Artificial Sequence
  Synthetic Peptide
LLECCARCLV

SEQ ID NO: 12239 - protein, 10 aa, Artificial Sequence
  Synthetic Peptide
CLVGAPFASL

SEQ ID NO: 12240 - protein, 10 aa, Artificial Sequence
  Synthetic Peptide
WLLVFACSAV

SEQ ID NO: 12241 - protein, 10 aa, Artificial Sequence
  Synthetic Peptide
TLVSLLTFMI

SEQ ID NO: 12242 - protein, 9 aa, Artificial Sequence
  Synthetic Peptide
VIHAFQYVI

SEQ ID NO: 12243 - protein, 9 aa, Artificial Sequence
  Synthetic Peptide
FLYGALLLA

SEQ ID NO: 12244 - protein, 9 aa, Artificial Sequence
  Synthetic Peptide
YALTVVWLL

SEQ ID NO: 12245 - protein, 9 aa, Artificial Sequence
  Synthetic Peptide
WLLVFACSA

SEQ ID NO: 12246 - protein, 9 aa, Artificial Sequence
  Synthetic Peptide
QMTFHLFIA

SEQ ID NO: 12247 - protein, 9 aa, Artificial Sequence
  Synthetic Peptide
LVSLLTFMI

SEQ ID NO: 12248 - protein, 9 aa, Artificial Sequence
  Synthetic Peptide
SLLTFMIAA

SEQ ID NO: 12249 - protein, 9 aa, Artificial Sequence
  Synthetic Peptide
IAATYNFAV

SEQ ID NO: 12250 - protein, 11 aa, Artificial Sequence
  Synthetic Peptide
ALLLLAEGFYT

SEQ ID NO: 12251 - protein, 10 aa, Artificial Sequence
  Synthetic Peptide
YALTVVWLLV

SEQ ID NO: 12252 - protein, 10 aa, Artificial Sequence
  Synthetic Peptide
LVFACSAVPV

SEQ ID NO: 12253 - protein, 10 aa, Artificial Sequence
  Synthetic Peptide
KVCGSNLLSI

SEQ ID NO: 12254 - protein, 10 aa, Artificial Sequence
  Synthetic Peptide
SLLTFMIAAT

SEQ ID NO: 12255 - protein, 9 aa, Artificial Sequence
  Synthetic Peptide
ALMGPLGLL

SEQ ID NO: 12256 - protein, 9 aa, Artificial Sequence
  Synthetic Peptide
GLLGQIGPL

SEQ ID NO: 12257 - protein, 9 aa, Artificial Sequence
  Synthetic Peptide
GMLGQKGEI

SEQ ID NO: 12258 - protein, 9 aa, Artificial Sequence
  Synthetic Peptide
PLGQDGLPV

SEQ ID NO: 12259 - protein, 10 aa, Artificial Sequence
  Synthetic Peptide
TLALMGPLGL

SEQ ID NO: 12260 - protein, 10 aa, Artificial Sequence
  Synthetic Peptide
MLGQKGEIGL

SEQ ID NO: 12261 - protein, 10 aa, Artificial Sequence
  Synthetic Peptide
PLGKDGPPGV

SEQ ID NO: 12262 - protein, 10 aa, Artificial Sequence
  Synthetic Peptide
PLGLPGASGL

SEQ ID NO: 12263 - protein, 9 aa, Artificial Sequence
  Synthetic Peptide
GLAGQRGIV

SEQ ID NO: 12264 - protein, 9 aa, Artificial Sequence
  Synthetic Peptide
VMQGPMGPM

SEQ ID NO: 12265 - protein, 9 aa, Artificial Sequence
  Synthetic Peptide
SLEEKSRLV

SEQ ID NO: 12266 - protein, 9 aa, Artificial Sequence
  Synthetic Peptide
FLLEVVDIL

SEQ ID NO: 12267 - protein, 9 aa, Artificial Sequence
  Synthetic Peptide
LLEVVDILL

SEQ ID NO: 12268 - protein, 9 aa, Artificial Sequence
  Synthetic Peptide
GMEGFNLEL

SEQ ID NO: 12269 - protein, 9 aa, Artificial Sequence
  Synthetic Peptide
ELSDHPESL

SEQ ID NO: 12270 - protein, 9 aa, Artificial Sequence
  Synthetic Peptide
ILVDCRDTL

SEQ ID NO: 12271 - protein, 9 aa, Artificial Sequence
  Synthetic Peptide
QLSTGLDII

SEQ ID NO: 12272 - protein, 9 aa, Artificial Sequence
  Synthetic Peptide
TLKKMREIV

SEQ ID NO: 12273 - protein, 9 aa, Artificial Sequence
  Synthetic Peptide
GMAAVPKLV

SEQ ID NO: 12274 - protein, 9 aa, Artificial Sequence
  Synthetic Peptide
ALGFGTDNV

SEQ ID NO: 12275 - protein, 9 aa, Artificial Sequence
  Synthetic Peptide
VLLQCSAIL

SEQ ID NO: 12276 - protein, 9 aa, Artificial Sequence
  Synthetic Peptide
LLQCSAILV

SEQ ID NO: 12277 - protein, 9 aa, Artificial Sequence
  Synthetic Peptide
ILVKEKGIL

SEQ ID NO: 12278 - protein, 9 aa, Artificial Sequence
  Synthetic Peptide
LMWKAKGTV

SEQ ID NO: 12279 - protein, 9 aa, Artificial Sequence
  Synthetic Peptide
KLHKVAPKI

SEQ ID NO: 12280 - protein, 9 aa, Artificial Sequence
  Synthetic Peptide
MMESGTTMV

SEQ ID NO: 12281 - protein, 9 aa, Artificial Sequence
  Synthetic Peptide
FLIEEIERL

SEQ ID NO: 12282 - protein, 10 aa, Artificial Sequence
  Synthetic Peptide
KLGLKICGFL

SEQ ID NO: 12283 - protein, 10 aa, Artificial Sequence
  Synthetic Peptide
FLLEVVDILL

SEQ ID NO: 12284 - protein, 10 aa, Artificial Sequence
  Synthetic Peptide
VLDFHHPHQL

SEQ ID NO: 12285 - protein, 10 aa, Artificial Sequence
  Synthetic Peptide
LLEGMEGFNL

SEQ ID NO: 12286 - protein, 10 aa, Artificial Sequence
  Synthetic Peptide
NMFTYEIAPV

SEQ ID NO: 12287 - protein, 10 aa, Artificial Sequence
  Synthetic Peptide
GMAAVPKLVL

SEQ ID NO: 12288 - protein, 10 aa, Artificial Sequence
  Synthetic Peptide
ALGFGTDNVI

SEQ ID NO: 12289 - protein, 10 aa, Artificial Sequence
  Synthetic Peptide
ILEAKQKGYV

SEQ ID NO: 12290 - protein, 10 aa, Artificial Sequence
  Synthetic Peptide
LMSRKHRHKL

SEQ ID NO: 12291 - protein, 10 aa, Artificial Sequence
  Synthetic Peptide
VLLQCSAILV

SEQ ID NO: 12292 - protein, 10 aa, Artificial Sequence
  Synthetic Peptide
LLQPDKQYDV

SEQ ID NO: 12293 - protein, 10 aa, Artificial Sequence
  Synthetic Peptide
WLMWKAKGTV

SEQ ID NO: 12294 - protein, 10 aa, Artificial Sequence
  Synthetic Peptide
ELAEYLYAKI

SEQ ID NO: 12295 - protein, 10 aa, Artificial Sequence
  Synthetic Peptide
LMMESGTTMV

SEQ ID NO: 12296 - protein, 9 aa, Artificial Sequence
  Synthetic Peptide
GAISNMYSI

SEQ ID NO: 12297 - protein, 9 aa, Artificial Sequence
  Synthetic Peptide
NLWLHVDAA

SEQ ID NO: 12298 - protein, 9 aa, Artificial Sequence
  Synthetic Peptide
RMVISNPAA

SEQ ID NO: 12299 - protein, 10 aa, Artificial Sequence
  Synthetic Peptide
AALGFGTDNV

SEQ ID NO: 12300 - protein, 10 aa, Artificial Sequence
  Synthetic Peptide
MMGVLLQCSA

SEQ ID NO: 12301 - protein, 10 aa, Artificial Sequence
  Synthetic Peptide
ILQGCNQMCA

SEQ ID NO: 12302 - protein, 8 aa, Artificial Sequence
  Synthetic Peptide
TLGIVCPI

SEQ ID NO: 12303 - protein, 9 aa, Artificial Sequence
  Synthetic Peptide
TLGIVCPIC

SEQ ID NO: 12304 - protein, 9 aa, Artificial Sequence
  Synthetic Peptide
GTLGIVCPI

SEQ ID NO: 12305 - protein, 10 aa, Artificial Sequence
  Synthetic Peptide
YMLDLQPETT

SEQ ID NO: 12306 - protein, 9 aa, Artificial Sequence
  Synthetic Peptide
YMLDLQPET

SEQ ID NO: 12307 - protein, 9 aa, Artificial Sequence
  Synthetic Peptide
MLDLQPETT

SEQ ID NO: 12308 - protein, 9 aa, Artificial Sequence
  Synthetic Peptide
FAFRDLCIV

SEQ ID NO: 12309 - protein, 9 aa, Artificial Sequence
  Synthetic Peptide
LLMGTLGIV

SEQ ID NO: 12310 - protein, 10 aa, Artificial Sequence
  Synthetic Peptide
TIHDIILECV

SEQ ID NO: 12311 - protein, 9 aa, Artificial Sequence
  Synthetic Peptide
TLHEYMLDL

SEQ ID NO: 12312 - protein, 9 aa, Artificial Sequence
  Synthetic Peptide
KLPQLCTEL

SEQ ID NO: 12313 - protein, 9 aa, Artificial Sequence
  Synthetic Peptide
AMFQDPQER

SEQ ID NO: 12314 - protein, 9 aa, Artificial Sequence
  Synthetic Peptide
LQTTIHDII

SEQ ID NO: 12315 - protein, 9 aa, Artificial Sequence
  Synthetic Peptide
HVDIRTLED

SEQ ID NO: 12316 - protein, 9 aa, Artificial Sequence
  Synthetic Peptide
ILSPFLPLL

SEQ ID NO: 12317 - protein, 9 aa, Artificial Sequence
  Synthetic Peptide
TLQDIVLHL

SEQ ID NO: 12318 - protein, 9 aa, Artificial Sequence
  Synthetic Peptide
WLSLLVPFV

SEQ ID NO: 12319 - protein, 9 aa, Artificial Sequence
  Synthetic Peptide
FLLSLGIHL

SEQ ID NO: 12320 - protein, 9 aa, Artificial Sequence
  Synthetic Peptide
QLFEDNYAL

SEQ ID NO: 12321 - protein, 9 aa, Artificial Sequence
  Synthetic Peptide
LMVTVYYGV

SEQ ID NO: 12322 - protein, 9 aa, Artificial Sequence
  Synthetic Peptide
MMWFWGTSL

SEQ ID NO: 12323 - protein, 8 aa, Artificial Sequence
  Synthetic Peptide
MMWWGPSL

SEQ ID NO: 12324 - protein, 9 aa, Artificial Sequence
  Synthetic Peptide
FLTKQYLNL

SEQ ID NO: 12325 - protein, 9 aa, Artificial Sequence
  Synthetic Peptide
ILHNGAYSL

SEQ ID NO: 12326 - protein, 9 aa, Artificial Sequence
  Synthetic Peptide
LLLCLIFLL

SEQ ID NO: 12327 - protein, 9 aa, Artificial Sequence
  Synthetic Peptide
GLYSSTVPV

SEQ ID NO: 12328 - protein, 9 aa, Artificial Sequence
  Synthetic Peptide
HLYSHPIIL

SEQ ID NO: 12329 - protein, 9 aa, Artificial Sequence
  Synthetic Peptide
RMPEAAPPV

SEQ ID NO: 12330 - protein, 9 aa, Artificial Sequence
  Synthetic Peptide
LLMGTLGIV

SEQ ID NO: 12331 - protein, 9 aa, Artificial Sequence
  Synthetic Peptide
ILSPFMPLL

SEQ ID NO: 12332 - protein, 9 aa, Artificial Sequence
  Synthetic Peptide
YLVAYQATV

SEQ ID NO: 12333 - protein, 9 aa, Artificial Sequence
  Synthetic Peptide
VLLDYQGML

SEQ ID NO: 12334 - protein, 9 aa, Artificial Sequence
  Synthetic Peptide
VLAEAMSQV

SEQ ID NO: 12335 - protein, 9 aa, Artificial Sequence
  Synthetic Peptide
KLLQETELV

SEQ ID NO: 12336 - protein, 9 aa, Artificial Sequence
  Synthetic Peptide
SLYAVSPSV

SEQ ID NO: 12337 - protein, 9 aa, Artificial Sequence
  Synthetic Peptide
DLMGYIPLV

SEQ ID NO: 12338 - protein, 9 aa, Artificial Sequence
  Synthetic Peptide
LLCLIFLLV

SEQ ID NO: 12339 - protein, 9 aa, Artificial Sequence
  Synthetic Peptide
FLCQQYLHL

SEQ ID NO: 12340 - protein, 9 aa, Artificial Sequence
  Synthetic Peptide
NLYVSLMLL

SEQ ID NO: 12341 - protein, 9 aa, Artificial Sequence
  Synthetic Peptide
GMLPVCPLL

SEQ ID NO: 12342 - protein, 9 aa, Artificial Sequence
  Synthetic Peptide
ILPCSFTTL

SEQ ID NO: 12343 - protein, 9 aa, Artificial Sequence
  Synthetic Peptide
ALSTGLIHL

SEQ ID NO: 12344 - protein, 9 aa, Artificial Sequence
  Synthetic Peptide
ILLLCLIFL

SEQ ID NO: 12345 - protein, 9 aa, Artificial Sequence
  Synthetic Peptide
HLYQGCQVV

SEQ ID NO: 12346 - protein, 9 aa, Artificial Sequence
  Synthetic Peptide
CLTSTVQLV

SEQ ID NO: 12347 - protein, 9 aa, Artificial Sequence
  Synthetic Peptide
PLLPIFFCL

SEQ ID NO: 12348 - protein, 9 aa, Artificial Sequence
  Synthetic Peptide
ALCRWGLLL

SEQ ID NO: 12349 - protein, 9 aa, Artificial Sequence
  Synthetic Peptide
VLIQRNPQL

SEQ ID NO: 12350 - protein, 10 aa, Artificial Sequence
  Synthetic Peptide
QVLQACFFLL

SEQ ID NO: 12351 - protein, 9 aa, Artificial Sequence
  Synthetic Peptide
LLWFHISCL

SEQ ID NO: 12352 - protein, 9 aa, Artificial Sequence
  Synthetic Peptide
ILAGYGAGV

SEQ ID NO: 12353 - protein, 9 aa, Artificial Sequence
  Synthetic Peptide
QLMPYGCLL

SEQ ID NO: 12354 - protein, 9 aa, Artificial Sequence
  Synthetic Peptide
LLWKGEGAV

SEQ ID NO: 12355 - protein, 9 aa, Artificial Sequence
  Synthetic Peptide
FLGGTPVCL

SEQ ID NO: 12356 - protein, 9 aa, Artificial Sequence
  Synthetic Peptide
ALIHHNTHL

SEQ ID NO: 12357 - protein, 9 aa, Artificial Sequence
  Synthetic Peptide
VLVHPQWVL

SEQ ID NO: 12358 - protein, 9 aa, Artificial Sequence
  Synthetic Peptide
KLQCVDLHV

SEQ ID NO: 12359 - protein, 9 aa, Artificial Sequence
  Synthetic Peptide
VLPCSFTTL

SEQ ID NO: 12360 - protein, 9 aa, Artificial Sequence
  Synthetic Peptide
HLHQNIVDV

SEQ ID NO: 12361 - protein, 9 aa, Artificial Sequence
  Synthetic Peptide
SMVGNWAKV

SEQ ID NO: 12362 - protein, 9 aa, Artificial Sequence
  Synthetic Peptide
LLGRNSFEV

SEQ ID NO: 12363 - protein, 9 aa, Artificial Sequence
  Synthetic Peptide
GLYRPLLSL

SEQ ID NO: 12364 - protein, 9 aa, Artificial Sequence
  Synthetic Peptide
GLYRPLLRL

SEQ ID NO: 12365 - protein, 9 aa, Artificial Sequence
  Synthetic Peptide
NLSWLSLDV

SEQ ID NO: 12366 - protein, 9 aa, Artificial Sequence
  Synthetic Peptide
FLLLADARV

SEQ ID NO: 12367 - protein, 9 aa, Artificial Sequence
  Synthetic Peptide
YLVTRHADV

SEQ ID NO: 12368 - protein, 9 aa, Artificial Sequence
  Synthetic Peptide
CLTHIVNLL

SEQ ID NO: 12369 - protein, 9 aa, Artificial Sequence
  Synthetic Peptide
ELMNLATWV

SEQ ID NO: 12370 - protein, 9 aa, Artificial Sequence
  Synthetic Peptide
KLPDLCTEL

SEQ ID NO: 12371 - protein, 9 aa, Artificial Sequence
  Synthetic Peptide
ALQDSGLEV

SEQ ID NO: 12372 - protein, 9 aa, Artificial Sequence
  Synthetic Peptide
LLSSDLSWL

SEQ ID NO: 12373 - protein, 8 aa, Artificial Sequence
  Synthetic Peptide
ALAHGVRL

SEQ ID NO: 12374 - protein, 9 aa, Artificial Sequence
  Synthetic Peptide
TLHGPTPLL

SEQ ID NO: 12375 - protein, 9 aa, Artificial Sequence
  Synthetic Peptide
KLLRGTKAL

SEQ ID NO: 12376 - protein, 9 aa, Artificial Sequence
  Synthetic Peptide
CMSADLEVV

SEQ ID NO: 12377 - protein, 9 aa, Artificial Sequence
  Synthetic Peptide
GLLCPLLVL

SEQ ID NO: 12378 - protein, 9 aa, Artificial Sequence
  Synthetic Peptide
TLHEYMLDL

SEQ ID NO: 12379 - protein, 8 aa, Artificial Sequence
  Synthetic Peptide
KLLPENVL

SEQ ID NO: 12380 - protein, 10 aa, Artificial Sequence
  Synthetic Peptide
EILKEPVHGV

SEQ ID NO: 12381 - protein, 9 aa, Artificial Sequence
  Synthetic Peptide
RLGLYRPLL

SEQ ID NO: 12382 - protein, 9 aa, Artificial Sequence
  Synthetic Peptide
GLPRYVARL

SEQ ID NO: 12383 - protein, 9 aa, Artificial Sequence
  Synthetic Peptide
KLIGTDNSV

SEQ ID NO: 12384 - protein, 9 aa, Artificial Sequence
  Synthetic Peptide
FLLALLSCL

SEQ ID NO: 12385 - protein, 9 aa, Artificial Sequence
  Synthetic Peptide
LLSSNLSWL

SEQ ID NO: 12386 - protein, 9 aa, Artificial Sequence
  Synthetic Peptide
QLLRIPQAV

SEQ ID NO: 12387 - protein, 9 aa, Artificial Sequence
  Synthetic Peptide
GLRDLAVAV

SEQ ID NO: 12388 - protein, 9 aa, Artificial Sequence
  Synthetic Peptide
TLNAWVKVI

SEQ ID NO: 12389 - protein, 9 aa, Artificial Sequence
  Synthetic Peptide
NLQSLTNLL

SEQ ID NO: 12390 - protein, 9 aa, Artificial Sequence
  Synthetic Peptide
QLGRKPTPL

SEQ ID NO: 12391 - protein, 9 aa, Artificial Sequence
  Synthetic Peptide
SLDSWWTSL

SEQ ID NO: 12392 - protein, 9 aa, Artificial Sequence
  Synthetic Peptide
ILSKTGDPV

SEQ ID NO: 12393 - protein, 9 aa, Artificial Sequence
  Synthetic Peptide
ILLVVVLGV

SEQ ID NO: 12394 - protein, 9 aa, Artificial Sequence
  Synthetic Peptide
LLHKRTLGL

SEQ ID NO: 12395 - protein, 9 aa, Artificial Sequence
  Synthetic Peptide
CLFKDWEEL

SEQ ID NO: 12396 - protein, 9 aa, Artificial Sequence
  Synthetic Peptide
GLGISWLGL

SEQ ID NO: 12397 - protein, 9 aa, Artificial Sequence
  Synthetic Peptide
HLLVGSSBL

SEQ ID NO: 12398 - protein, 9 aa, Artificial Sequence
  Synthetic Peptide
TLEEITGYL

SEQ ID NO: 12399 - protein, 9 aa, Artificial Sequence
  Synthetic Peptide
PLTSIISAV

SEQ ID NO: 12400 - protein, 8 aa, Artificial Sequence
  Synthetic Peptide
LLGIITSL

SEQ ID NO: 12401 - protein, 9 aa, Artificial Sequence
  Synthetic Peptide
ALNKMFCQL

SEQ ID NO: 12402 - protein, 9 aa, Artificial Sequence
  Synthetic Peptide
HLEGKIILV

SEQ ID NO: 12403 - protein, 9 aa, Artificial Sequence
  Synthetic Peptide
QLRSLTIEL

SEQ ID NO: 12404 - protein, 9 aa, Artificial Sequence
  Synthetic Peptide
DLAVAVEPV

SEQ ID NO: 12405 - protein, 9 aa, Artificial Sequence
  Synthetic Peptide
VLHKRTLGL

SEQ ID NO: 12406 - protein, 9 aa, Artificial Sequence
  Synthetic Peptide
FLCILLLCL

SEQ ID NO: 12407 - protein, 9 aa, Artificial Sequence
  Synthetic Peptide
LLDPRVRGL

SEQ ID NO: 12408 - protein, 9 aa, Artificial Sequence
  Synthetic Peptide
KLPQLCTEL

SEQ ID NO: 12409 - protein, 9 aa, Artificial Sequence
  Synthetic Peptide
HLEGKVILV

SEQ ID NO: 12410 - protein, 9 aa, Artificial Sequence
  Synthetic Peptide
EMMTACQGV

SEQ ID NO: 12411 - protein, 9 aa, Artificial Sequence
  Synthetic Peptide
HLALQDSGL

SEQ ID NO: 12412 - protein, 9 aa, Artificial Sequence
  Synthetic Peptide
VLGVVPGIL

SEQ ID NO: 12413 - protein, 9 aa, Artificial Sequence
  Synthetic Peptide
TLNAWVKVV

SEQ ID NO: 12414 - protein, 9 aa, Artificial Sequence
  Synthetic Peptide
HLESLYAAV

SEQ ID NO: 12415 - protein, 9 aa, Artificial Sequence
  Synthetic Peptide
CLIRLKPTL

SEQ ID NO: 12416 - protein, 8 aa, Artificial Sequence
  Synthetic Peptide
CLGSYDGL

SEQ ID NO: 12417 - protein, 9 aa, Artificial Sequence
  Synthetic Peptide
HLSLRGLPV

SEQ ID NO: 12418 - protein, 9 aa, Artificial Sequence
  Synthetic Peptide
ILESLFRAV

SEQ ID NO: 12419 - protein, 9 aa, Artificial Sequence
  Synthetic Peptide
TLTCGFACL

SEQ ID NO: 12420 - protein, 9 aa, Artificial Sequence
  Synthetic Peptide
TLPALSTGL

SEQ ID NO: 12421 - protein, 9 aa, Artificial Sequence
  Synthetic Peptide
ALAIPQCRL

SEQ ID NO: 12422 - protein, 9 aa, Artificial Sequence
  Synthetic Peptide
DLCGSVFLV

SEQ ID NO: 12423 - protein, 9 aa, Artificial Sequence
  Synthetic Peptide
RLCVQSTHV

SEQ ID NO: 12424 - protein, 9 aa, Artificial Sequence
  Synthetic Peptide
LLDDEAGPL

SEQ ID NO: 12425 - protein, 9 aa, Artificial Sequence
  Synthetic Peptide
CLRRFIIFL

SEQ ID NO: 12426 - protein, 9 aa, Artificial Sequence
  Synthetic Peptide
GLPVCQDHL

SEQ ID NO: 12427 - protein, 9 aa, Artificial Sequence
  Synthetic Peptide
PLEEELPRL

SEQ ID NO: 12428 - protein, 9 aa, Artificial Sequence
  Synthetic Peptide
PLLYRLGAV

SEQ ID NO: 12429 - protein, 9 aa, Artificial Sequence
  Synthetic Peptide
ELAENREIL

SEQ ID NO: 12430 - protein, 9 aa, Artificial Sequence
  Synthetic Peptide
ELQAIHLAL

SEQ ID NO: 12431 - protein, 9 aa, Artificial Sequence
  Synthetic Peptide
LIPRRGPRL

SEQ ID NO: 12432 - protein, 9 aa, Artificial Sequence
  Synthetic Peptide
NLGKVIDTL

SEQ ID NO: 12433 - protein, 9 aa, Artificial Sequence
  Synthetic Peptide
PLGGAARAL

SEQ ID NO: 12434 - protein, 9 aa, Artificial Sequence
  Synthetic Peptide
DLLDTASAL

SEQ ID NO: 12435 - protein, 9 aa, Artificial Sequence
  Synthetic Peptide
QLKQSRLGL

SEQ ID NO: 12436 - protein, 9 aa, Artificial Sequence
  Synthetic Peptide
CLQPQQGSL

SEQ ID NO: 12437 - protein, 9 aa, Artificial Sequence
  Synthetic Peptide
PLDGEYFTL

SEQ ID NO: 12438 - protein, 9 aa, Artificial Sequence
  Synthetic Peptide
VLKDAIKDL

SEQ ID NO: 12439 - protein, 9 aa, Artificial Sequence
  Synthetic Peptide
QLCYQDTIL

SEQ ID NO: 12440 - protein, 9 aa, Artificial Sequence
  Synthetic Peptide
DLNTMLNTV

SEQ ID NO: 12441 - protein, 9 aa, Artificial Sequence
  Synthetic Peptide
ELHPDKWTV

SEQ ID NO: 12442 - protein, 9 aa, Artificial Sequence
  Synthetic Peptide
ELKKIICQV

SEQ ID NO: 12443 - protein, 9 aa, Artificial Sequence
  Synthetic Peptide
ELVVSYVNV

SEQ ID NO: 12444 - protein, 9 aa, Artificial Sequence
  Synthetic Peptide
CLTPGRETV

SEQ ID NO: 12445 - protein, 9 aa, Artificial Sequence
  Synthetic Peptide
DLNLGNLNV

SEQ ID NO: 12446 - protein, 9 aa, Artificial Sequence
  Synthetic Peptide
LLVVVLGVV

SEQ ID NO: 12447 - protein, 9 aa, Artificial Sequence
  Synthetic Peptide
NMGLKIRQL

SEQ ID NO: 12448 - protein, 9 aa, Artificial Sequence
  Synthetic Peptide
SLRELGSGL

SEQ ID NO: 12449 - protein, 9 aa, Artificial Sequence
  Synthetic Peptide
DLLEKGERL

SEQ ID NO: 12450 - protein, 9 aa, Artificial Sequence
  Synthetic Peptide
DLVDAEEYL

SEQ ID NO: 12451 - protein, 10 aa, Artificial Sequence
  Synthetic Peptide
PLEEELPIIL

SEQ ID NO: 12452 - protein, 9 aa, Artificial Sequence
  Synthetic Peptide
DLQHGRLVL

SEQ ID NO: 12453 - protein, 9 aa, Artificial Sequence
  Synthetic Peptide
PLPGPLGAL

SEQ ID NO: 12454 - protein, 9 aa, Artificial Sequence
  Synthetic Peptide
LLTQIGCTL

SEQ ID NO: 12455 - protein, 9 aa, Artificial Sequence
  Synthetic Peptide
PLVKLWYQL

SEQ ID NO: 12456 - protein, 9 aa, Artificial Sequence
  Synthetic Peptide
FLFILLLCL

SEQ ID NO: 12457 - protein, 9 aa, Artificial Sequence
  Synthetic Peptide
NLYVSLLLL

SEQ ID NO: 12458 - protein, 9 aa, Artificial Sequence
  Synthetic Peptide
PLQPEQLQV

SEQ ID NO: 12459 - protein, 9 aa, Artificial Sequence
  Synthetic Peptide
DLAARNVLV

SEQ ID NO: 12460 - protein, 9 aa, Artificial Sequence
  Synthetic Peptide
VLVKSPNHV

SEQ ID NO: 12461 - protein, 9 aa, Artificial Sequence
  Synthetic Peptide
TLSPGKNGV

SEQ ID NO: 12462 - protein, 9 aa, Artificial Sequence
  Synthetic Peptide
DLSWLSLDV

SEQ ID NO: 12463 - protein, 9 aa, Artificial Sequence
  Synthetic Peptide
NMENIASGL

SEQ ID NO: 12464 - protein, 9 aa, Artificial Sequence
  Synthetic Peptide
TLPQEHIVL

SEQ ID NO: 12465 - protein, 9 aa, Artificial Sequence
  Synthetic Peptide
KLKQCFRKL

SEQ ID NO: 12466 - protein, 9 aa, Artificial Sequence
  Synthetic Peptide
PLPIHTAEL

SEQ ID NO: 12467 - protein, 9 aa, Artificial Sequence
  Synthetic Peptide
QLDPARDVL

SEQ ID NO: 12468 - protein, 9 aa, Artificial Sequence
  Synthetic Peptide
VLGGCRHKL

SEQ ID NO: 12469 - protein, 8 aa, Artificial Sequence
  Synthetic Peptide
DLQETTDL

SEQ ID NO: 12470 - protein, 9 aa, Artificial Sequence
  Synthetic Peptide
DLPTQEPAL

SEQ ID NO: 12471 - protein, 9 aa, Artificial Sequence
  Synthetic Peptide
HLIRVEGNL

SEQ ID NO: 12472 - protein, 9 aa, Artificial Sequence
  Synthetic Peptide
TLEDSSGNL

SEQ ID NO: 12473 - protein, 9 aa, Artificial Sequence
  Synthetic Peptide
ELRHYSDSV

SEQ ID NO: 12474 - protein, 9 aa, Artificial Sequence
  Synthetic Peptide
DLHVISNDV

SEQ ID NO: 12475 - protein, 9 aa, Artificial Sequence
  Synthetic Peptide
CLIFLLVLL

SEQ ID NO: 12476 - protein, 10 aa, Artificial Sequence
  Synthetic Peptide
LLFNILGGWV

SEQ ID NO: 12477 - protein, 10 aa, Artificial Sequence
  Synthetic Peptide
LLVPFVQWFV

SEQ ID NO: 12478 - protein, 10 aa, Artificial Sequence
  Synthetic Peptide
LLALLSCLTV

SEQ ID NO: 12479 - protein, 10 aa, Artificial Sequence
  Synthetic Peptide
ILLLCLIFLL

SEQ ID NO: 12480 - protein, 10 aa, Artificial Sequence
  Synthetic Peptide
GLSPTVWLSV

SEQ ID NO: 12481 - protein, 10 aa, Artificial Sequence
  Synthetic Peptide
SLYNILSPFL

SEQ ID NO: 12482 - protein, 10 aa, Artificial Sequence
  Synthetic Peptide
LLVLQAGFFL

SEQ ID NO: 12483 - protein, 10 aa, Artificial Sequence
  Synthetic Peptide
FLQTHIFAEV

SEQ ID NO: 12484 - protein, 10 aa, Artificial Sequence
  Synthetic Peptide
QLFLNTLSFV

SEQ ID NO: 12485 - protein, 10 aa, Artificial Sequence
  Synthetic Peptide
LLPIFFCLWV

SEQ ID NO: 12486 - protein, 10 aa, Artificial Sequence
  Synthetic Peptide
LLLCLIFLLV

SEQ ID NO: 12487 - protein, 10 aa, Artificial Sequence
  Synthetic Peptide
LLDYQGMLPV

SEQ ID NO: 12488 - protein, 10 aa, Artificial Sequence
  Synthetic Peptide
WMMWYWGPSL

SEQ ID NO: 12489 - protein, 10 aa, Artificial Sequence
  Synthetic Peptide
GLYSSTVPVL

SEQ ID NO: 12490 - protein, 10 aa, Artificial Sequence
  Synthetic Peptide
YLLPRRGPRL

SEQ ID NO: 12491 - protein, 10 aa, Artificial Sequence
  Synthetic Peptide
GLLGCIITSL

SEQ ID NO: 12492 - protein, 10 aa, Artificial Sequence
  Synthetic Peptide
ILCWGELMNL

SEQ ID NO: 12493 - protein, 10 aa, Artificial Sequence
  Synthetic Peptide
LLGICLTSTV

SEQ ID NO: 12494 - protein, 10 aa, Artificial Sequence
  Synthetic Peptide
LLWKGEGAVV

SEQ ID NO: 12495 - protein, 10 aa, Artificial Sequence
  Synthetic Peptide
LLALLSCLTI

SEQ ID NO: 12496 - protein, 10 aa, Artificial Sequence
  Synthetic Peptide
KLTNTGLYNL

SEQ ID NO: 12497 - protein, 10 aa, Artificial Sequence
  Synthetic Peptide
RLIVFPDLGV

SEQ ID NO: 12498 - protein, 11 aa, Artificial Sequence
  Synthetic Peptide
FLLTPKKLQCV

SEQ ID NO: 12499 - protein, 10 aa, Artificial Sequence
  Synthetic Peptide
WMMWFWGPSL

SEQ ID NO: 12500 - protein, 10 aa, Artificial Sequence
  Synthetic Peptide
SLNFLGGTPV

SEQ ID NO: 12501 - protein, 10 aa, Artificial Sequence
  Synthetic Peptide
SLQDIEITCV

SEQ ID NO: 12502 - protein, 10 aa, Artificial Sequence
  Synthetic Peptide
ILSTLPETTV

SEQ ID NO: 12503 - protein, 10 aa, Artificial Sequence
  Synthetic Peptide
RLHGLSAFSL

SEQ ID NO: 12504 - protein, 10 aa, Artificial Sequence
  Synthetic Peptide
ILGGWVAAQL

SEQ ID NO: 12505 - protein, 10 aa, Artificial Sequence
  Synthetic Peptide
VMAGVGSPYV

SEQ ID NO: 12506 - protein, 10 aa, Artificial Sequence
  Synthetic Peptide
QLMVTVYYGV

SEQ ID NO: 12507 - protein, 10 aa, Artificial Sequence
  Synthetic Peptide
ILRGTSFVYV

SEQ ID NO: 12508 - protein, 10 aa, Artificial Sequence
  Synthetic Peptide
SLTEILKGGV

SEQ ID NO: 12509 - protein, 10 aa, Artificial Sequence
  Synthetic Peptide
LLGCAANWIL

SEQ ID NO: 12510 - protein, 10 aa, Artificial Sequence
  Synthetic Peptide
ALPPASPSAV

SEQ ID NO: 12511 - protein, 10 aa, Artificial Sequence
  Synthetic Peptide
QLLWFHISCL

SEQ ID NO: 12512 - protein, 10 aa, Artificial Sequence
  Synthetic Peptide
NLLGRNSFEV

SEQ ID NO: 12513 - protein, 10 aa, Artificial Sequence
  Synthetic Peptide
VLAALAAYCL

SEQ ID NO: 12514 - protein, 10 aa, Artificial Sequence
  Synthetic Peptide
LLLDDEAGPL

SEQ ID NO: 12515 - protein, 10 aa, Artificial Sequence
  Synthetic Peptide
IMAKNBVFCV

SEQ ID NO: 12516 - protein, 10 aa, Artificial Sequence
  Synthetic Peptide
VLVGGVLAAL

SEQ ID NO: 12517 - protein, 10 aa, Artificial Sequence
  Synthetic Peptide
LLCLIFLLVL

SEQ ID NO: 12518 - protein, 10 aa, Artificial Sequence
  Synthetic Peptide
KLMVTVYYGV

SEQ ID NO: 12519 - protein, 10 aa, Artificial Sequence
  Synthetic Peptide
NLMVTVYYGV

SEQ ID NO: 12520 - protein, 10 aa, Artificial Sequence
  Synthetic Peptide
GLSPTVWLSA

SEQ ID NO: 12521 - protein, 10 aa, Artificial Sequence
  Synthetic Peptide
SLPTHDPSPL

SEQ ID NO: 12522 - protein, 10 aa, Artificial Sequence
  Synthetic Peptide
VLPEKDSWTV

SEQ ID NO: 12523 - protein, 10 aa, Artificial Sequence
  Synthetic Peptide
FLHSGTAKSV

SEQ ID NO: 12524 - protein, 10 aa, Artificial Sequence
  Synthetic Peptide
GLIHLGQNIV

SEQ ID NO: 12525 - protein, 10 aa, Artificial Sequence
  Synthetic Peptide
SLYAAVTNFL

SEQ ID NO: 12526 - protein, 10 aa, Artificial Sequence
  Synthetic Peptide
IMPARFYPNV

SEQ ID NO: 12527 - protein, 10 aa, Artificial Sequence
  Synthetic Peptide
YLTRDPTTPL

SEQ ID NO: 12528 - protein, 10 aa, Artificial Sequence
  Synthetic Peptide
GLYNLLIRCL

SEQ ID NO: 12529 - protein, 10 aa, Artificial Sequence
  Synthetic Peptide
YLEYGRCRTV

SEQ ID NO: 12530 - protein, 10 aa, Artificial Sequence
  Synthetic Peptide
SLFTSITNFL

SEQ ID NO: 12531 - protein, 10 aa, Artificial Sequence
  Synthetic Peptide
NLLSSDLSWL

SEQ ID NO: 12532 - protein, 10 aa, Artificial Sequence
  Synthetic Peptide
RMARDPQRFV

SEQ ID NO: 12533 - protein, 10 aa, Artificial Sequence
  Synthetic Peptide
RMRGTFVVPL

SEQ ID NO: 12534 - protein, 10 aa, Artificial Sequence
  Synthetic Peptide
SLQLVFGIDV

SEQ ID NO: 12535 - protein, 10 aa, Artificial Sequence
  Synthetic Peptide
KLLHKRTLGL

SEQ ID NO: 12536 - protein, 10 aa, Artificial Sequence
  Synthetic Peptide
GLGMEHLREV

SEQ ID NO: 12537 - protein, 10 aa, Artificial Sequence
  Synthetic Peptide
GMSYLEDVRL

SEQ ID NO: 12538 - protein, 10 aa, Artificial Sequence
  Synthetic Peptide
NLLSSNLSWL

SEQ ID NO: 12539 - protein, 10 aa, Artificial Sequence
  Synthetic Peptide
QLTVWGIKQL

SEQ ID NO: 12540 - protein, 10 aa, Artificial Sequence
  Synthetic Peptide
VLEYLVSFGV

SEQ ID NO: 12541 - protein, 10 aa, Artificial Sequence
  Synthetic Peptide
VLNPSVAATL

SEQ ID NO: 12542 - protein, 10 aa, Artificial Sequence
  Synthetic Peptide
SLTNLLSSNL

SEQ ID NO: 12543 - protein, 10 aa, Artificial Sequence
  Synthetic Peptide
ALLDPRVRGL

SEQ ID NO: 12544 - protein, 10 aa, Artificial Sequence
  Synthetic Peptide
TLEDSSGNLL

SEQ ID NO: 12545 - protein, 10 aa, Artificial Sequence
  Synthetic Peptide
TLQGLGISWL

SEQ ID NO: 12546 - protein, 10 aa, Artificial Sequence
  Synthetic Peptide
DLRAFQQLFL

SEQ ID NO: 12547 - protein, 10 aa, Artificial Sequence
  Synthetic Peptide
VLQGLPREYV

SEQ ID NO: 12548 - protein, 10 aa, Artificial Sequence
  Synthetic Peptide
DLPPWFPPMV

SEQ ID NO: 12549 - protein, 10 aa, Artificial Sequence
  Synthetic Peptide
DLSDGSWSTV

SEQ ID NO: 12550 - protein, 10 aa, Artificial Sequence
  Synthetic Peptide
CLAFSYMDDV

SEQ ID NO: 12551 - protein, 10 aa, Artificial Sequence
  Synthetic Peptide
PLVLGTLEEV

SEQ ID NO: 12552 - protein, 10 aa, Artificial Sequence
  Synthetic Peptide
NLATWVGSNL

SEQ ID NO: 12553 - protein, 10 aa, Artificial Sequence
  Synthetic Peptide
NLLTQIGCTL

SEQ ID NO: 12554 - protein, 10 aa, Artificial Sequence
  Synthetic Peptide
GLTHIDAHFL

SEQ ID NO: 12555 - protein, 10 aa, Artificial Sequence
  Synthetic Peptide
VLGSGAFGTV

SEQ ID NO: 12556 - protein, 10 aa, Artificial Sequence
  Synthetic Peptide
QLIKKEKVYL

SEQ ID NO: 12557 - protein, 10 aa, Artificial Sequence
  Synthetic Peptide
KLLWKGEGAV

SEQ ID NO: 12558 - protein, 10 aa, Artificial Sequence
  Synthetic Peptide
SMVGNWAKVL

SEQ ID NO: 12559 - protein, 10 aa, Artificial Sequence
  Synthetic Peptide
KLIGTDNSVV

SEQ ID NO: 12560 - protein, 10 aa, Artificial Sequence
  Synthetic Peptide
ILLVVVLGVV

SEQ ID NO: 12561 - protein, 10 aa, Artificial Sequence
  Synthetic Peptide
LLDTGADDTV

SEQ ID NO: 12562 - protein, 10 aa, Artificial Sequence
  Synthetic Peptide
HLKTAVQMAV

SEQ ID NO: 12563 - protein, 10 aa, Artificial Sequence
  Synthetic Peptide
DLLMGTLGIV

SEQ ID NO: 12564 - protein, 10 aa, Artificial Sequence
  Synthetic Peptide
LLKLAGRWPV

SEQ ID NO: 12565 - protein, 10 aa, Artificial Sequence
  Synthetic Peptide
DLMVTVYYGV

SEQ ID NO: 12566 - protein, 10 aa, Artificial Sequence
  Synthetic Peptide
TLEKLTNTGL

SEQ ID NO: 12567 - protein, 10 aa, Artificial Sequence
  Synthetic Peptide
SLTNLLSSDL

SEQ ID NO: 12568 - protein, 10 aa, Artificial Sequence
  Synthetic Peptide
NLEDPASREL

SEQ ID NO: 12569 - protein, 10 aa, Artificial Sequence
  Synthetic Peptide
GLSAMSTTDL

SEQ ID NO: 12570 - protein, 10 aa, Artificial Sequence
  Synthetic Peptide
VLVASRGRAV

SEQ ID NO: 12571 - protein, 10 aa, Artificial Sequence
  Synthetic Peptide
DLSVFQNLQV

SEQ ID NO: 12572 - protein, 10 aa, Artificial Sequence
  Synthetic Peptide
QLFRNPHQAL

SEQ ID NO: 12573 - protein, 10 aa, Artificial Sequence
  Synthetic Peptide
PLTSIISAVV

SEQ ID NO: 12574 - protein, 10 aa, Artificial Sequence
  Synthetic Peptide
YLKGSSGGPL

SEQ ID NO: 12575 - protein, 10 aa, Artificial Sequence
  Synthetic Peptide
QLPCEPEPDV

SEQ ID NO: 12576 - protein, 10 aa, Artificial Sequence
  Synthetic Peptide
CLTFGRETVL

SEQ ID NO: 12577 - protein, 10 aa, Artificial Sequence
  Synthetic Peptide
TLEDLLMGTL

SEQ ID NO: 12578 - protein, 10 aa, Artificial Sequence
  Synthetic Peptide
SLHCKPEEAL

SEQ ID NO: 12579 - protein, 10 aa, Artificial Sequence
  Synthetic Peptide
EMPRELNEAL

SEQ ID NO: 12580 - protein, 10 aa, Artificial Sequence
  Synthetic Peptide
VLKDAIKDLV

SEQ ID NO: 12581 - protein, 10 aa, Artificial Sequence
  Synthetic Peptide
DLVDAEEYLV

SEQ ID NO: 12582 - protein, 10 aa, Artificial Sequence
  Synthetic Peptide
RMRGTFVSPL

SEQ ID NO: 12583 - protein, 10 aa, Artificial Sequence
  Synthetic Peptide
QLAKTCPVQL

SEQ ID NO: 12584 - protein, 10 aa, Artificial Sequence
  Synthetic Peptide
NLQVIRGRIL

SEQ ID NO: 12585 - protein, 10 aa, Artificial Sequence
  Synthetic Peptide
WLGLRSLREL

SEQ ID NO: 12586 - protein, 10 aa, Artificial Sequence
  Synthetic Peptide
NMGLKIRQLL

SEQ ID NO: 12587 - protein, 10 aa, Artificial Sequence
  Synthetic Peptide
PLSYQHFRKL

SEQ ID NO: 12588 - protein, 10 aa, Artificial Sequence
  Synthetic Peptide
ELPRLADEGL

SEQ ID NO: 12589 - protein, 10 aa, Artificial Sequence
  Synthetic Peptide
GLNRRVAEDL

SEQ ID NO: 12590 - protein, 10 aa, Artificial Sequence
  Synthetic Peptide
PLTVNEKRRL

SEQ ID NO: 12591 - protein, 10 aa, Artificial Sequence
  Synthetic Peptide
IMPARFYPNL

SEQ ID NO: 12592 - protein, 10 aa, Artificial Sequence
  Synthetic Peptide
PLHPAAMPHL

SEQ ID NO: 12593 - protein, 10 aa, Artificial Sequence
  Synthetic Peptide
DLHDSCSRNL

SEQ ID NO: 12594 - protein, 10 aa, Artificial Sequence
  Synthetic Peptide
LLYKTFGRKL

SEQ ID NO: 12595 - protein, 10 aa, Artificial Sequence
  Synthetic Peptide
PMGVGLSPFL

SEQ ID NO: 12596 - protein, 10 aa, Artificial Sequence
  Synthetic Peptide
VLGAKSVQHL

SEQ ID NO: 12597 - protein, 10 aa, Artificial Sequence
  Synthetic Peptide
PLPIHTAELL

SEQ ID NO: 12598 - protein, 10 aa, Artificial Sequence
  Synthetic Peptide
PLPSLAPSAV

SEQ ID NO: 12599 - protein, 10 aa, Artificial Sequence
  Synthetic Peptide
DLEAYFKDCL

SEQ ID NO: 12600 - protein, 10 aa, Artificial Sequence
  Synthetic Peptide
ELGEEIRLKV

SEQ ID NO: 12601 - protein, 10 aa, Artificial Sequence
  Synthetic Peptide
VLGGCRHKLV

SEQ ID NO: 12602 - protein, 10 aa, Artificial Sequence
  Synthetic Peptide
TLEQQYNKPL

SEQ ID NO: 12603 - protein, 10 aa, Artificial Sequence
  Synthetic Peptide
DLCTELNTSL

SEQ ID NO: 12604 - protein, 10 aa, Artificial Sequence
  Synthetic Peptide
RLQRRRETQV

SEQ ID NO: 12605 - protein, 10 aa, Artificial Sequence
  Synthetic Peptide
HLEPQNEIPV

SEQ ID NO: 12606 - protein, 10 aa, Artificial Sequence
  Synthetic Peptide
LLKYRAREPV

SEQ ID NO: 12607 - protein, 10 aa, Artificial Sequence
  Synthetic Peptide
CLGLSYDGLL

SEQ ID NO: 12608 - protein, 10 aa, Artificial Sequence
  Synthetic Peptide
DMSLLKNRFL

SEQ ID NO: 12609 - protein, 10 aa, Artificial Sequence
  Synthetic Peptide
LLRLSEPAEL

SEQ ID NO: 12610 - protein, 10 aa, Artificial Sequence
  Synthetic Peptide
PLSQETFSDL

SEQ ID NO: 12611 - protein, 10 aa, Artificial Sequence
  Synthetic Peptide
PLPSQAMDDL

SEQ ID NO: 12612 - protein, 10 aa, Artificial Sequence
  Synthetic Peptide
ELAALCRWGL

SEQ ID NO: 12613 - protein, 10 aa, Artificial Sequence
  Synthetic Peptide
RLPASPETHL

SEQ ID NO: 12614 - protein, 10 aa, Artificial Sequence
  Synthetic Peptide
RLRIVRGTQL

SEQ ID NO: 12615 - protein, 10 aa, Artificial Sequence
  Synthetic Peptide
GLRELQLRSL

SEQ ID NO: 12616 - protein, 10 aa, Artificial Sequence
  Synthetic Peptide
QMRILKETEL

SEQ ID NO: 12617 - protein, 10 aa, Artificial Sequence
  Synthetic Peptide
ILKETELRKV

SEQ ID NO: 12618 - protein, 10 aa, Artificial Sequence
  Synthetic Peptide
PLDSTFYRSL

SEQ ID NO: 12619 - protein, 10 aa, Artificial Sequence
  Synthetic Peptide
LLEDDDMGDL

SEQ ID NO: 12620 - protein, 10 aa, Artificial Sequence
  Synthetic Peptide
DLGMGAAKGL

SEQ ID NO: 12621 - protein, 10 aa, Artificial Sequence
  Synthetic Peptide
PLPSETDGYV

SEQ ID NO: 12622 - protein, 9 aa, Artificial Sequence
  Synthetic Peptide
TLSGKNGVV

SEQ ID NO: 12623 - protein, 10 aa, Artificial Sequence
  Synthetic Peptide
TLQDPRVRAL

SEQ ID NO: 12624 - protein, 10 aa, Artificial Sequence
  Synthetic Peptide
NMENIASGLL

SEQ ID NO: 12625 - protein, 10 aa, Artificial Sequence
  Synthetic Peptide
ELPHLADEGL

SEQ ID NO: 12626 - protein, 10 aa, Artificial Sequence
  Synthetic Peptide
GLNRPVAEDL

SEQ ID NO: 12627 - protein, 10 aa, Artificial Sequence
  Synthetic Peptide
PLTVNENRRL

SEQ ID NO: 12628 - protein, 10 aa, Artificial Sequence
  Synthetic Peptide
LLYKTYGRKL

SEQ ID NO: 12629 - protein, 10 aa, Artificial Sequence
  Synthetic Peptide
GLSAMSPTDL

SEQ ID NO: 12630 - protein, 10 aa, Artificial Sequence
  Synthetic Peptide
DLEAYFKDCV

SEQ ID NO: 12631 - protein, 10 aa, Artificial Sequence
  Synthetic Peptide
TLQDPRVRGL

SEQ ID NO: 12632 - protein, 10 aa, Artificial Sequence
  Synthetic Peptide
NMENITSGFL

SEQ ID NO: 12633 - protein, 10 aa, Artificial Sequence
  Synthetic Peptide
DLVNLLPAIL

SEQ ID NO: 12634 - protein, 10 aa, Artificial Sequence
  Synthetic Peptide
PLTEEKIKAL

SEQ ID NO: 12635 - protein, 10 aa, Artificial Sequence
  Synthetic Peptide
QLGIPHPAGL

SEQ ID NO: 12636 - protein, 10 aa, Artificial Sequence
  Synthetic Peptide
GLKKKKSVTV

SEQ ID NO: 12637 - protein, 10 aa, Artificial Sequence
  Synthetic Peptide
PIWKGPAKLL

SEQ ID NO: 12638 - protein, 10 aa, Artificial Sequence
  Synthetic Peptide
DLAVAVEPVV

SEQ ID NO: 12639 - protein, 10 aa, Artificial Sequence
  Synthetic Peptide
SLTGRDKNQV

SEQ ID NO: 12640 - protein, 10 aa, Artificial Sequence
  Synthetic Peptide
DLEVVTSTWV

SEQ ID NO: 12641 - protein, 10 aa, Artificial Sequence
  Synthetic Peptide
GLGKVLIDIL

SEQ ID NO: 12642 - protein, 10 aa, Artificial Sequence
  Synthetic Peptide
VLTTSCGNTL

SEQ ID NO: 12643 - protein, 10 aa, Artificial Sequence
  Synthetic Peptide
ELITSCSSNV

SEQ ID NO: 12644 - protein, 10 aa, Artificial Sequence
  Synthetic Peptide
CLRKLGVPPL

SEQ ID NO: 12645 - protein, 10 aa, Artificial Sequence
  Synthetic Peptide
PLGFFPDHQL

SEQ ID NO: 12646 - protein, 10 aa, Artificial Sequence
  Synthetic Peptide
NMENTTSGFL

SEQ ID NO: 12647 - protein, 9 aa, Artificial Sequence
  Synthetic Peptide
FPVRPQVPL

SEQ ID NO: 12648 - protein, 9 aa, Artificial Sequence
  Synthetic Peptide
IPIPSSWAF

SEQ ID NO: 12649 - protein, 9 aa, Artificial Sequence
  Synthetic Peptide
LPGCSFSIF

SEQ ID NO: 12650 - protein, 9 aa, Artificial Sequence
  Synthetic Peptide
VPISHLYIL

SEQ ID NO: 12651 - protein, 9 aa, Artificial Sequence
  Synthetic Peptide
FPHCLAFSY

SEQ ID NO: 12652 - protein, 9 aa, Artificial Sequence
  Synthetic Peptide
MPKAGLLII

SEQ ID NO: 12653 - protein, 9 aa, Artificial Sequence
  Synthetic Peptide
LPTTMNYPL

SEQ ID NO: 12654 - protein, 9 aa, Artificial Sequence
  Synthetic Peptide
FPYLVAYQA

SEQ ID NO: 12655 - protein, 9 aa, Artificial Sequence
  Synthetic Peptide
LPVCAFSSA

SEQ ID NO: 12656 - protein, 8 aa, Artificial Sequence
  Synthetic Peptide
FPRIWLHL

SEQ ID NO: 12657 - protein, 9 aa, Artificial Sequence
  Synthetic Peptide
APLLLARAA

SEQ ID NO: 12658 - protein, 9 aa, Artificial Sequence
  Synthetic Peptide
HPQWVLTAA

SEQ ID NO: 12659 - protein, 9 aa, Artificial Sequence
  Synthetic Peptide
YPCTVNFTI

SEQ ID NO: 12660 - protein, 9 aa, Artificial Sequence
  Synthetic Peptide
FPISPIETV

SEQ ID NO: 12661 - protein, 10 aa, Artificial Sequence
  Synthetic Peptide
FPHCLAFSYM

SEQ ID NO: 12662 - protein, 10 aa, Artificial Sequence
  Synthetic Peptide
YPLASLRSLF

SEQ ID NO: 12663 - protein, 10 aa, Artificial Sequence
  Synthetic Peptide
TPYAGEPAPF

SEQ ID NO: 12664 - protein, 10 aa, Artificial Sequence
  Synthetic Peptide
TPARVTGGVF

SEQ ID NO: 12665 - protein, 10 aa, Artificial Sequence
  Synthetic Peptide
YPCTVNFTIF

SEQ ID NO: 12666 - protein, 10 aa, Artificial Sequence
  Synthetic Peptide
IPQAVVDMVA

SEQ ID NO: 12667 - protein, 10 aa, Artificial Sequence
  Synthetic Peptide
LPCSFTTLPA

SEQ ID NO: 12668 - protein, 10 aa, Artificial Sequence
  Synthetic Peptide
LPQGWKGSPA

SEQ ID NO: 12669 - protein, 25 aa, Artificial Sequence
  Synthetic Peptide
MDIDPYKEFGATVELLSFLPSDFFP

SEQ ID NO: 12670 - protein, 20 aa, Artificial Sequence
  Synthetic Peptide
LETTMRSPVFTDNSSPPVVP

SEQ ID NO: 12671 - protein, 18 aa, Artificial Sequence
  Synthetic Peptide
AYAAQGYKVLVLNPSVAA

SEQ ID NO: 12672 - protein, 20 aa, Artificial Sequence
  Synthetic Peptide
TPAETTVRLRAYMNTPGLPV

SEQ ID NO: 12673 - protein, 20 aa, Artificial Sequence
  Synthetic Peptide
ENLPYLVAYQATVCARAQAP

SEQ ID NO: 12674 - protein, 18 aa, Artificial Sequence
  Synthetic Peptide
GIQYLAGLSTLPGNPAIA

SEQ ID NO: 12675 - protein, 20 aa, Artificial Sequence
  Synthetic Peptide
KGGRKPARLIVFPDLGVRVC

SEQ ID NO: 12676 - protein, 20 aa, Artificial Sequence
  Synthetic Peptide
CGKYLFNWAVRTKLKLTPIA

SEQ ID NO: 12677 - protein, 15 aa, Artificial Sequence
  Synthetic Peptide
NGWFYVEAVIDRQTG

SEQ ID NO: 12678 - protein, 15 aa, Artificial Sequence
  Synthetic Peptide
TGWFEVEAVIERRTG

SEQ ID NO: 12679 - protein, 15 aa, Artificial Sequence
  Synthetic Peptide
NGWFYVEAVVEKKTG

SEQ ID NO: 12680 - protein, 15 aa, Artificial Sequence
  Synthetic Peptide
EDEIDTDLDGFIDDS

SEQ ID NO: 12681 - protein, 15 aa, Artificial Sequence
  Synthetic Peptide
LLEFIDDSMENSIQA

SEQ ID NO: 12682 - protein, 15 aa, Artificial Sequence
  Synthetic Peptide
VDFIDTQLSICEQAE

SEQ ID NO: 12683 - protein, 15 aa, Artificial Sequence
  Synthetic Peptide
VDFIVNDNDYLTQAE

SEQ ID NO: 12684 - protein, 15 aa, Artificial Sequence
  Synthetic Peptide
ENSIQADTEAARALF

SEQ ID NO: 12685 - protein, 15 aa, Artificial Sequence
  Synthetic Peptide
QAELETAQALFHAQE

SEQ ID NO: 12686 - protein, 15 aa, Artificial Sequence
  Synthetic Peptide
GQQLLQVQTAHADKQ

SEQ ID NO: 12687 - protein, 15 aa, Artificial Sequence
  Synthetic Peptide
QQLLQVQTAHADKQT

SEQ ID NO: 12688 - protein, 15 aa, Artificial Sequence
  Synthetic Peptide
HALFTAQEAKQHRDA

SEQ ID NO: 12689 - protein, 15 aa, Artificial Sequence
  Synthetic Peptide
AQEVHNDAQVLHVLK

SEQ ID NO: 12690 - protein, 15 aa, Artificial Sequence
  Synthetic Peptide
EDDLHAVSAVKRKFT

SEQ ID NO: 12691 - protein, 15 aa, Artificial Sequence
  Synthetic Peptide
GERLEVDTELSPRLQ

SEQ ID NO: 12692 - protein, 15 aa, Artificial Sequence
  Synthetic Peptide
QQTVCREGVKRRLIL

SEQ ID NO: 12693 - protein, 15 aa, Artificial Sequence
  Synthetic Peptide
LKAICIENNSKTAKR

SEQ ID NO: 12694 - protein, 15 aa, Artificial Sequence
  Synthetic Peptide
LKAICIEKQSRAAKR

SEQ ID NO: 12695 - protein, 15 aa, Artificial Sequence
  Synthetic Peptide
NTEVETQQMVQVEEQ

SEQ ID NO: 12696 - protein, 15 aa, Artificial Sequence
  Synthetic Peptide
NTEVETQQMVQQVES

SEQ ID NO: 12697 - protein, 15 aa, Artificial Sequence
  Synthetic Peptide
NTEVETQQMLQVEGR

SEQ ID NO: 12698 - protein, 15 aa, Artificial Sequence
  Synthetic Peptide
MVQVEEQQTTLSCNG

SEQ ID NO: 12699 - protein, 15 aa, Artificial Sequence
  Synthetic Peptide
LYGVSFMELIRPFQS

SEQ ID NO: 12700 - protein, 15 aa, Artificial Sequence
  Synthetic Peptide
LNVLKTSNAKAAMLA

SEQ ID NO: 12701 - protein, 15 aa, Artificial Sequence
  Synthetic Peptide
TLLYKFKEAYGVSFM

SEQ ID NO: 12702 - protein, 15 aa, Artificial Sequence
  Synthetic Peptide
TVLFKFKETYGVSFM

SEQ ID NO: 12703 - protein, 15 aa, Artificial Sequence
  Synthetic Peptide
AYGISFMELVRPFKS

SEQ ID NO: 12704 - protein, 15 aa, Artificial Sequence
  Synthetic Peptide
TYGVSFMELVRPFKS

SEQ ID NO: 12705 - protein, 15 aa, Artificial Sequence
  Synthetic Peptide
MLAVFKDTYGLSFTD

SEQ ID NO: 12706 - protein, 15 aa, Artificial Sequence
  Synthetic Peptide
DWCVAAFGVTGTVAE

SEQ ID NO: 12707 - protein, 15 aa, Artificial Sequence
  Synthetic Peptide
DWVMAIFGVNPTVAE

SEQ ID NO: 12708 - protein, 15 aa, Artificial Sequence
  Synthetic Peptide
VMAIFGVNPTVAEGF

SEQ ID NO: 12709 - protein, 15 aa, Artificial Sequence
  Synthetic Peptide
VRNFKSDKTTCTDWV

SEQ ID NO: 12710 - protein, 15 aa, Artificial Sequence
  Synthetic Peptide
MAIFGVNPTVAEGFK

SEQ ID NO: 12711 - protein, 15 aa, Artificial Sequence
  Synthetic Peptide
DWCIIGMGVTPSVAE

SEQ ID NO: 12712 - protein, 15 aa, Artificial Sequence
  Synthetic Peptide
WCIIGMGVTPSVAEG

SEQ ID NO: 12713 - protein, 15 aa, Artificial Sequence
  Synthetic Peptide
LKTIIKPHCMYYHMQ

SEQ ID NO: 12714 - protein, 15 aa, Artificial Sequence
  Synthetic Peptide
VTAIFGVNPTIAEGF

SEQ ID NO: 12715 - protein, 15 aa, Artificial Sequence
  Synthetic Peptide
LKVLIKQHSLYTHLQ

SEQ ID NO: 12716 - protein, 15 aa, Artificial Sequence
  Synthetic Peptide
FKTLIKPATLYAHIQ

SEQ ID NO: 12717 - protein, 15 aa, Artificial Sequence
  Synthetic Peptide
LKVLIKQHSIYTHLQ

SEQ ID NO: 12718 - protein, 15 aa, Artificial Sequence
  Synthetic Peptide
TAIFGVNPTIAEGFK

SEQ ID NO: 12719 - protein, 15 aa, Artificial Sequence
  Synthetic Peptide
KTLIKPATLYAHIQC

SEQ ID NO: 12720 - protein, 15 aa, Artificial Sequence
  Synthetic Peptide
LKVLIQPYSIYAHLQ

SEQ ID NO: 12721 - protein, 15 aa, Artificial Sequence
  Synthetic Peptide
ACSWGMVMLMLVRFK

SEQ ID NO: 12722 - protein, 15 aa, Artificial Sequence
  Synthetic Peptide
SWGMVMLMLVRFKCA

SEQ ID NO: 12723 - protein, 15 aa, Artificial Sequence
  Synthetic Peptide
FKTLIQPFILYAHIQ

SEQ ID NO: 12724 - protein, 15 aa, Artificial Sequence
  Synthetic Peptide
DRGIIILLLIRFRCS

SEQ ID NO: 12725 - protein, 15 aa, Artificial Sequence
  Synthetic Peptide
RGIIILLLIRFRCSK

SEQ ID NO: 12726 - protein, 15 aa, Artificial Sequence
  Synthetic Peptide
DRGVLILLLIRFKCG

SEQ ID NO: 12727 - protein, 15 aa, Artificial Sequence
  Synthetic Peptide
ACSWGMVVLLLVRYK

SEQ ID NO: 12728 - protein, 15 aa, Artificial Sequence
  Synthetic Peptide
SWGMVVLLLVRYKCG

SEQ ID NO: 12729 - protein, 15 aa, Artificial Sequence
  Synthetic Peptide
EKLLEKLLCISTNCM

SEQ ID NO: 12730 - protein, 15 aa, Artificial Sequence
  Synthetic Peptide
RKTIAKALSSILNVP

SEQ ID NO: 12731 - protein, 15 aa, Artificial Sequence
  Synthetic Peptide
DCKWGVLILALLRYK

SEQ ID NO: 12732 - protein, 15 aa, Artificial Sequence
  Synthetic Peptide
KWGVLILALLRYKCG

SEQ ID NO: 12733 - protein, 15 aa, Artificial Sequence
  Synthetic Peptide
KNRLTVAKLMSNLLS

SEQ ID NO: 12734 - protein, 15 aa, Artificial Sequence
  Synthetic Peptide
RLTVAKLMSNLLSIP

SEQ ID NO: 12735 - protein, 15 aa, Artificial Sequence
  Synthetic Peptide
TNCMLIQPPKLRSTA

SEQ ID NO: 12736 - protein, 15 aa, Artificial Sequence
  Synthetic Peptide
RLTVSKLMSQLLNIP

SEQ ID NO: 12737 - protein, 15 aa, Artificial Sequence
  Synthetic Peptide
CMLIQPPKLRSTAAA

SEQ ID NO: 12738 - protein, 15 aa, Artificial Sequence
  Synthetic Peptide
AKLMSNLLSIPETCM

SEQ ID NO: 12739 - protein, 15 aa, Artificial Sequence
  Synthetic Peptide
VSKLMSQLLNIPETH

SEQ ID NO: 12740 - protein, 15 aa, Artificial Sequence
  Synthetic Peptide
RETIEKLLSKLLCVS

SEQ ID NO: 12741 - protein, 15 aa, Artificial Sequence
  Synthetic Peptide
SNLLSIPETCMVIEP

SEQ ID NO: 12742 - protein, 15 aa, Artificial Sequence
  Synthetic Peptide
QEQMLIQPPKIRSPA

SEQ ID NO: 12743 - protein, 15 aa, Artificial Sequence
  Synthetic Peptide
EKLLSKLLCVSPMCM

SEQ ID NO: 12744 - protein, 15 aa, Artificial Sequence
  Synthetic Peptide
SQLLNIPETHMVIEP

SEQ ID NO: 12745 - protein, 15 aa, Artificial Sequence
  Synthetic Peptide
RLTVAKGLSTLLHVP

SEQ ID NO: 12746 - protein, 15 aa, Artificial Sequence
  Synthetic Peptide
ETCMLIEPPKLRSSV

SEQ ID NO: 12747 - protein, 15 aa, Artificial Sequence
  Synthetic Peptide
ETCMVIEPPKLRSQT

SEQ ID NO: 12748 - protein, 15 aa, Artificial Sequence
  Synthetic Peptide
ETHMVIEPPKLRSAT

SEQ ID NO: 12749 - protein, 15 aa, Artificial Sequence
  Synthetic Peptide
PMCMMIEPPKLRSTA

SEQ ID NO: 12750 - protein, 15 aa, Artificial Sequence
  Synthetic Peptide
ETCMLIQPPKLRSSV

SEQ ID NO: 12751 - protein, 15 aa, Artificial Sequence
  Synthetic Peptide
TPEWIERQTVLQHSF

SEQ ID NO: 12752 - protein, 15 aa, Artificial Sequence
  Synthetic Peptide
PEWIERQTVLQHSFN

SEQ ID NO: 12753 - protein, 15 aa, Artificial Sequence
  Synthetic Peptide
LYWYKTGISNISEVY

SEQ ID NO: 12754 - protein, 15 aa, Artificial Sequence
  Synthetic Peptide
TPEWIDRLTVLQHSF

SEQ ID NO: 12755 - protein, 15 aa, Artificial Sequence
  Synthetic Peptide
ISEVYGDTPEWIQRQ

SEQ ID NO: 12756 - protein, 15 aa, Artificial Sequence
  Synthetic Peptide
PEWIDRLTVLQHSFN

SEQ ID NO: 12757 - protein, 15 aa, Artificial Sequence
  Synthetic Peptide
DTTFDLSQMVQWAYD

SEQ ID NO: 12758 - protein, 15 aa, Artificial Sequence
  Synthetic Peptide
TPEWIEQQTVLQHSF

SEQ ID NO: 12759 - protein, 15 aa, Artificial Sequence
  Synthetic Peptide
PEWIEQQTVLQHSFD

SEQ ID NO: 12760 - protein, 15 aa, Artificial Sequence
  Synthetic Peptide
TPEWIQRQTVLQHSF

SEQ ID NO: 12761 - protein, 15 aa, Artificial Sequence
  Synthetic Peptide
ISEVMGDTPEWIQRL

SEQ ID NO: 12762 - protein, 15 aa, Artificial Sequence
  Synthetic Peptide
PEWIQRQTVLQHSFN

SEQ ID NO: 12763 - protein, 15 aa, Artificial Sequence
  Synthetic Peptide
QHSFNDDIFDLSEMI

SEQ ID NO: 12764 - protein, 15 aa, Artificial Sequence
  Synthetic Peptide
TPEWIQRLTIIQHGI

SEQ ID NO: 12765 - protein, 15 aa, Artificial Sequence
  Synthetic Peptide
PEWIQRLTIIQHGID

SEQ ID NO: 12766 - protein, 15 aa, Artificial Sequence
  Synthetic Peptide
DNDVMDDSEIAYKYA

SEQ ID NO: 12767 - protein, 15 aa, Artificial Sequence
  Synthetic Peptide
NSIFDFGEMVQWAYD

SEQ ID NO: 12768 - protein, 15 aa, Artificial Sequence
  Synthetic Peptide
DSEIAYKYAQLADSD

SEQ ID NO: 12769 - protein, 15 aa, Artificial Sequence
  Synthetic Peptide
DSQIAFQYAQLADVD

SEQ ID NO: 12770 - protein, 15 aa, Artificial Sequence
  Synthetic Peptide
DNELTDDSDIAYYYA

SEQ ID NO: 12771 - protein, 15 aa, Artificial Sequence
  Synthetic Peptide
QWAYDNDIVDDSEIA

SEQ ID NO: 12772 - protein, 15 aa, Artificial Sequence
  Synthetic Peptide
DHDITDDSDIAYKYA

SEQ ID NO: 12773 - protein, 15 aa, Artificial Sequence
  Synthetic Peptide
DSDIAYYYAQLADSN

SEQ ID NO: 12774 - protein, 15 aa, Artificial Sequence
  Synthetic Peptide
ESDMAFQYAQLADCN

SEQ ID NO: 12775 - protein, 15 aa, Artificial Sequence
  Synthetic Peptide
DNDIVDDSEIAYKYA

SEQ ID NO: 12776 - protein, 15 aa, Artificial Sequence
  Synthetic Peptide
IAYYYAQLADSNSNA

SEQ ID NO: 12777 - protein, 15 aa, Artificial Sequence
  Synthetic Peptide
DIAYKYAQLADVNSN

SEQ ID NO: 12778 - protein, 15 aa, Artificial Sequence
  Synthetic Peptide
DSEIAYKYAQLADTN

SEQ ID NO: 12779 - protein, 15 aa, Artificial Sequence
  Synthetic Peptide
QAKIVKDCGTMCRHY

SEQ ID NO: 12780 - protein, 15 aa, Artificial Sequence
  Synthetic Peptide
ESDMAFEYALLADSN

SEQ ID NO: 12781 - protein, 15 aa, Artificial Sequence
  Synthetic Peptide
QAKYVKDCGIMCRHY

SEQ ID NO: 12782 - protein, 15 aa, Artificial Sequence
  Synthetic Peptide
QAKIVKDCGIMCRHY

SEQ ID NO: 12783 - protein, 15 aa, Artificial Sequence
  Synthetic Peptide
QAKYLKDCAVMCRHY

SEQ ID NO: 12784 - protein, 15 aa, Artificial Sequence
  Synthetic Peptide
QAKIVKDCATMCRHY

SEQ ID NO: 12785 - protein, 15 aa, Artificial Sequence
  Synthetic Peptide
VKFLRYQQIEFVSFL

SEQ ID NO: 12786 - protein, 15 aa, Artificial Sequence
  Synthetic Peptide
VSFLSALKLFLKGVP

SEQ ID NO: 12787 - protein, 15 aa, Artificial Sequence
  Synthetic Peptide
GGDWKQIVMFLRYQG

SEQ ID NO: 12788 - protein, 15 aa, Artificial Sequence
  Synthetic Peptide
LKLFLKGVPKKNCIL

SEQ ID NO: 12789 - protein, 15 aa, Artificial Sequence
  Synthetic Peptide
VMFLRYQGVEFMSFL

SEQ ID NO: 12790 - protein, 15 aa, Artificial Sequence
  Synthetic Peptide
FLSYFKLFLQGTPKH

SEQ ID NO: 12791 - protein, 15 aa, Artificial Sequence
  Synthetic Peptide
YFKLFLQGTPKHNCL

SEQ ID NO: 12792 - protein, 15 aa, Artificial Sequence
  Synthetic Peptide
FKLFLQGTPKHNCLV

SEQ ID NO: 12793 - protein, 15 aa, Artificial Sequence
  Synthetic Peptide
KNCILIHGAPNTGKS

SEQ ID NO: 12794 - protein, 15 aa, Artificial Sequence
  Synthetic Peptide
VEFMSFLTALKRFLQ

SEQ ID NO: 12795 - protein, 15 aa, Artificial Sequence
  Synthetic Peptide
FKKFLKGIPKKSCML

SEQ ID NO: 12796 - protein, 15 aa, Artificial Sequence
  Synthetic Peptide
LKEFLKGTPKKNCIL

SEQ ID NO: 12797 - protein, 15 aa, Artificial Sequence
  Synthetic Peptide
IEFITFLGALKSFLK

SEQ ID NO: 12798 - protein, 15 aa, Artificial Sequence
  Synthetic Peptide
LKRFLQGIPKKNCIL

SEQ ID NO: 12799 - protein, 15 aa, Artificial Sequence
  Synthetic Peptide
ITFLGALKSFLKGTP

SEQ ID NO: 12800 - protein, 15 aa, Artificial Sequence
  Synthetic Peptide
GKSYFGMSLISFLQG

SEQ ID NO: 12801 - protein, 15 aa, Artificial Sequence
  Synthetic Peptide
SCMLICGPANTGKSY

SEQ ID NO: 12802 - protein, 15 aa, Artificial Sequence
  Synthetic Peptide
NCILLYGPANTGKSY

SEQ ID NO: 12803 - protein, 15 aa, Artificial Sequence
  Synthetic Peptide
LKSFLKGTPKKNCLV

SEQ ID NO: 12804 - protein, 15 aa, Artificial Sequence
  Synthetic Peptide
NCILLYGAANTGKSL

SEQ ID NO: 12805 - protein, 15 aa, Artificial Sequence
  Synthetic Peptide
ILLYGAANTGKSLFG

SEQ ID NO: 12806 - protein, 15 aa, Artificial Sequence
  Synthetic Peptide
GKSYFGMSLIQFLKG

SEQ ID NO: 12807 - protein, 15 aa, Artificial Sequence
  Synthetic Peptide
GKSYFGMSLIHFLKG

SEQ ID NO: 12808 - protein, 15 aa, Artificial Sequence
  Synthetic Peptide
LIKFFQGSVISFVNS

SEQ ID NO: 12809 - protein, 15 aa, Artificial Sequence
  Synthetic Peptide
IKFFQGSVISFVNSQ

SEQ ID NO: 12810 - protein, 15 aa, Artificial Sequence
  Synthetic Peptide
GKSLFGMSLMKFLQG

SEQ ID NO: 12811 - protein, 15 aa, Artificial Sequence
  Synthetic Peptide
KSLFGMSLMKFLQGS

SEQ ID NO: 12812 - protein, 15 aa, Artificial Sequence
  Synthetic Peptide
FIHFLQGAIISFVNS

SEQ ID NO: 12813 - protein, 15 aa, Artificial Sequence
  Synthetic Peptide
IQFLKGCVISCVNSK

SEQ ID NO: 12814 - protein, 15 aa, Artificial Sequence
  Synthetic Peptide
IHFLQGAIISFVNSN

SEQ ID NO: 12815 - protein, 15 aa, Artificial Sequence
  Synthetic Peptide
IHFLKGCIISYVNSK

SEQ ID NO: 12816 - protein, 15 aa, Artificial Sequence
  Synthetic Peptide
FIHFIQGAVISFVNS

SEQ ID NO: 12817 - protein, 15 aa, Artificial Sequence
  Synthetic Peptide
IHFIQGAVISFVNST

SEQ ID NO: 12818 - protein, 15 aa, Artificial Sequence
  Synthetic Peptide
KIGMIDDVTPISWTY

SEQ ID NO: 12819 - protein, 15 aa, Artificial Sequence
  Synthetic Peptide
KVAMLDDATHTCWTY

SEQ ID NO: 12820 - protein, 15 aa, Artificial Sequence
  Synthetic Peptide
KIGMLDDATVPCWNY

SEQ ID NO: 12821 - protein, 15 aa, Artificial Sequence
  Synthetic Peptide
CWTYFDNYMRNALDG

SEQ ID NO: 12822 - protein, 15 aa, Artificial Sequence
  Synthetic Peptide
RNLVDGNPISLDRKH

SEQ ID NO: 12823 - protein, 15 aa, Artificial Sequence
  Synthetic Peptide
KVAMLDDATTTCWTY

SEQ ID NO: 12824 - protein, 15 aa, Artificial Sequence
  Synthetic Peptide
CWNYIDDNLRNALDG

SEQ ID NO: 12825 - protein, 15 aa, Artificial Sequence
  Synthetic Peptide
LMQLKCPPLLITSNI

SEQ ID NO: 12826 - protein, 15 aa, Artificial Sequence
  Synthetic Peptide
LVQIKCPPLLITTNI

SEQ ID NO: 12827 - protein, 15 aa, Artificial Sequence
  Synthetic Peptide
LVQLKCPPLLLTSNT

SEQ ID NO: 12828 - protein, 15 aa, Artificial Sequence
  Synthetic Peptide
LLQLKCPPILLTSNI

SEQ ID NO: 12829 - protein, 15 aa, Artificial Sequence
  Synthetic Peptide
PPLLITTNINPMLDA

SEQ ID NO: 12830 - protein, 15 aa, Artificial Sequence
  Synthetic Peptide
DDRWPYLHSRLVVFT

SEQ ID NO: 12831 - protein, 15 aa, Artificial Sequence
  Synthetic Peptide
LVQLKCPPLLITSNI

SEQ ID NO: 12832 - protein, 15 aa, Artificial Sequence
  Synthetic Peptide
LIQLKCPPILLTTNI

SEQ ID NO: 12833 - protein, 15 aa, Artificial Sequence
  Synthetic Peptide
DPRWPYLHSRLVVFH

SEQ ID NO: 12834 - protein, 15 aa, Artificial Sequence
  Synthetic Peptide
VTVFTFPHAFPFDKN

SEQ ID NO: 12835 - protein, 15 aa, Artificial Sequence
  Synthetic Peptide
PHAFPFDKNGNPVYE

SEQ ID NO: 12836 - protein, 15 aa, Artificial Sequence
  Synthetic Peptide
RLNLDNDEDKENNGD

SEQ ID NO: 12837 - protein, 15 aa, Artificial Sequence
  Synthetic Peptide
LSQRLNVCQDKILEH

SEQ ID NO: 12838 - protein, 15 aa, Artificial Sequence
  Synthetic Peptide
RLNVCQDKILTHYEN

SEQ ID NO: 12839 - protein, 15 aa, Artificial Sequence
  Synthetic Peptide
YENDSTDLRDHIDYW

SEQ ID NO: 12840 - protein, 15 aa, Artificial Sequence
  Synthetic Peptide
LDHYENDSKDINSQI

SEQ ID NO: 12841 - protein, 15 aa, Artificial Sequence
  Synthetic Peptide
HWKLIRMECAIMYTA

SEQ ID NO: 12842 - protein, 15 aa, Artificial Sequence
  Synthetic Peptide
WKLIRMECALLYTAK

SEQ ID NO: 12843 - protein, 15 aa, Artificial Sequence
  Synthetic Peptide
WKAVRHENVLYYKAR

SEQ ID NO: 12844 - protein, 15 aa, Artificial Sequence
  Synthetic Peptide
WKLIRMECAIMYTAR

SEQ ID NO: 12845 - protein, 16 aa, Artificial Sequence
  Synthetic Peptide
KHIRLLECVLMYKARE

SEQ ID NO: 12846 - protein, 15 aa, Artificial Sequence
  Synthetic Peptide
LIRMECALLYTAKQM

SEQ ID NO: 12847 - protein, 15 aa, Artificial Sequence
  Synthetic Peptide
LIRMECAIMYTARQM

SEQ ID NO: 12848 - protein, 15 aa, Artificial Sequence
  Synthetic Peptide
WQLIRLENAILFTAR

SEQ ID NO: 12849 - protein, 15 aa, Artificial Sequence
  Synthetic Peptide
LIRLENAILFTAREH

SEQ ID NO: 12850 - protein, 15 aa, Artificial Sequence
  Synthetic Peptide
ITHIGHQVVPPMAVS

SEQ ID NO: 12851 - protein, 15 aa, Artificial Sequence
  Synthetic Peptide
NHQVVPALSVSKAKA

SEQ ID NO: 12852 - protein, 15 aa, Artificial Sequence
  Synthetic Peptide
GHQVVPPMAVSKAKA

SEQ ID NO: 12853 - protein, 15 aa, Artificial Sequence
  Synthetic Peptide
HQVVPALSVSKAKAL

SEQ ID NO: 12854 - protein, 15 aa, Artificial Sequence
  Synthetic Peptide
HQVVPPMAVSKAKAC

SEQ ID NO: 12855 - protein, 15 aa, Artificial Sequence
  Synthetic Peptide
HQVVPSLVASKTKAF

SEQ ID NO: 12856 - protein, 15 aa, Artificial Sequence
  Synthetic Peptide
TLAVSKNKALQAIEL

SEQ ID NO: 12857 - protein, 15 aa, Artificial Sequence
  Synthetic Peptide
ALSVSKAKALQAIEL

SEQ ID NO: 12858 - protein, 15 aa, Artificial Sequence
  Synthetic Peptide
PMAVSKAKACQAIEL

SEQ ID NO: 12859 - protein, 15 aa, Artificial Sequence
  Synthetic Peptide
AYNISKSKAHKAIEL

SEQ ID NO: 12860 - protein, 15 aa, Artificial Sequence
  Synthetic Peptide
NKALQAIELQLTLET

SEQ ID NO: 12861 - protein, 15 aa, Artificial Sequence
  Synthetic Peptide
AKALQAIELQMMLET

SEQ ID NO: 12862 - protein, 15 aa, Artificial Sequence
  Synthetic Peptide
PINISKSKAHKAIEL

SEQ ID NO: 12863 - protein, 15 aa, Artificial Sequence
  Synthetic Peptide
AFQVIELQMALETLS

SEQ ID NO: 12864 - protein, 15 aa, Artificial Sequence
  Synthetic Peptide
AFQVIELQMALETLN

SEQ ID NO: 12865 - protein, 15 aa, Artificial Sequence
  Synthetic Peptide
FQVIELQMALETLSK

SEQ ID NO: 12866 - protein, 15 aa, Artificial Sequence
  Synthetic Peptide
CQAIELQLALEALNK

SEQ ID NO: 12867 - protein, 15 aa, Artificial Sequence
  Synthetic Peptide
CSAIEVQIALESLST

SEQ ID NO: 12868 - protein, 15 aa, Artificial Sequence
  Synthetic Peptide
FQVIELQMALETLNA

SEQ ID NO: 12869 - protein, 15 aa, Artificial Sequence
  Synthetic Peptide
HKAIELQMALQGLAQ

SEQ ID NO: 12870 - protein, 15 aa, Artificial Sequence
  Synthetic Peptide
ELQMALETLSKSQYS

SEQ ID NO: 12871 - protein, 15 aa, Artificial Sequence
  Synthetic Peptide
EVQIALESLSTTIYN

SEQ ID NO: 12872 - protein, 15 aa, Artificial Sequence
  Synthetic Peptide
HKAIELQMALKGLAQ

SEQ ID NO: 12873 - protein, 15 aa, Artificial Sequence
  Synthetic Peptide
QMMLETLNNTEYKNE

SEQ ID NO: 12874 - protein, 15 aa, Artificial Sequence
  Synthetic Peptide
LETIYNSQYSNEKWT

SEQ ID NO: 12875 - protein, 15 aa, Artificial Sequence
  Synthetic Peptide
ELQMALKGLAQSKYN

SEQ ID NO: 12876 - protein, 15 aa, Artificial Sequence
  Synthetic Peptide
TTIYNNEEWTLRDTC

SEQ ID NO: 12877 - protein, 15 aa, Artificial Sequence
  Synthetic Peptide
QSRYKTEDWTLQDTC

SEQ ID NO: 12878 - protein, 15 aa, Artificial Sequence
  Synthetic Peptide
PTGCLKKHGYTVEVQ

SEQ ID NO: 12879 - protein, 15 aa, Artificial Sequence
  Synthetic Peptide
QKCFKKKGITVTVQY

SEQ ID NO: 12880 - protein, 15 aa, Artificial Sequence
  Synthetic Peptide
TVEVQFDGDICNTMH

SEQ ID NO: 12881 - protein, 15 aa, Artificial Sequence
  Synthetic Peptide
DICNTMHYTNWTHIY

SEQ ID NO: 12882 - protein, 15 aa, Artificial Sequence
  Synthetic Peptide
GNKDNCMTYVAWDSV

SEQ ID NO: 12883 - protein, 15 aa, Artificial Sequence
  Synthetic Peptide
GEIYIIEEDTCTMVT

SEQ ID NO: 12884 - protein, 15 aa, Artificial Sequence
  Synthetic Peptide
MNYVVWDSIYYITET

SEQ ID NO: 12885 - protein, 15 aa, Artificial Sequence
  Synthetic Peptide
SEIYIIEETTCTLVA

SEQ ID NO: 12886 - protein, 15 aa, Artificial Sequence
  Synthetic Peptide
EIYIIEEDTCTMVTG

SEQ ID NO: 12887 - protein, 15 aa, Artificial Sequence
  Synthetic Peptide
EIYIIEETTCTLVAG

SEQ ID NO: 12888 - protein, 15 aa, Artificial Sequence
  Synthetic Peptide
VAWDSVYYMTDAGTW

SEQ ID NO: 12889 - protein, 15 aa, Artificial Sequence
  Synthetic Peptide
IYIIEEDTCTMVTGK

SEQ ID NO: 12890 - protein, 15 aa, Artificial Sequence
  Synthetic Peptide
SVYYMTDAGTWDKTA

SEQ ID NO: 12891 - protein, 15 aa, Artificial Sequence
  Synthetic Peptide
CTLVAGEVDYVGLYY

SEQ ID NO: 12892 - protein, 15 aa, Artificial Sequence
  Synthetic Peptide
GLYYVHEGIRTYFVQ

SEQ ID NO: 12893 - protein, 15 aa, Artificial Sequence
  Synthetic Peptide
GLYYWCDGEKIYFVK

SEQ ID NO: 12894 - protein, 15 aa, Artificial Sequence
  Synthetic Peptide
VHEGIRTYFVQFKDD

SEQ ID NO: 12895 - protein, 15 aa, Artificial Sequence
  Synthetic Peptide
GVYYIKDGDTTYYVQ

SEQ ID NO: 12896 - protein, 15 aa, Artificial Sequence
  Synthetic Peptide
YFKYFKEDAAKYSKT

SEQ ID NO: 12897 - protein, 15 aa, Artificial Sequence
  Synthetic Peptide
YFKYFKEDAKKYSKT

SEQ ID NO: 12898 - protein, 15 aa, Artificial Sequence
  Synthetic Peptide
FKYFKEDAAKYSKTQ

SEQ ID NO: 12899 - protein, 15 aa, Artificial Sequence
  Synthetic Peptide
EKYGNTGTWEVHFGN

SEQ ID NO: 12900 - protein, 15 aa, Artificial Sequence
  Synthetic Peptide
IWEVHMENESIYCPD

SEQ ID NO: 12901 - protein, 15 aa, Artificial Sequence
  Synthetic Peptide
EVHVGGQVIVCPTSI

SEQ ID NO: 12902 - protein, 15 aa, Artificial Sequence
  Synthetic Peptide
EVHVGGQVIVCPASV

SEQ ID NO: 12903 - protein, 15 aa, Artificial Sequence
  Synthetic Peptide
EVHMENESIYCPDSV

SEQ ID NO: 12904 - protein, 15 aa, Artificial Sequence
  Synthetic Peptide
GQVIVFPESVFSSDE

SEQ ID NO: 12905 - protein, 15 aa, Artificial Sequence
  Synthetic Peptide
GQVIVCPTSISSNQI

SEQ ID NO: 12906 - protein, 15 aa, Artificial Sequence
  Synthetic Peptide
GQVIVCPASVSSNEV

SEQ ID NO: 12907 - protein, 15 aa, Artificial Sequence
  Synthetic Peptide
SRVIVCPTSIPSDQI

SEQ ID NO: 12908 - protein, 15 aa, Artificial Sequence
  Synthetic Peptide
ESVFSSDEISFAGIV

SEQ ID NO: 12909 - protein, 15 aa, Artificial Sequence
  Synthetic Peptide
SNEVSSPEIIRQHLA

SEQ ID NO: 12910 - protein, 15 aa, Artificial Sequence
  Synthetic Peptide
SDEISFAGIVTKLPT

SEQ ID NO: 12911 - protein, 15 aa, Artificial Sequence
  Synthetic Peptide
EISFAGIVTKLPTAN

SEQ ID NO: 12912 - protein, 15 aa, Artificial Sequence
  Synthetic Peptide
FAGIVTKLPTANNTT

SEQ ID NO: 12913 - protein, 15 aa, Artificial Sequence
  Synthetic Peptide
SDDTVSATQLVKQLQ

SEQ ID NO: 12914 - protein, 15 aa, Artificial Sequence
  Synthetic Peptide
STSDDTVSATQIVRQ

SEQ ID NO: 12915 - protein, 15 aa, Artificial Sequence
  Synthetic Peptide
DDTVSATQLVKQLQH

SEQ ID NO: 12916 - protein, 15 aa, Artificial Sequence
  Synthetic Peptide
RQHLANHPAATHTKA

SEQ ID NO: 12917 - protein, 15 aa, Artificial Sequence
  Synthetic Peptide
TVSVGTAKTYGQTSA

SEQ ID NO: 12918 - protein, 15 aa, Artificial Sequence
  Synthetic Peptide
TKLFCADPALDNRTA

SEQ ID NO: 12919 - protein, 15 aa, Artificial Sequence
  Synthetic Peptide
DPALDNRTARTATNC

SEQ ID NO: 12920 - protein, 15 aa, Artificial Sequence
  Synthetic Peptide
PCHTTKLLHRDSVDS

SEQ ID NO: 12921 - protein, 15 aa, Artificial Sequence
  Synthetic Peptide
RDSVDSAPILTAFNS

SEQ ID NO: 12922 - protein, 15 aa, Artificial Sequence
  Synthetic Peptide
GRVNTHVHNPLLCSS

SEQ ID NO: 12923 - protein, 15 aa, Artificial Sequence
  Synthetic Peptide
NPLLGAATPTGNNKR

SEQ ID NO: 12924 - protein, 15 aa, Artificial Sequence
  Synthetic Peptide
DSVDSVNCGVISAAA

SEQ ID NO: 12925 - protein, 15 aa, Artificial Sequence
  Synthetic Peptide
KRRKLCSGNTTPIIH

SEQ ID NO: 12926 - protein, 15 aa, Artificial Sequence
  Synthetic Peptide
NCNSNTTPIVHLKGD

SEQ ID NO: 12927 - protein, 15 aa, Artificial Sequence
  Synthetic Peptide
NKRRKVCSGNTTPII

SEQ ID NO: 12928 - protein, 15 aa, Artificial Sequence
  Synthetic Peptide
IVHLKGDPNSLKCLR

SEQ ID NO: 12929 - protein, 15 aa, Artificial Sequence
  Synthetic Peptide
RKVCSGNTTPIIHLK

SEQ ID NO: 12930 - protein, 15 aa, Artificial Sequence
  Synthetic Peptide
TTPIIHKLGDRNSLK

SEQ ID NO: 12931 - protein, 15 aa, Artificial Sequence
  Synthetic Peptide
NTTPIIHLKGDKNSL

SEQ ID NO: 12932 - protein, 15 aa, Artificial Sequence
  Synthetic Peptide
IIHLKGDPNSLKCLR

SEQ ID NO: 12933 - protein, 15 aa, Artificial Sequence
  Synthetic Peptide
TTPIIHLKGDANILK

SEQ ID NO: 12934 - protein, 15 aa, Artificial Sequence
  Synthetic Peptide
IIHLKGDKNSLKCLR

SEQ ID NO: 12935 - protein, 15 aa, Artificial Sequence
  Synthetic Peptide
IIHLKGDANILKCLR

SEQ ID NO: 12936 - protein, 15 aa, Artificial Sequence
  Synthetic Peptide
LKGDANILKCLRYRL

SEQ ID NO: 12937 - protein, 15 aa, Artificial Sequence
  Synthetic Peptide
HCTLYTAVSSTWHWT

SEQ ID NO: 12938 - protein, 15 aa, Artificial Sequence
  Synthetic Peptide
RYRFQKYKTLFVDVT

SEQ ID NO: 12939 - protein, 15 aa, Artificial Sequence
  Synthetic Peptide
YKTLFVDVTSTYHWT

SEQ ID NO: 12940 - protein, 15 aa, Artificial Sequence
  Synthetic Peptide
TVTFVTEQQQQMFLG

SEQ ID NO: 12941 - protein, 15 aa, Artificial Sequence
  Synthetic Peptide
STWHWTGCNKNTGIL

SEQ ID NO: 12942 - protein, 15 aa, Artificial Sequence
  Synthetic Peptide
AGNEKTGILTVTYHS

SEQ ID NO: 12943 - protein, 15 aa, Artificial Sequence
  Synthetic Peptide
QQQMFLGTVKIPPTV

SEQ ID NO: 12944 - protein, 15 aa, Artificial Sequence
  Synthetic Peptide
QMFLGTVKIPPTVQI

SEQ ID NO: 12945 - protein, 15 aa, Artificial Sequence
  Synthetic Peptide
LNTVKIPPTVQISTG

SEQ ID NO: 12946 - protein, 15 aa, Artificial Sequence
  Synthetic Peptide
EKQRTKFLNTVAIPD

SEQ ID NO: 12947 - protein, 15 aa, Artificial Sequence
  Synthetic Peptide
TYISTSQRDDFLNTV

SEQ ID NO: 12948 - protein, 15 aa, Artificial Sequence
  Synthetic Peptide
FLNTVAIPDSVQILV

SEQ ID NO: 12949 - protein, 15 aa, Artificial Sequence
  Synthetic Peptide
RNTFLDVVTIPNSVQ

SEQ ID NO: 12950 - protein, 15 aa, Artificial Sequence
  Synthetic Peptide
LSQVKIPKTITVSTG

SEQ ID NO: 12951 - protein, 15 aa, Artificial Sequence
  Synthetic Peptide
FLDVVTIPNSVQISV

SEQ ID NO: 12952 - protein, 15 aa, Artificial Sequence
  Synthetic Peptide
LKTVKIPNTVQVIQG

SEQ ID NO: 12953 - protein, 15 aa, Artificial Sequence
  Synthetic Peptide
LSHVKIPVVYRLVWD

SEQ ID NO: 12954 - protein, 15 aa, Artificial Sequence
  Synthetic Peptide
DFLNTVKIPNTVSVS

SEQ ID NO: 12955 - protein, 15 aa, Artificial Sequence
  Synthetic Peptide
VVTIPNSVQISVGYM

SEQ ID NO: 12956 - protein, 15 aa, Artificial Sequence
  Synthetic Peptide
LNTVKIPNTVSVSTG

SEQ ID NO: 12957 - protein, 15 aa, Artificial Sequence
  Synthetic Peptide
TIPNSVQISVGYMTI

SEQ ID NO: 12958 - protein, 15 aa, Artificial Sequence
  Synthetic Peptide
ECVYCKQQLLRREVY

SEQ ID NO: 12959 - protein, 15 aa, Artificial Sequence
  Synthetic Peptide
SEVYDFAFADLTVVY

SEQ ID NO: 12960 - protein, 15 aa, Artificial Sequence
  Synthetic Peptide
YDFVFADLRIVYRDG

SEQ ID NO: 12961 - protein, 15 aa, Artificial Sequence
  Synthetic Peptide
DFVFADLRIVYRDGN

SEQ ID NO: 12962 - protein, 15 aa, Artificial Sequence
  Synthetic Peptide
RIVYRDNNPYGVCIM

SEQ ID NO: 12963 - protein, 15 aa, Artificial Sequence
  Synthetic Peptide
CIVYRDGNPYAVCDK

SEQ ID NO: 12964 - protein, 15 aa, Artificial Sequence
  Synthetic Peptide
CDLLIRCITCQRPLC

SEQ ID NO: 12965 - protein, 15 aa, Artificial Sequence
  Synthetic Peptide
NEILIRCIICQRPLC

SEQ ID NO: 12966 - protein, 15 aa, Artificial Sequence
  Synthetic Peptide
IRCIICQRPLCPQEK

SEQ ID NO: 12967 - protein, 15 aa, Artificial Sequence
  Synthetic Peptide
IRCLRCQKPLNPAEK

SEQ ID NO: 12968 - protein, 15 aa, Artificial Sequence
  Synthetic Peptide
QERPRKLPQLCTELQ

SEQ ID NO: 12969 - protein, 15 aa, Artificial Sequence
  Synthetic Peptide
RGRWTGRCMSCCRSS

SEQ ID NO: 12970 - protein, 15 aa, Artificial Sequence
  Synthetic Peptide
LCTELQTTIHDIILE

SEQ ID NO: 12971 - protein, 15 aa, Artificial Sequence
  Synthetic Peptide
RREVYDFAFRDLCIV

SEQ ID NO: 12972 - protein, 15 aa, Artificial Sequence
  Synthetic Peptide
RHLDKKQRFHNIRGR

SEQ ID NO: 12973 - protein, 15 aa, Artificial Sequence
  Synthetic Peptide
QRFHNIRGRWTGRCM

SEQ ID NO: 12974 - protein, 15 aa, Artificial Sequence
  Synthetic Peptide
HNIRGRWTGRCMSCC

SEQ ID NO: 12975 - protein, 15 aa, Artificial Sequence
  Synthetic Peptide
WTGRCMSCCRSSRTR

SEQ ID NO: 12976 - protein, 15 aa, Artificial Sequence
  Synthetic Peptide
RCMSCCRSSRTRRET

SEQ ID NO: 12977 - protein, 15 aa, Artificial Sequence
  Synthetic Peptide
MSCCRSSRTRRETQL

SEQ ID NO: 12978 - protein, 15 aa, Artificial Sequence
  Synthetic Peptide
TNTGLYNLLIRCLRC

SEQ ID NO: 12979 - protein, 15 aa, Artificial Sequence
  Synthetic Peptide
TELNTSLQDIEITCV

SEQ ID NO: 12980 - protein, 15 aa, Artificial Sequence
  Synthetic Peptide
EVFEFAFKDLFVVYR

SEQ ID NO: 12981 - protein, 15 aa, Artificial Sequence
  Synthetic Peptide
TGRCIACWRRPRTET

SEQ ID NO: 12982 - protein, 15 aa, Artificial Sequence
  Synthetic Peptide
CQALETTIHNIELQC

SEQ ID NO: 12983 - protein, 15 aa, Artificial Sequence
  Synthetic Peptide
FHSIAGQYRGQCNTC

SEQ ID NO: 12984 - protein, 15 aa, Artificial Sequence
  Synthetic Peptide
QYRGQCNTCCDQARQ

SEQ ID NO: 12985 - protein, 15 aa, Artificial Sequence
  Synthetic Peptide
TRPRTLHELCEVLEE

SEQ ID NO: 12986 - protein, 15 aa, Artificial Sequence
  Synthetic Peptide
GCWRQTSREPRESTV

SEQ ID NO: 12987 - protein, 15 aa, Artificial Sequence
  Synthetic Peptide
SEVYDFVFADLRIVY

SEQ ID NO: 12988 - protein, 15 aa, Artificial Sequence
  Synthetic Peptide
RVCLLFYSKVRKYRY

SEQ ID NO: 12989 - protein, 15 aa, Artificial Sequence
  Synthetic Peptide
HGWTGSCLGCWRQTS

SEQ ID NO: 12990 - protein, 15 aa, Artificial Sequence
  Synthetic Peptide
CLGCWRQTSREPRES

SEQ ID NO: 12991 - protein, 15 aa, Artificial Sequence
  Synthetic Peptide
IMCLRFLSKISEYRH

SEQ ID NO: 12992 - protein, 15 aa, Artificial Sequence
  Synthetic Peptide
YRHYQYSLYGKTLEE

SEQ ID NO: 12993 - protein, 15 aa, Artificial Sequence
  Synthetic Peptide
KERHVNANKRFHNIM

SEQ ID NO: 12994 - protein, 15 aa, Artificial Sequence
  Synthetic Peptide
RFHNIMGRWTGRCSE

SEQ ID NO: 12995 - protein, 15 aa, Artificial Sequence
  Synthetic Peptide
DLRVVQQLLMGALTV

SEQ ID NO: 12996 - protein, 15 aa, Artificial Sequence
  Synthetic Peptide
QLLMGTCTIVCPSCA

SEQ ID NO: 12997 - protein, 15 aa, Artificial Sequence
  Synthetic Peptide
EPDRAHYNIVTFCCK

SEQ ID NO: 12998 - protein, 15 aa, Artificial Sequence
  Synthetic Peptide
LDLQPETTDLYCYEQ

SEQ ID NO: 12999 - protein, 15 aa, Artificial Sequence
  Synthetic Peptide
GVNHQHLPARRAEPQ

SEQ ID NO: 13000 - protein, 15 aa, Artificial Sequence
  Synthetic Peptide
SADDLRAFQQLFLNT

SEQ ID NO: 13001 - protein, 15 aa, Artificial Sequence
  Synthetic Peptide
DYVLDLQPEATDLHC

SEQ ID NO: 13002 - protein, 15 aa, Artificial Sequence
  Synthetic Peptide
QSTQVDIRILQELLM

SEQ ID NO: 13003 - protein, 15 aa, Artificial Sequence
  Synthetic Peptide
EYVLDLYPEPTDLYC

SEQ ID NO: 13004 - protein, 15 aa, Artificial Sequence
  Synthetic Peptide
LYCYEQLSDSSDEDE

SEQ ID NO: 13005 - protein, 15 aa, Artificial Sequence
  Synthetic Peptide
YYIVTCCHTCNTTVR

SEQ ID NO: 13006 - protein, 15 aa, Artificial Sequence
  Synthetic Peptide
LCVNSTASDLRTIQQ

SEQ ID NO: 13007 - protein, 15 aa, Artificial Sequence
  Synthetic Peptide
LLMGTVNIVCPTCAQ

SEQ ID NO: 13008 - protein, 15 aa, Artificial Sequence
  Synthetic Peptide
LMGTVNIVCPTCAQQ

SEQ ID NO: 13009 - protein, 15 aa, Artificial Sequence
  Synthetic Peptide
DGVSHAQLPARRAEP

SEQ ID NO: 13010 - protein, 15 aa, Artificial Sequence
  Synthetic Peptide
FLSTLSFVCPWCATN

SEQ ID NO: 13011 - protein, 15 aa, Artificial Sequence
  Synthetic Peptide
EIVLHLEPQNELDPV

SEQ ID NO: 13012 - protein, 15 aa, Artificial Sequence
  Synthetic Peptide
EDLRTLQQLFLSTLS

SEQ ID NO: 13013 - protein, 15 aa, Artificial Sequence
  Synthetic Peptide
PDGQAEQATSNYYIV

SEQ ID NO: 13014 - protein, 15 aa, Artificial Sequence
  Synthetic Peptide
TYCHSCDSTLRLCIH

SEQ ID NO: 13015 - protein, 15 aa, Artificial Sequence
  Synthetic Peptide
CIHSTATDLRTLQQM

SEQ ID NO: 13016 - protein, 15 aa, Artificial Sequence
  Synthetic Peptide
EYILDLHPEPTDLFC

SEQ ID NO: 13017 - protein, 15 aa, Artificial Sequence
  Synthetic Peptide
TCGTTVRLCINSTTT

SEQ ID NO: 13018 - protein, 15 aa, Artificial Sequence
  Synthetic Peptide
LMGTCTIVCPSCAQQ

SEQ ID NO: 13019 - protein, 15 aa, Artificial Sequence
  Synthetic Peptide
NASLLIQNSIQNDTG

SEQ ID NO: 13020 - protein, 15 aa, Artificial Sequence
  Synthetic Peptide
QNFIQNDTGFYTLHV

SEQ ID NO: 13021 - protein, 15 aa, Artificial Sequence
  Synthetic Peptide
QNWIQNDTGFYTLHV

SEQ ID NO: 13022 - protein, 15 aa, Artificial Sequence
  Synthetic Peptide
QNYIQNDTGFYTLHV

SEQ ID NO: 13023 - protein, 15 aa, Artificial Sequence
  Synthetic Peptide
QNIIQNDVGFYTLHV

SEQ ID NO: 13024 - protein, 15 aa, Artificial Sequence
  Synthetic Peptide
KPSFSSNNSKPVEDK

SEQ ID NO: 13025 - protein, 15 aa, Artificial Sequence
  Synthetic Peptide
KPSLSSNNSKPVEDK

SEQ ID NO: 13026 - protein, 15 aa, Artificial Sequence
  Synthetic Peptide
KPSVSSNNSKPVEDK

SEQ ID NO: 13027 - protein, 15 aa, Artificial Sequence
  Synthetic Peptide
KPSWSSNNSKPVEDK

SEQ ID NO: 13028 - protein, 15 aa, Artificial Sequence
  Synthetic Peptide
KPSYSSNNSKPVEDK

SEQ ID NO: 13029 - protein, 15 aa, Artificial Sequence
  Synthetic Peptide
KPSISSNNAKPVEDK

SEQ ID NO: 13030 - protein, 15 aa, Artificial Sequence
  Synthetic Peptide
LWWVNNESLPVSPRL

SEQ ID NO: 13031 - protein, 15 aa, Artificial Sequence
  Synthetic Peptide
RTTFKTITVSAELPK

SEQ ID NO: 13032 - protein, 15 aa, Artificial Sequence
  Synthetic Peptide
RTTLKTITVSAELPK

SEQ ID NO: 13033 - protein, 15 aa, Artificial Sequence
  Synthetic Peptide
RTTWKTITVSAELPK

SEQ ID NO: 13034 - protein, 15 aa, Artificial Sequence
  Synthetic Peptide
RTTYKTITVSAELPK

SEQ ID NO: 13035 - protein, 15 aa, Artificial Sequence
  Synthetic Peptide
RTTVKTITLSAELPK

SEQ ID NO: 13036 - protein, 15 aa, Artificial Sequence
  Synthetic Peptide
GTDFKLRLPASPETH

SEQ ID NO: 13037 - protein, 15 aa, Artificial Sequence
  Synthetic Peptide
GTDIKLRLPASPETH

SEQ ID NO: 13038 - protein, 15 aa, Artificial Sequence
  Synthetic Peptide
GTDWKLRLPASPETH

SEQ ID NO: 13039 - protein, 15 aa, Artificial Sequence
  Synthetic Peptide
GTDYKLRLPASPETH

SEQ ID NO: 13040 - protein, 15 aa, Artificial Sequence
  Synthetic Peptide
GTDMKLRLAASPETH

SEQ ID NO: 13041 - protein, 15 aa, Artificial Sequence
  Synthetic Peptide
GTDMKLRLFASPETH

SEQ ID NO: 13042 - protein, 15 aa, Artificial Sequence
  Synthetic Peptide
GTDMKLRLHASPETH

SEQ ID NO: 13043 - protein, 15 aa, Artificial Sequence
  Synthetic Peptide
GTDMKLRLIASPETH

SEQ ID NO: 13044 - protein, 15 aa, Artificial Sequence
  Synthetic Peptide
GTDMKLRLLASPETH

SEQ ID NO: 13045 - protein, 15 aa, Artificial Sequence
  Synthetic Peptide
GTDMKLRLNASPETH

SEQ ID NO: 13046 - protein, 15 aa, Artificial Sequence
  Synthetic Peptide
GTDMKLRLSASPETH

SEQ ID NO: 13047 - protein, 15 aa, Artificial Sequence
  Synthetic Peptide
GTDMKLRLTASPETH

SEQ ID NO: 13048 - protein, 15 aa, Artificial Sequence
  Synthetic Peptide
GTDMKLRLVASPETH

SEQ ID NO: 13049 - protein, 15 aa, Artificial Sequence
  Synthetic Peptide
DMKLRLAASPETHLD

SEQ ID NO: 13050 - protein, 15 aa, Artificial Sequence
  Synthetic Peptide
DMKLRLFASPETHLD

SEQ ID NO: 13051 - protein, 15 aa, Artificial Sequence
  Synthetic Peptide
DMKLRLIASPETHLD

SEQ ID NO: 13052 - protein, 15 aa, Artificial Sequence
  Synthetic Peptide
DMKLRLLASPETHLD

SEQ ID NO: 13053 - protein, 15 aa, Artificial Sequence
  Synthetic Peptide
DMKLRLNASPETHLD

SEQ ID NO: 13054 - protein, 15 aa, Artificial Sequence
  Synthetic Peptide
DMKLRLSASPETHLD

SEQ ID NO: 13055 - protein, 15 aa, Artificial Sequence
  Synthetic Peptide
DMKLRLVASPETHLD

SEQ ID NO: 13056 - protein, 15 aa, Artificial Sequence
  Synthetic Peptide
DMKYRLPASPETHLD

SEQ ID NO: 13057 - protein, 15 aa, Artificial Sequence
  Synthetic Peptide
DMKLRLPAIPETHLD

SEQ ID NO: 13058 - protein, 18 aa, Artificial Sequence
  Synthetic Peptide
KIFGSLAFLPESFDGDPA

SEQ ID NO: 13059 - protein, 18 aa, Artificial Sequence
  Synthetic Peptide
KAFGSLAFLPESFDGDPA

SEQ ID NO: 13060 - protein, 18 aa, Artificial Sequence
  Synthetic Peptide
KFFGSLAFLPESFDGDPA

SEQ ID NO: 13061 - protein, 18 aa, Artificial Sequence
  Synthetic Peptide
KHFGSLAFLPESFDGDPA

SEQ ID NO: 13062 - protein, 18 aa, Artificial Sequence
  Synthetic Peptide
KKFGSLAFLPESFDGDPA

SEQ ID NO: 13063 - protein, 18 aa, Artificial Sequence
  Synthetic Peptide
KLFGSLAFLPESFDGDPA

SEQ ID NO: 13064 - protein, 18 aa, Artificial Sequence
  Synthetic Peptide
KVFGSLAFLPESFDGDPA

SEQ ID NO: 13065 - protein, 18 aa, Artificial Sequence
  Synthetic Peptide
KWFGSLAFLPESFDGDPA

SEQ ID NO: 13066 - protein, 18 aa, Artificial Sequence
  Synthetic Peptide
KYFGSLAFLPESFDGDPA

SEQ ID NO: 13067 - protein, 18 aa, Artificial Sequence
  Synthetic Peptide
KIFGSLIFLPESFDGDPA

SEQ ID NO: 13068 - protein, 18 aa, Artificial Sequence
  Synthetic Peptide
KIFGSLLFLPESFDGDPA

SEQ ID NO: 13069 - protein, 18 aa, Artificial Sequence
  Synthetic Peptide
KIFGSLNFLPESFDGDPA

SEQ ID NO: 13070 - protein, 18 aa, Artificial Sequence
  Synthetic Peptide
KIFGSLSFLPESFDGDPA

SEQ ID NO: 13071 - protein, 18 aa, Artificial Sequence
  Synthetic Peptide
KIFGSLTFLPESFDGDPA

SEQ ID NO: 13072 - protein, 18 aa, Artificial Sequence
  Synthetic Peptide
KIFGSLVFLPESFDGDPA

SEQ ID NO: 13073 - protein, 18 aa, Artificial Sequence
  Synthetic Peptide
KIFGSLAALPESFDGDPA

SEQ ID NO: 13074 - protein, 18 aa, Artificial Sequence
  Synthetic Peptide
KIFGSLAHLPESFDGDPA

SEQ ID NO: 13075 - protein, 18 aa, Artificial Sequence
  Synthetic Peptide
KIFGSLAILPESFDGDPA

SEQ ID NO: 13076 - protein, 18 aa, Artificial Sequence
  Synthetic Peptide
KIFGSLALLPESFDGDPA

SEQ ID NO: 13077 - protein, 18 aa, Artificial Sequence
  Synthetic Peptide
KIFGSLAVLPESFDGDPA

SEQ ID NO: 13078 - protein, 18 aa, Artificial Sequence
  Synthetic Peptide
KIFGSLAWLPESFDGDPA

SEQ ID NO: 13079 - protein, 18 aa, Artificial Sequence
  Synthetic Peptide
KIFGSLAYLPESFDGDPA

SEQ ID NO: 13080 - protein, 18 aa, Artificial Sequence
  Synthetic Peptide
KIFGSLAFLPESHDGDPA

SEQ ID NO: 13081 - protein, 18 aa, Artificial Sequence
  Synthetic Peptide
KIFGSLAFLPESLDGDPA

SEQ ID NO: 13082 - protein, 11 aa, Artificial Sequence
  Synthetic Peptide
QIQVFETLEET

SEQ ID NO: 13083 - protein, 15 aa, Artificial Sequence
  Synthetic Peptide
ETEAVEPLTPSGAMP

SEQ ID NO: 13084 - protein, 15 aa, Artificial Sequence
  Synthetic Peptide
ETEFVEPLTPSGAMP

SEQ ID NO: 13085 - protein, 15 aa, Artificial Sequence
  Synthetic Peptide
ETEHVEPLTPSGAMP

SEQ ID NO: 13086 - protein, 15 aa, Artificial Sequence
  Synthetic Peptide
ETEIVEPLTPSGAMP

SEQ ID NO: 13087 - protein, 15 aa, Artificial Sequence
  Synthetic Peptide
ETEKVEPLTPSGAMP

SEQ ID NO: 13088 - protein, 15 aa, Artificial Sequence
  Synthetic Peptide
ETEVVEPLTPSGAMP

SEQ ID NO: 13089 - protein, 15 aa, Artificial Sequence
  Synthetic Peptide
ETEWVEPLTPSGAMP

SEQ ID NO: 13090 - protein, 15 aa, Artificial Sequence
  Synthetic Peptide
ETEYVEPLTPSGAMP

SEQ ID NO: 13091 - protein, 15 aa, Artificial Sequence
  Synthetic Peptide
ETELVEPLAPSGAMP

SEQ ID NO: 13092 - protein, 15 aa, Artificial Sequence
  Synthetic Peptide
ETELVEPLFPSGAMP

SEQ ID NO: 13093 - protein, 15 aa, Artificial Sequence
  Synthetic Peptide
ETELVEPLHPSGAMP

SEQ ID NO: 13094 - protein, 15 aa, Artificial Sequence
  Synthetic Peptide
ETELVEPLIPSGAMP

SEQ ID NO: 13095 - protein, 15 aa, Artificial Sequence
  Synthetic Peptide
ETELVEPLLPSGAMP

SEQ ID NO: 13096 - protein, 15 aa, Artificial Sequence
  Synthetic Peptide
ETELVEPLNPSGAMP

SEQ ID NO: 13097 - protein, 15 aa, Artificial Sequence
  Synthetic Peptide
ETELVEPLSPSGAMP

SEQ ID NO: 13098 - protein, 15 aa, Artificial Sequence
  Synthetic Peptide
ETELVEPLVPSGAMP

SEQ ID NO: 13099 - protein, 15 aa, Artificial Sequence
  Synthetic Peptide
KEILDEAYIMAGVGS

SEQ ID NO: 13100 - protein, 15 aa, Artificial Sequence
  Synthetic Peptide
KEILDEAYLMAGVGS

SEQ ID NO: 13101 - protein, 15 aa, Artificial Sequence
  Synthetic Peptide
ITDIGLARLLDIDET

SEQ ID NO: 13102 - protein, 15 aa, Artificial Sequence
  Synthetic Peptide
ITDFGLARALDIDET

SEQ ID NO: 13103 - protein, 15 aa, Artificial Sequence
  Synthetic Peptide
ITDFGLARNLDIDET

SEQ ID NO: 13104 - protein, 15 aa, Artificial Sequence
  Synthetic Peptide
ITDFGLARSLDIDET

SEQ ID NO: 13105 - protein, 15 aa, Artificial Sequence
  Synthetic Peptide
CWAIDSECRPRFREL

SEQ ID NO: 13106 - protein, 15 aa, Artificial Sequence
  Synthetic Peptide
CWFIDSECRPRFREL

SEQ ID NO: 13107 - protein, 15 aa, Artificial Sequence
  Synthetic Peptide
CWHIDSECRPRFREL

SEQ ID NO: 13108 - protein, 15 aa, Artificial Sequence
  Synthetic Peptide
CWIIDSECRPRFREL

SEQ ID NO: 13109 - protein, 15 aa, Artificial Sequence
  Synthetic Peptide
CWKIDSECRPRFREL

SEQ ID NO: 13110 - protein, 15 aa, Artificial Sequence
  Synthetic Peptide
CWLIDSECRPRFREL

SEQ ID NO: 13111 - protein, 15 aa, Artificial Sequence
  Synthetic Peptide
CWYIDSECRPRFREL

SEQ ID NO: 13112 - protein, 15 aa, Artificial Sequence
  Synthetic Peptide
CWMIDSEARPRFREL

SEQ ID NO: 13113 - protein, 15 aa, Artificial Sequence
  Synthetic Peptide
CWMIDSEFRPRFREL

SEQ ID NO: 13114 - protein, 15 aa, Artificial Sequence
  Synthetic Peptide
CWMIDSEHRPRFREL

SEQ ID NO: 13115 - protein, 15 aa, Artificial Sequence
  Synthetic Peptide
CWMIDSEIRPRFREL

SEQ ID NO: 13116 - protein, 15 aa, Artificial Sequence
  Synthetic Peptide
CWMIDSELRPRFREL

SEQ ID NO: 13117 - protein, 15 aa, Artificial Sequence
  Synthetic Peptide
CWMIDSENRPRFREL

SEQ ID NO: 13118 - protein, 15 aa, Artificial Sequence
  Synthetic Peptide
CWMIDSESRPRFREL

SEQ ID NO: 13119 - protein, 15 aa, Artificial Sequence
  Synthetic Peptide
CWMIDSETRPRFREL

SEQ ID NO: 13120 - protein, 15 aa, Artificial Sequence
  Synthetic Peptide
CWMIDSEVRPRFREL

SEQ ID NO: 13121 - protein, 15 aa, Artificial Sequence
  Synthetic Peptide
MWDLVLSIALSVGCT

SEQ ID NO: 13122 - protein, 15 aa, Artificial Sequence
  Synthetic Peptide
DLVLSIALSVGCTGA

SEQ ID NO: 13123 - protein, 15 aa, Artificial Sequence
  Synthetic Peptide
HPQWVLTAAHCLKKN

SEQ ID NO: 13124 - protein, 15 aa, Artificial Sequence
  Synthetic Peptide
QWVLTAAHCLKKNSQ

SEQ ID NO: 13125 - protein, 15 aa, Artificial Sequence
  Synthetic Peptide
GQRVPVSHSFPHPLY

SEQ ID NO: 13126 - protein, 15 aa, Artificial Sequence
  Synthetic Peptide
RVPVSHSFPHPLYNM

SEQ ID NO: 13127 - protein, 15 aa, Artificial Sequence
  Synthetic Peptide
PHPLYNMSLLKHQSL

SEQ ID NO: 13128 - protein, 15 aa, Artificial Sequence
  Synthetic Peptide
HPLYNMSLLKHQSLR

SEQ ID NO: 13129 - protein, 15 aa, Artificial Sequence
  Synthetic Peptide
NMSLLKHQSLRPDED

SEQ ID NO: 13130 - protein, 15 aa, Artificial Sequence
  Synthetic Peptide
SHDLMLLRLSEPAKI

SEQ ID NO: 13131 - protein, 15 aa, Artificial Sequence
  Synthetic Peptide
HDLMLLRLSEPAKIT

SEQ ID NO: 13132 - protein, 15 aa, Artificial Sequence
  Synthetic Peptide
PEEFLRPRSLQCVSL

SEQ ID NO: 13133 - protein, 15 aa, Artificial Sequence
  Synthetic Peptide
PRSLQCVSLHLLSND

SEQ ID NO: 13134 - protein, 15 aa, Artificial Sequence
  Synthetic Peptide
LHLLSNDMCARAYSE

SEQ ID NO: 13135 - protein, 15 aa, Artificial Sequence
  Synthetic Peptide
NGVLQGITSWGPEPC

SEQ ID NO: 13136 - protein, 15 aa, Artificial Sequence
  Synthetic Peptide
KPAVYTKVVHYRKWI

SEQ ID NO: 13137 - protein, 15 aa, Artificial Sequence
  Synthetic Peptide
VGNWQYFFPVIFSKA

SEQ ID NO: 13138 - protein, 16 aa, Artificial Sequence
  Synthetic Peptide
LVEVTLGEVPAAESPD

SEQ ID NO: 13139 - protein, 15 aa, Artificial Sequence
  Synthetic Peptide
AAPLLLARAASLSLG

SEQ ID NO: 13140 - protein, 15 aa, Artificial Sequence
  Synthetic Peptide
APLLLARAASLSLGF

SEQ ID NO: 13141 - protein, 15 aa, Artificial Sequence
  Synthetic Peptide
PLLLARAASLSLGFL

SEQ ID NO: 13142 - protein, 15 aa, Artificial Sequence
  Synthetic Peptide
SLSLGFLFLLFFWLD

SEQ ID NO: 13143 - protein, 15 aa, Artificial Sequence
  Synthetic Peptide
LLFFWLDRSVLAKEL

SEQ ID NO: 13144 - protein, 15 aa, Artificial Sequence
  Synthetic Peptide
DRSVLAKELKFVTLV

SEQ ID NO: 13145 - protein, 15 aa, Artificial Sequence
  Synthetic Peptide
AKELKFVTLVFRHGD

SEQ ID NO: 13146 - protein, 15 aa, Artificial Sequence
  Synthetic Peptide
RSPIDTFPTDPIKES

SEQ ID NO: 13147 - protein, 15 aa, Artificial Sequence
  Synthetic Peptide
FGQLTQLGMEQHYEL

SEQ ID NO: 13148 - protein, 15 aa, Artificial Sequence
  Synthetic Peptide
DRTLMSAMTNLAALF

SEQ ID NO: 13149 - protein, 15 aa, Artificial Sequence
  Synthetic Peptide
MSAMTNLAALFPPEG

SEQ ID NO: 13150 - protein, 15 aa, Artificial Sequence
  Synthetic Peptide
MTNLAALFPPEGVSI

SEQ ID NO: 13151 - protein, 15 aa, Artificial Sequence
  Synthetic Peptide
PEGVSIWNPILLWQP

SEQ ID NO: 13152 - protein, 15 aa, Artificial Sequence
  Synthetic Peptide
GVSIWNPILLWQPIP

SEQ ID NO: 13153 - protein, 15 aa, Artificial Sequence
  Synthetic Peptide
WNPILLWQPIPVHTV

SEQ ID NO: 13154 - protein, 15 aa, Artificial Sequence
  Synthetic Peptide
NPILLWQPIPVHTVP

SEQ ID NO: 13155 - protein, 15 aa, Artificial Sequence
  Synthetic Peptide
PILLWQPIPVHTVPL

SEQ ID NO: 13156 - protein, 15 aa, Artificial Sequence
  Synthetic Peptide
ILLWQPIPVHTVPLS

SEQ ID NO: 13157 - protein, 15 aa, Artificial Sequence
  Synthetic Peptide
WQPIPVHTVPLSEDQ

SEQ ID NO: 13158 - protein, 15 aa, Artificial Sequence
  Synthetic Peptide
TVPLSEDQLLYLPFR

SEQ ID NO: 13159 - protein, 15 aa, Artificial Sequence
  Synthetic Peptide
LSGLHGQDLFGIWSK

SEQ ID NO: 13160 - protein, 15 aa, Artificial Sequence
  Synthetic Peptide
YDPLYCESVHNFTLP

SEQ ID NO: 13161 - protein, 15 aa, Artificial Sequence
  Synthetic Peptide
LPSWATEDTMTKLRE

SEQ ID NO: 13162 - protein, 15 aa, Artificial Sequence
  Synthetic Peptide
LRELSELSLLSLYGI

SEQ ID NO: 13163 - protein, 15 aa, Artificial Sequence
  Synthetic Peptide
LSELSLLSLYGIHKQ

SEQ ID NO: 13164 - protein, 15 aa, Artificial Sequence
  Synthetic Peptide
LSLLSLYGIHKQKEK

SEQ ID NO: 13165 - protein, 15 aa, Artificial Sequence
  Synthetic Peptide
KSRLQGGVLVNEILN

SEQ ID NO: 13166 - protein, 15 aa, Artificial Sequence
  Synthetic Peptide
GGVLVNEILNHMKRA

SEQ ID NO: 13167 - protein, 15 aa, Artificial Sequence
  Synthetic Peptide
IPSYKKLIMYSAHDT

SEQ ID NO: 13168 - protein, 15 aa, Artificial Sequence
  Synthetic Peptide
YKKLIMYSAHDTTVS

SEQ ID NO: 13169 - protein, 15 aa, Artificial Sequence
  Synthetic Peptide
LIMYSAHDTTVSGLQ

SEQ ID NO: 13170 - protein, 15 aa, Artificial Sequence
  Synthetic Peptide
DTTVSGLQMALDVYN

SEQ ID NO: 13171 - protein, 15 aa, Artificial Sequence
  Synthetic Peptide
ALDVYNGLLPPYASC

SEQ ID NO: 13172 - protein, 15 aa, Artificial Sequence
  Synthetic Peptide
LDVYNGLLPPYASCH

SEQ ID NO: 13173 - protein, 15 aa, Artificial Sequence
  Synthetic Peptide
YNGLLPPYASCHLTE

SEQ ID NO: 13174 - protein, 15 aa, Artificial Sequence
  Synthetic Peptide
LTELYFEKGEYFVEM

SEQ ID NO: 13175 - protein, 15 aa, Artificial Sequence
  Synthetic Peptide
FAELVGPVIPQDWST

SEQ ID NO: 13176 - protein, 15 aa, Artificial Sequence
  Synthetic Peptide
GPVIPQDWSTECMTT

SEQ ID NO: 13177 - protein, 20 aa, Artificial Sequence
  Synthetic Peptide
FLYGALLLAEGFYTTGAVRQ

SEQ ID NO: 13178 - protein, 20 aa, Artificial Sequence
  Synthetic Peptide
QKGRGYRGQHQAHSLERVCH

SEQ ID NO: 13179 - protein, 20 aa, Artificial Sequence
  Synthetic Peptide
SAVPVYIYFNTWTTCQSIAF

SEQ ID NO: 13180 - protein, 20 aa, Artificial Sequence
  Synthetic Peptide
WTTCQSIAFPSKTSASIGSL

SEQ ID NO: 13181 - protein, 18 aa, Artificial Sequence
  Synthetic Peptide
AATYNFAVLKLMGRGTKF

SEQ ID NO: 13182 - protein, 15 aa, Artificial Sequence
  Synthetic Peptide
TLSVTWIGAAPLILS

SEQ ID NO: 13183 - protein, 15 aa, Artificial Sequence
  Synthetic Peptide
SVTWIGAAPLILSRI

SEQ ID NO: 13184 - protein, 15 aa, Artificial Sequence
  Synthetic Peptide
VTWIGAAPLILSRIV

SEQ ID NO: 13185 - protein, 15 aa, Artificial Sequence
  Synthetic Peptide
SQPWQVLVASRGRAV

SEQ ID NO: 13186 - protein, 15 aa, Artificial Sequence
  Synthetic Peptide
GRAVCGGVLVHPQWV

SEQ ID NO: 13187 - protein, 15 aa, Artificial Sequence
  Synthetic Peptide
GVLVHPQWVLTAAHC

SEQ ID NO: 13188 - protein, 15 aa, Artificial Sequence
  Synthetic Peptide
HPQWVLTAAHCIRNK

SEQ ID NO: 13189 - protein, 15 aa, Artificial Sequence
  Synthetic Peptide
QWVLTAAHCIRNKSV

SEQ ID NO: 13190 - protein, 15 aa, Artificial Sequence
  Synthetic Peptide
AHCIRNKSVILLGRH

SEQ ID NO: 13191 - protein, 15 aa, Artificial Sequence
  Synthetic Peptide
SVILLGRHSLFHPED

SEQ ID NO: 13192 - protein, 15 aa, Artificial Sequence
  Synthetic Peptide
VILLGRHSLFHPEDT

SEQ ID NO: 13193 - protein, 15 aa, Artificial Sequence
  Synthetic Peptide
HSLFHPEDTGQVFQV

SEQ ID NO: 13194 - protein, 15 aa, Artificial Sequence
  Synthetic Peptide
GQVFQVSHSFPHPLY

SEQ ID NO: 13195 - protein, 15 aa, Artificial Sequence
  Synthetic Peptide
VFQVSHSFPHPLYDM

SEQ ID NO: 13196 - protein, 15 aa, Artificial Sequence
  Synthetic Peptide
PHPLYDMSLLKNRFL

SEQ ID NO: 13197 - protein, 15 aa, Artificial Sequence
  Synthetic Peptide
SHDLMLLRLSEPAEL

SEQ ID NO: 13198 - protein, 15 aa, Artificial Sequence
  Synthetic Peptide
HDLMLLRLSEPAELT

SEQ ID NO: 13199 - protein, 15 aa, Artificial Sequence
  Synthetic Peptide
TDAVKVMDLPTQEPA

SEQ ID NO: 13200 - protein, 15 aa, Artificial Sequence
  Synthetic Peptide
LHVISNDVCAQVHPQ

SEQ ID NO: 13201 - protein, 15 aa, Artificial Sequence
  Synthetic Peptide
CAQVHPQKVTKFMLC

SEQ ID NO: 13202 - protein, 15 aa, Artificial Sequence
  Synthetic Peptide
GGPLVCNGVLQGITS

SEQ ID NO: 13203 - protein, 15 aa, Artificial Sequence
  Synthetic Peptide
GPLVCNGVLQGITSW

SEQ ID NO: 13204 - protein, 15 aa, Artificial Sequence
  Synthetic Peptide
NGVLQGITSWGSEPC

SEQ ID NO: 13205 - protein, 15 aa, Artificial Sequence
  Synthetic Peptide
RPSLYTKVVHYRKWI

SEQ ID NO: 13206 - protein, 15 aa, Artificial Sequence
  Synthetic Peptide
PRWLCAGALVLAGGF

SEQ ID NO: 13207 - protein, 15 aa, Artificial Sequence
  Synthetic Peptide
LGFLFGWFIKSSNEA

SEQ ID NO: 13208 - protein, 15 aa, Artificial Sequence
  Synthetic Peptide
LDELKAENIKKFLYN

SEQ ID NO: 13209 - protein, 15 aa, Artificial Sequence
  Synthetic Peptide
IKKFLYNFTQIPHLA

SEQ ID NO: 13210 - protein, 15 aa, Artificial Sequence
  Synthetic Peptide
KFLYNFTQIPHLAGT

SEQ ID NO: 13211 - protein, 15 aa, Artificial Sequence
  Synthetic Peptide
WKEFGLDSVELAHYD

SEQ ID NO: 13212 - protein, 15 aa, Artificial Sequence
  Synthetic Peptide
LAHYDVLLSYPNKTH

SEQ ID NO: 13213 - protein, 15 aa, Artificial Sequence
  Synthetic Peptide
YISIINEDGNEIFNT

SEQ ID NO: 13214 - protein, 15 aa, Artificial Sequence
  Synthetic Peptide
ISIINEDGNEIFNTS

SEQ ID NO: 13215 - protein, 15 aa, Artificial Sequence
  Synthetic Peptide
GNEIFNTSLFEPPPP

SEQ ID NO: 13216 - protein, 15 aa, Artificial Sequence
  Synthetic Peptide
EDFFKLERDMKINCS

SEQ ID NO: 13217 - protein, 15 aa, Artificial Sequence
  Synthetic Peptide
FFKLERDMKINCSGK

SEQ ID NO: 13218 - protein, 15 aa, Artificial Sequence
  Synthetic Peptide
GKVFRGNKVKNAQLA

SEQ ID NO: 13219 - protein, 15 aa, Artificial Sequence
  Synthetic Peptide
GNKVKNAQLAGAKGV

SEQ ID NO: 13220 - protein, 15 aa, Artificial Sequence
  Synthetic Peptide
GVILYSDPADYFAPG

SEQ ID NO: 13221 - protein, 15 aa, Artificial Sequence
  Synthetic Peptide
EYAYRRGIAEAVGLP

SEQ ID NO: 13222 - protein, 15 aa, Artificial Sequence
  Synthetic Peptide
AEAVGLPSIPVHPIG

SEQ ID NO: 13223 - protein, 15 aa, Artificial Sequence
  Synthetic Peptide
AVGLPSIPVHPIGYY

SEQ ID NO: 13224 - protein, 15 aa, Artificial Sequence
  Synthetic Peptide
IGYYDAQKLLEKMGG

SEQ ID NO: 13225 - protein, 15 aa, Artificial Sequence
  Synthetic Peptide
TGNFSTQKVKMHIHS

SEQ ID NO: 13226 - protein, 15 aa, Artificial Sequence
  Synthetic Peptide
TRIYNVIGTLRGAVE

SEQ ID NO: 13227 - protein, 15 aa, Artificial Sequence
  Synthetic Peptide
GAAVVHEIVRSFGTL

SEQ ID NO: 13228 - protein, 15 aa, Artificial Sequence
  Synthetic Peptide
NSRLLQERGVAYINA

SEQ ID NO: 13229 - protein, 15 aa, Artificial Sequence
  Synthetic Peptide
ERGVAYINADSSIEG

SEQ ID NO: 13230 - protein, 15 aa, Artificial Sequence
  Synthetic Peptide
GVAYINADSSIEGNY

SEQ ID NO: 13231 - protein, 15 aa, Artificial Sequence
  Synthetic Peptide
VAYINADSSIEGNYT

SEQ ID NO: 13232 - protein, 15 aa, Artificial Sequence
  Synthetic Peptide
DSSIEGNYTLRVDCT

SEQ ID NO: 13233 - protein, 15 aa, Artificial Sequence
  Synthetic Peptide
NYTLRVDCTPLMYSL

SEQ ID NO: 13234 - protein, 15 aa, Artificial Sequence
  Synthetic Peptide
CTPLMYSLVHNLTKE

SEQ ID NO: 13235 - protein, 15 aa, Artificial Sequence
  Synthetic Peptide
DFEVFFQRLGIASGR

SEQ ID NO: 13236 - protein, 15 aa, Artificial Sequence
  Synthetic Peptide
EVFFQRLGIASGRAR

SEQ ID NO: 13237 - protein, 15 aa, Artificial Sequence
  Synthetic Peptide
TNKFSGYPLYHSVYE

SEQ ID NO: 13238 - protein, 15 aa, Artificial Sequence
  Synthetic Peptide
YDPMFKYHLTVAQVR

SEQ ID NO: 13239 - protein, 15 aa, Artificial Sequence
  Synthetic Peptide
DPMFKYHLTVAQVRG

SEQ ID NO: 13240 - protein, 15 aa, Artificial Sequence
  Synthetic Peptide
MFKYHLTVAQVRGGM

SEQ ID NO: 13241 - protein, 15 aa, Artificial Sequence
  Synthetic Peptide
KYHLTVAQVRGGMVF

SEQ ID NO: 13242 - protein, 15 aa, Artificial Sequence
  Synthetic Peptide
VAQVRGGMVFELANS

SEQ ID NO: 13243 - protein, 15 aa, Artificial Sequence
  Synthetic Peptide
RGGMVFELANSIVLP

SEQ ID NO: 13244 - protein, 15 aa, Artificial Sequence
  Synthetic Peptide
GMVFELANSIVLPFD

SEQ ID NO: 13245 - protein, 15 aa, Artificial Sequence
  Synthetic Peptide
VFELANSIVLPFDCR

SEQ ID NO: 13246 - protein, 15 aa, Artificial Sequence
  Synthetic Peptide
ADKIYSISMKHPQEM

SEQ ID NO: 13247 - protein, 15 aa, Artificial Sequence
  Synthetic Peptide
IYSISMKHPQEMKTY

SEQ ID NO: 13248 - protein, 15 aa, Artificial Sequence
  Synthetic Peptide
PQEMKTYSVSFDSLF

SEQ ID NO: 13249 - protein, 15 aa, Artificial Sequence
  Synthetic Peptide
TYSVSFDSLFSAVKN

SEQ ID NO: 13250 - protein, 15 aa, Artificial Sequence
  Synthetic Peptide
VLRMMNDQLMFLERA

SEQ ID NO: 13251 - protein, 15 aa, Artificial Sequence
  Synthetic Peptide
LRMMNDQLMFLERAF

SEQ ID NO: 13252 - protein, 15 aa, Artificial Sequence
  Synthetic Peptide
DQLMFLERAFIDPLG

SEQ ID NO: 13253 - protein, 15 aa, Artificial Sequence
  Synthetic Peptide
RHVIYAPSSHNKYAG

SEQ ID NO: 13254 - protein, 15 aa, Artificial Sequence
  Synthetic Peptide
RQIYVAAFTVQAAAE

SEQ ID NO: 13255 - protein, 15 aa, Artificial Sequence
  Synthetic Peptide
QIYVAAFTVQAAAET

SEQ ID NO: 13256 - protein, 15 aa, Artificial Sequence
  Synthetic Peptide
VAAFTVQAAAETLSE

SEQ ID NO: 13257 - protein, 10 aa, Artificial Sequence
  Synthetic Peptide
CSMSYTWTGA

SEQ ID NO: 13258 - protein, 10 aa, Artificial Sequence
  Synthetic Peptide
VTFDPIPIHY

SEQ ID NO: 13259 - protein, 9 aa, Artificial Sequence
  Synthetic Peptide
SFEPIPIHY

SEQ ID NO: 13260 - protein, 9 aa, Artificial Sequence
  Synthetic Peptide
SFDPIPIHY

SEQ ID NO: 13261 - protein, 10 aa, Artificial Sequence
  Synthetic Peptide
MRDNWRSELY

SEQ ID NO: 13262 - protein, 10 aa, Artificial Sequence
  Synthetic Peptide
QTRVLAIERY

SEQ ID NO: 13263 - protein, 10 aa, Artificial Sequence
  Synthetic Peptide
EISNYTDTIY

SEQ ID NO: 13264 - protein, 10 aa, Artificial Sequence
  Synthetic Peptide
EISNYTDIIY

SEQ ID NO: 13265 - protein, 9 aa, Artificial Sequence
  Synthetic Peptide
ISNYTDTIY

SEQ ID NO: 13266 - protein, 10 aa, Artificial Sequence
  Synthetic Peptide
WFDITKWLWY

SEQ ID NO: 13267 - protein, 10 aa, Artificial Sequence
  Synthetic Peptide
WFSITNWLWY

SEQ ID NO: 13268 - protein, 10 aa, Artificial Sequence
  Synthetic Peptide
WFDITNWLWY

SEQ ID NO: 13269 - protein, 9 aa, Artificial Sequence
  Synthetic Peptide
FSITNWLWY

SEQ ID NO: 13270 - protein, 9 aa, Artificial Sequence
  Synthetic Peptide
RFALNPGLL

SEQ ID NO: 13271 - protein, 9 aa, Artificial Sequence
  Synthetic Peptide
GSEELRSLY

SEQ ID NO: 13272 - protein, 9 aa, Artificial Sequence
  Synthetic Peptide
GTEELRSLY

SEQ ID NO: 13273 - protein, 9 aa, Artificial Sequence
  Synthetic Peptide
SSSKVSQNY

SEQ ID NO: 13274 - protein, 9 aa, Artificial Sequence
  Synthetic Peptide
RMYSPVSIL

SEQ ID NO: 13275 - protein, 9 aa, Artificial Sequence
  Synthetic Peptide
HIGPGRAFY

SEQ ID NO: 13276 - protein, 9 aa, Artificial Sequence
  Synthetic Peptide
IVNRVRQGY

SEQ ID NO: 13277 - protein, 9 aa, Artificial Sequence
  Synthetic Peptide
KYCWNLLQY

SEQ ID NO: 13278 - protein, 9 aa, Artificial Sequence
  Synthetic Peptide
KIQNFRVYY

SEQ ID NO: 13279 - protein, 10 aa, Artificial Sequence
  Synthetic Peptide
RQEILDLWVY

SEQ ID NO: 13280 - protein, 10 aa, Artificial Sequence
  Synthetic Peptide
RTEILDLWVY

SEQ ID NO: 13281 - protein, 9 aa, Artificial Sequence
  Synthetic Peptide
GYFPDWQNY

SEQ ID NO: 13282 - protein, 9 aa, Artificial Sequence
  Synthetic Peptide
YTPGPGTRY

SEQ ID NO: 13283 - protein, 9 aa, Artificial Sequence
  Synthetic Peptide
YTPGPGVRY

SEQ ID NO: 13284 - protein, 9 aa, Artificial Sequence
  Synthetic Peptide
YTDGPGTRY

SEQ ID NO: 13285 - protein, 9 aa, Artificial Sequence
  Synthetic Peptide
YTDGPGVRY

SEQ ID NO: 13286 - protein, 10 aa, Artificial Sequence
  Synthetic Peptide
RQDILDLWVY

SEQ ID NO: 13287 - protein, 9 aa, Artificial Sequence
  Synthetic Peptide
LMWKFDSSL

SEQ ID NO: 13288 - protein, 10 aa, Artificial Sequence
  Synthetic Peptide
MWKFDSRLAL

SEQ ID NO: 13289 - protein, 10 aa, Artificial Sequence
  Synthetic Peptide
HMDREKHPEY

SEQ ID NO: 13290 - protein, 10 aa, Artificial Sequence
  Synthetic Peptide
HYARELHPEY

SEQ ID NO: 13291 - protein, 10 aa, Artificial Sequence
  Synthetic Peptide
HMARELHPEY

SEQ ID NO: 13292 - protein, 10 aa, Artificial Sequence
  Synthetic Peptide
HTAREKHPEY

SEQ ID NO: 13293 - protein, 10 aa, Artificial Sequence
  Synthetic Peptide
HMDRELHPEY

SEQ ID NO: 13294 - protein, 10 aa, Artificial Sequence
  Synthetic Peptide
HTARELHPEY

SEQ ID NO: 13295 - protein, 11 aa, Artificial Sequence
  Synthetic Peptide
RSLYNTVATLY

SEQ ID NO: 13296 - protein, 10 aa, Artificial Sequence
  Synthetic Peptide
ITKIGPENPY

SEQ ID NO: 13297 - protein, 9 aa, Artificial Sequence
  Synthetic Peptide
ETPGIRYQY

SEQ ID NO: 13298 - protein, 10 aa, Artificial Sequence
  Synthetic Peptide
RTKNPEIVIY

SEQ ID NO: 13299 - protein, 10 aa, Artificial Sequence
  Synthetic Peptide
ETWETWWTDY

SEQ ID NO: 13300 - protein, 10 aa, Artificial Sequence
  Synthetic Peptide
ETWETWWMDY

SEQ ID NO: 13301 - protein, 9 aa, Artificial Sequence
  Synthetic Peptide
TWETWWTDY

SEQ ID NO: 13302 - protein, 10 aa, Artificial Sequence
  Synthetic Peptide
NTPPLVKLWY

SEQ ID NO: 13303 - protein, 9 aa, Artificial Sequence
  Synthetic Peptide
ETKKGKAGY

SEQ ID NO: 13304 - protein, 9 aa, Artificial Sequence
  Synthetic Peptide
ETKLGKAGY

SEQ ID NO: 13305 - protein, 9 aa, Artificial Sequence
  Synthetic Peptide
QMAVFIHNF

SEQ ID NO: 13306 - protein, 10 aa, Artificial Sequence
  Synthetic Peptide
ITKIQNFRVY

SEQ ID NO: 13307 - protein, 9 aa, Artificial Sequence
  Synthetic Peptide
ISERILSTY

SEQ ID NO: 13308 - protein, 9 aa, Artificial Sequence
  Synthetic Peptide
KQNPDIVIY

SEQ ID NO: 13309 - protein, 9 aa, Artificial Sequence
  Synthetic Peptide
KLNWASQIY

SEQ ID NO: 13310 - protein, 9 aa, Artificial Sequence
  Synthetic Peptide
QTKGLGISY

SEQ ID NO: 13311 - protein, 9 aa, Artificial Sequence
  Synthetic Peptide
NTDKSLVKY

SEQ ID NO: 13312 - protein, 10 aa, Artificial Sequence
  Synthetic Peptide
WKSLVKHHMY

SEQ ID NO: 13313 - protein, 9 aa, Artificial Sequence
  Synthetic Peptide
KSLVKHHMY

SEQ ID NO: 13314 - protein, 9 aa, Artificial Sequence
  Synthetic Peptide
NSLVKHHMY

SEQ ID NO: 13315 - protein, 9 aa, Artificial Sequence
  Synthetic Peptide
NSDVKHHMY

SEQ ID NO: 13316 - protein, 9 aa, Artificial Sequence
  Synthetic Peptide
NYLVKHHMY

SEQ ID NO: 13317 - protein, 9 aa, Artificial Sequence
  Synthetic Peptide
NTLVKHHMY

SEQ ID NO: 13318 - protein, 10 aa, Artificial Sequence
  Synthetic Peptide
VSRRANGWFY

SEQ ID NO: 13319 - protein, 10 aa, Artificial Sequence
  Synthetic Peptide
VSRRAKGWFY

SEQ ID NO: 13320 - protein, 10 aa, Artificial Sequence
  Synthetic Peptide
VSDRANGWFY

SEQ ID NO: 13321 - protein, 10 aa, Artificial Sequence
  Synthetic Peptide
VTRRANGWFY

SEQ ID NO: 13322 - protein, 10 aa, Artificial Sequence
  Synthetic Peptide
VTRRAKGWFY

SEQ ID NO: 13323 - protein, 10 aa, Artificial Sequence
  Synthetic Peptide
VSRDAKGWFY

SEQ ID NO: 13324 - protein, 10 aa, Artificial Sequence
  Synthetic Peptide
VSIEWRQRRY

SEQ ID NO: 13325 - protein, 10 aa, Artificial Sequence
  Synthetic Peptide
VSIEWRKRRY

SEQ ID NO: 13326 - protein, 10 aa, Artificial Sequence
  Synthetic Peptide
VSDEWRLRRY

SEQ ID NO: 13327 - protein, 10 aa, Artificial Sequence
  Synthetic Peptide
VSIEWRLRRY

SEQ ID NO: 13328 - protein, 10 aa, Artificial Sequence
  Synthetic Peptide
VTIEWRLRRY

SEQ ID NO: 13329 - protein, 9 aa, Artificial Sequence
  Synthetic Peptide
SIDWRLRRY

SEQ ID NO: 13330 - protein, 9 aa, Artificial Sequence
  Synthetic Peptide
SYEWRLRRY

SEQ ID NO: 13331 - protein, 9 aa, Artificial Sequence
  Synthetic Peptide
SIEWRLRRY

SEQ ID NO: 13332 - protein, 9 aa, Artificial Sequence
  Synthetic Peptide
SIDWRQRRY

SEQ ID NO: 13333 - protein, 9 aa, Artificial Sequence
  Synthetic Peptide
STEWRQRRY

SEQ ID NO: 13334 - protein, 9 aa, Artificial Sequence
  Synthetic Peptide
STEWRLRRY

SEQ ID NO: 13335 - protein, 10 aa, Artificial Sequence
  Synthetic Peptide
RYSTQVDPGY

SEQ ID NO: 13336 - protein, 10 aa, Artificial Sequence
  Synthetic Peptide
DLADQLIHLY

SEQ ID NO: 13337 - protein, 10 aa, Artificial Sequence
  Synthetic Peptide
GLDDQLIHLY

SEQ ID NO: 13338 - protein, 10 aa, Artificial Sequence
  Synthetic Peptide
GYADQLIHLY

SEQ ID NO: 13339 - protein, 10 aa, Artificial Sequence
  Synthetic Peptide
GLADQLIHLY

SEQ ID NO: 13340 - protein, 10 aa, Artificial Sequence
  Synthetic Peptide
DTADQLIHLY

SEQ ID NO: 13341 - protein, 10 aa, Artificial Sequence
  Synthetic Peptide
DLDDQLIHLY

SEQ ID NO: 13342 - protein, 10 aa, Artificial Sequence
  Synthetic Peptide
GTADQLIHLY

SEQ ID NO: 13343 - protein, 10 aa, Artificial Sequence
  Synthetic Peptide
LADQLIHMHY

SEQ ID NO: 13344 - protein, 10 aa, Artificial Sequence
  Synthetic Peptide
LADQLIHMYY

SEQ ID NO: 13345 - protein, 9 aa, Artificial Sequence
  Synthetic Peptide
LADQLIHLY

SEQ ID NO: 13346 - protein, 10 aa, Artificial Sequence
  Synthetic Peptide
LTDQLIHMHY

SEQ ID NO: 13347 - protein, 10 aa, Artificial Sequence
  Synthetic Peptide
LYDQLIHMHY

SEQ ID NO: 13348 - protein, 10 aa, Artificial Sequence
  Synthetic Peptide
LFDQLIHMHY

SEQ ID NO: 13349 - protein, 10 aa, Artificial Sequence
  Synthetic Peptide
LTDQLIHMYY

SEQ ID NO: 13350 - protein, 10 aa, Artificial Sequence
  Synthetic Peptide
LFDQLIHMYY

SEQ ID NO: 13351 - protein, 10 aa, Artificial Sequence
  Synthetic Peptide
LYDQLIHMYY

SEQ ID NO: 13352 - protein, 9 aa, Artificial Sequence
  Synthetic Peptide
LTDQLIHLY

SEQ ID NO: 13353 - protein, 9 aa, Artificial Sequence
  Synthetic Peptide
LFDQLIHLY

SEQ ID NO: 13354 - protein, 9 aa, Artificial Sequence
  Synthetic Peptide
LYDQLIHLY

SEQ ID NO: 13355 - protein, 9 aa, Artificial Sequence
  Synthetic Peptide
VWTIVYIEY

SEQ ID NO: 13356 - protein, 9 aa, Artificial Sequence
  Synthetic Peptide
VWDIVYIEY

SEQ ID NO: 13357 - protein, 9 aa, Artificial Sequence
  Synthetic Peptide
VTTIVYIEY

SEQ ID NO: 13358 - protein, 9 aa, Artificial Sequence
  Synthetic Peptide
GTGCNGWFY

SEQ ID NO: 13359 - protein, 9 aa, Artificial Sequence
  Synthetic Peptide
GTDCNGWFY

SEQ ID NO: 13360 - protein, 9 aa, Artificial Sequence
  Synthetic Peptide
LSDLQDSGY

SEQ ID NO: 13361 - protein, 9 aa, Artificial Sequence
  Synthetic Peptide
QTDYYGLYY

SEQ ID NO: 13362 - protein, 9 aa, Artificial Sequence
  Synthetic Peptide
SSNLQGKLY

SEQ ID NO: 13363 - protein, 10 aa, Artificial Sequence
  Synthetic Peptide
NSNTKATLLY

SEQ ID NO: 13364 - protein, 10 aa, Artificial Sequence
  Synthetic Peptide
SSNTKANILY

SEQ ID NO: 13365 - protein, 9 aa, Artificial Sequence
  Synthetic Peptide
CTDWCITGY

SEQ ID NO: 13366 - protein, 9 aa, Artificial Sequence
  Synthetic Peptide
STDAALYWY

SEQ ID NO: 13367 - protein, 9 aa, Artificial Sequence
  Synthetic Peptide
STAAALYWY

SEQ ID NO: 13368 - protein, 9 aa, Artificial Sequence
  Synthetic Peptide
SSDAALYWY

SEQ ID NO: 13369 - protein, 9 aa, Artificial Sequence
  Synthetic Peptide
SSVAALYWY

SEQ ID NO: 13370 - protein, 9 aa, Artificial Sequence
  Synthetic Peptide
KSDIVTLTY

SEQ ID NO: 13371 - protein, 9 aa, Artificial Sequence
  Synthetic Peptide
VTDDSEIAY

SEQ ID NO: 13372 - protein, 9 aa, Artificial Sequence
  Synthetic Peptide
VMDDSEIAY

SEQ ID NO: 13373 - protein, 9 aa, Artificial Sequence
  Synthetic Peptide
LSEMVQWAY

SEQ ID NO: 13374 - protein, 9 aa, Artificial Sequence
  Synthetic Peptide
LSEMIQWAY

SEQ ID NO: 13375 - protein, 9 aa, Artificial Sequence
  Synthetic Peptide
FGEMVQWAY

SEQ ID NO: 13376 - protein, 9 aa, Artificial Sequence
  Synthetic Peptide
LSDMVQWAY

SEQ ID NO: 13377 - protein, 9 aa, Artificial Sequence
  Synthetic Peptide
LSQMVQWAY

SEQ ID NO: 13378 - protein, 9 aa, Artificial Sequence
  Synthetic Peptide
LTDDSDIAY

SEQ ID NO: 13379 - protein, 10 aa, Artificial Sequence
  Synthetic Peptide
LTDDSDIAYY

SEQ ID NO: 13380 - protein, 9 aa, Artificial Sequence
  Synthetic Peptide
ITDDSDIAY

SEQ ID NO: 13381 - protein, 9 aa, Artificial Sequence
  Synthetic Peptide
ITDDSEIAY

SEQ ID NO: 13382 - protein, 9 aa, Artificial Sequence
  Synthetic Peptide
IVDDSEIAY

SEQ ID NO: 13383 - protein, 9 aa, Artificial Sequence
  Synthetic Peptide
MSDSQWIKY

SEQ ID NO: 13384 - protein, 9 aa, Artificial Sequence
  Synthetic Peptide
MSMSQWIKY

SEQ ID NO: 13385 - protein, 9 aa, Artificial Sequence
  Synthetic Peptide
ISWTYIDDY

SEQ ID NO: 13386 - protein, 9 aa, Artificial Sequence
  Synthetic Peptide
CQDKILEHY

SEQ ID NO: 13387 - protein, 9 aa, Artificial Sequence
  Synthetic Peptide
CTDKILEHY

SEQ ID NO: 13388 - protein, 9 aa, Artificial Sequence
  Synthetic Peptide
VQDKILDIY

SEQ ID NO: 13389 - protein, 9 aa, Artificial Sequence
  Synthetic Peptide
CQDKILTHY

SEQ ID NO: 13390 - protein, 9 aa, Artificial Sequence
  Synthetic Peptide
VQEKILDLY

SEQ ID NO: 13391 - protein, 9 aa, Artificial Sequence
  Synthetic Peptide
LQDKIIDHY

SEQ ID NO: 13392 - protein, 9 aa, Artificial Sequence
  Synthetic Peptide
LTDKIIDHY

SEQ ID NO: 13393 - protein, 9 aa, Artificial Sequence
  Synthetic Peptide
LTDKILDHY

SEQ ID NO: 13394 - protein, 9 aa, Artificial Sequence
  Synthetic Peptide
LQDKILDHY

SEQ ID NO: 13395 - protein, 10 aa, Artificial Sequence
  Synthetic Peptide
STDLRDHIDY

SEQ ID NO: 13396 - protein, 10 aa, Artificial Sequence
  Synthetic Peptide
MLETLNNTEY

SEQ ID NO: 13397 - protein, 10 aa, Artificial Sequence
  Synthetic Peptide
MTETLNNTEY

SEQ ID NO: 13398 - protein, 9 aa, Artificial Sequence
  Synthetic Peptide
YVAWKYIYY

SEQ ID NO: 13399 - protein, 9 aa, Artificial Sequence
  Synthetic Peptide
IVEGQVDYY

SEQ ID NO: 13400 - protein, 9 aa, Artificial Sequence
  Synthetic Peptide
QVDYYGLYY

SEQ ID NO: 13401 - protein, 9 aa, Artificial Sequence
  Synthetic Peptide
EVDYVGLYY

SEQ ID NO: 13402 - protein, 9 aa, Artificial Sequence
  Synthetic Peptide
KVDYIGMYY

SEQ ID NO: 13403 - protein, 10 aa, Artificial Sequence
  Synthetic Peptide
ATDVSHRGLY

SEQ ID NO: 13404 - protein, 10 aa, Artificial Sequence
  Synthetic Peptide
ATCVSHRGLY

SEQ ID NO: 13405 - protein, 9 aa, Artificial Sequence
  Synthetic Peptide
CVSHRGLYY

SEQ ID NO: 13406 - protein, 9 aa, Artificial Sequence
  Synthetic Peptide
GNEKTYFKY

SEQ ID NO: 13407 - protein, 9 aa, Artificial Sequence
  Synthetic Peptide
DSVSSTCRY

SEQ ID NO: 13408 - protein, 9 aa, Artificial Sequence
  Synthetic Peptide
VTDSRNTKY

SEQ ID NO: 13409 - protein, 10 aa, Artificial Sequence
  Synthetic Peptide
ESNSLKCLRY

SEQ ID NO: 13410 - protein, 9 aa, Artificial Sequence
  Synthetic Peptide
WTSTDNKNY

SEQ ID NO: 13411 - protein, 9 aa, Artificial Sequence
  Synthetic Peptide
KTDILTVTY

SEQ ID NO: 13412 - protein, 9 aa, Artificial Sequence
  Synthetic Peptide
KTGILTVTY

SEQ ID NO: 13413 - protein, 9 aa, Artificial Sequence
  Synthetic Peptide
KSAIVTLTY

SEQ ID NO: 13414 - protein, 9 aa, Artificial Sequence
  Synthetic Peptide
NTDILTVTY

SEQ ID NO: 13415 - protein, 9 aa, Artificial Sequence
  Synthetic Peptide
NTGILTVTY

SEQ ID NO: 13416 - protein, 9 aa, Artificial Sequence
  Synthetic Peptide
DSDQILVGY

SEQ ID NO: 13417 - protein, 9 aa, Artificial Sequence
  Synthetic Peptide
DSVQILVGY

SEQ ID NO: 13418 - protein, 10 aa, Artificial Sequence
  Synthetic Peptide
RFEDPTRRPY

SEQ ID NO: 13419 - protein, 9 aa, Artificial Sequence
  Synthetic Peptide
LSDALEIPY

SEQ ID NO: 13420 - protein, 9 aa, Artificial Sequence
  Synthetic Peptide
LSSALEIPY

SEQ ID NO: 13421 - protein, 9 aa, Artificial Sequence
  Synthetic Peptide
LTSALEIPY

SEQ ID NO: 13422 - protein, 10 aa, Artificial Sequence
  Synthetic Peptide
LTDVSIACVY

SEQ ID NO: 13423 - protein, 10 aa, Artificial Sequence
  Synthetic Peptide
LTDIEITCVY

SEQ ID NO: 13424 - protein, 10 aa, Artificial Sequence
  Synthetic Peptide
ITDIILECVY

SEQ ID NO: 13425 - protein, 9 aa, Artificial Sequence
  Synthetic Peptide
KTDQRSEVY

SEQ ID NO: 13426 - protein, 9 aa, Artificial Sequence
  Synthetic Peptide
ATLERTEVY

SEQ ID NO: 13427 - protein, 9 aa, Artificial Sequence
  Synthetic Peptide
LFTDLRIVY

SEQ ID NO: 13428 - protein, 9 aa, Artificial Sequence
  Synthetic Peptide
VFADLRIVY

SEQ ID NO: 13429 - protein, 9 aa, Artificial Sequence
  Synthetic Peptide
AFTDLTIVY

SEQ ID NO: 13430 - protein, 9 aa, Artificial Sequence
  Synthetic Peptide
VTADLRIVY

SEQ ID NO: 13431 - protein, 9 aa, Artificial Sequence
  Synthetic Peptide
ATTDLTIVY

SEQ ID NO: 13432 - protein, 8 aa, Artificial Sequence
  Synthetic Peptide
FTDLTIVY

SEQ ID NO: 13433 - protein, 9 aa, Artificial Sequence
  Synthetic Peptide
AFKDLFVVY

SEQ ID NO: 13434 - protein, 9 aa, Artificial Sequence
  Synthetic Peptide
RFLSKISEY

SEQ ID NO: 13435 - protein, 10 aa, Artificial Sequence
  Synthetic Peptide
YSDVSEFRWY

SEQ ID NO: 13436 - protein, 10 aa, Artificial Sequence
  Synthetic Peptide
LSDISEYRHY

SEQ ID NO: 13437 - protein, 10 aa, Artificial Sequence
  Synthetic Peptide
YSKVSEFRWY

SEQ ID NO: 13438 - protein, 10 aa, Artificial Sequence
  Synthetic Peptide
LSKISEYRHY

SEQ ID NO: 13439 - protein, 10 aa, Artificial Sequence
  Synthetic Peptide
YTKVSEFRWY

SEQ ID NO: 13440 - protein, 9 aa, Artificial Sequence
  Synthetic Peptide
LFYSKVRKY

SEQ ID NO: 13441 - protein, 10 aa, Artificial Sequence
  Synthetic Peptide
FTSRIRELRY

SEQ ID NO: 13442 - protein, 10 aa, Artificial Sequence
  Synthetic Peptide
YSDIRELRHY

SEQ ID NO: 13443 - protein, 9 aa, Artificial Sequence
  Synthetic Peptide
YSRIRELRY

SEQ ID NO: 13444 - protein, 10 aa, Artificial Sequence
  Synthetic Peptide
YSDIRELRYY

SEQ ID NO: 13445 - protein, 10 aa, Artificial Sequence
  Synthetic Peptide
FTSKVRKYRY

SEQ ID NO: 13446 - protein, 10 aa, Artificial Sequence
  Synthetic Peptide
FYSKVRKYRY

SEQ ID NO: 13447 - protein, 9 aa, Artificial Sequence
  Synthetic Peptide
VSEFRWYRY

SEQ ID NO: 13448 - protein, 9 aa, Artificial Sequence
  Synthetic Peptide
ISEYRHYQY

SEQ ID NO: 13449 - protein, 9 aa, Artificial Sequence
  Synthetic Peptide
ISEYRHYNY

SEQ ID NO: 13450 - protein, 9 aa, Artificial Sequence
  Synthetic Peptide
ISDYRHYQY

SEQ ID NO: 13451 - protein, 9 aa, Artificial Sequence
  Synthetic Peptide
ISDYRHYNY

SEQ ID NO: 13452 - protein, 9 aa, Artificial Sequence
  Synthetic Peptide
YSDVRKYRY

SEQ ID NO: 13453 - protein, 9 aa, Artificial Sequence
  Synthetic Peptide
VSDFRWYRY

SEQ ID NO: 13454 - protein, 9 aa, Artificial Sequence
  Synthetic Peptide
VTEFRWYRY

SEQ ID NO: 13455 - protein, 10 aa, Artificial Sequence
  Synthetic Peptide
EYRHYQYSLY

SEQ ID NO: 13456 - protein, 10 aa, Artificial Sequence
  Synthetic Peptide
EYRHYNYSLY

SEQ ID NO: 13457 - protein, 10 aa, Artificial Sequence
  Synthetic Peptide
EYRHYNYSVY

SEQ ID NO: 13458 - protein, 9 aa, Artificial Sequence
  Synthetic Peptide
KFYSKISEY

SEQ ID NO: 13459 - protein, 9 aa, Artificial Sequence
  Synthetic Peptide
ISDYRHYCY

SEQ ID NO: 13460 - protein, 9 aa, Artificial Sequence
  Synthetic Peptide
ISEYRHYCY

SEQ ID NO: 13461 - protein, 10 aa, Artificial Sequence
  Synthetic Peptide
EYRHYCYSLY

SEQ ID NO: 13462 - protein, 11 aa, Artificial Sequence
  Synthetic Peptide
TLEKLTNTGLY

SEQ ID NO: 13463 - protein, 11 aa, Artificial Sequence
  Synthetic Peptide
TIEKLTNTGLY

SEQ ID NO: 13464 - protein, 9 aa, Artificial Sequence
  Synthetic Peptide
LTDLLIRCY

SEQ ID NO: 13465 - protein, 9 aa, Artificial Sequence
  Synthetic Peptide
RFHNIGGRW

SEQ ID NO: 13466 - protein, 9 aa, Artificial Sequence
  Synthetic Peptide
RFHNIMGRW

SEQ ID NO: 13467 - protein, 9 aa, Artificial Sequence
  Synthetic Peptide
RFHNISGRW

SEQ ID NO: 13468 - protein, 9 aa, Artificial Sequence
  Synthetic Peptide
RFHSIAGQY

SEQ ID NO: 13469 - protein, 9 aa, Artificial Sequence
  Synthetic Peptide
RFHNIRGRW

SEQ ID NO: 13470 - protein, 10 aa, Artificial Sequence
  Synthetic Peptide
RTETPTLQDY

SEQ ID NO: 13471 - protein, 10 aa, Artificial Sequence
  Synthetic Peptide
HTDTPTLHEY

SEQ ID NO: 13472 - protein, 11 aa, Artificial Sequence
  Synthetic Peptide
PTLKEYVLDLY

SEQ ID NO: 13473 - protein, 9 aa, Artificial Sequence
  Synthetic Peptide
LKEYVLDLY

SEQ ID NO: 13474 - protein, 9 aa, Artificial Sequence
  Synthetic Peptide
LTEYVLDLY

SEQ ID NO: 13475 - protein, 9 aa, Artificial Sequence
  Synthetic Peptide
LYPEPTDLY

SEQ ID NO: 13476 - protein, 10 aa, Artificial Sequence
  Synthetic Peptide
ETDPVDLLCY

SEQ ID NO: 13477 - protein, 10 aa, Artificial Sequence
  Synthetic Peptide
ELDPVDLLCY

SEQ ID NO: 13478 - protein, 9 aa, Artificial Sequence
  Synthetic Peptide
QTEPDTSNY

SEQ ID NO: 13479 - protein, 9 aa, Artificial Sequence
  Synthetic Peptide
QAEPDTSNY

SEQ ID NO: 13480 - protein, 9 aa, Artificial Sequence
  Synthetic Peptide
QAEPDRAHY

SEQ ID NO: 13481 - protein, 10 aa, Artificial Sequence
  Synthetic Peptide
QTEQATSNYY

SEQ ID NO: 13482 - protein, 10 aa, Artificial Sequence
  Synthetic Peptide
QAEQATSNYY

SEQ ID NO: 13483 - protein, 10 aa, Artificial Sequence
  Synthetic Peptide
ATSNYYIVTY

SEQ ID NO: 13484 - protein, 10 aa, Artificial Sequence
  Synthetic Peptide
ATDNYYIVTY

SEQ ID NO: 13485 - protein, 9 aa, Artificial Sequence
  Synthetic Peptide
TSDYYIVTY

SEQ ID NO: 13486 - protein, 11 aa, Artificial Sequence
  Synthetic Peptide
RTDGNRQIIGY

SEQ ID NO: 13487 - protein, 11 aa, Artificial Sequence
  Synthetic Peptide
GTDQATPGPAY

SEQ ID NO: 13488 - protein, 9 aa, Artificial Sequence
  Synthetic Peptide
QQATPGPAY

SEQ ID NO: 13489 - protein, 8 aa, Artificial Sequence
  Synthetic Peptide
YSDREIIY

SEQ ID NO: 13490 - protein, 11 aa, Artificial Sequence
  Synthetic Peptide
RSDSVILNVLY

SEQ ID NO: 13491 - protein, 11 aa, Artificial Sequence
  Synthetic Peptide
RTDSVILNVLY

SEQ ID NO: 13492 - protein, 9 aa, Artificial Sequence
  Synthetic Peptide
TTSPLNTSY

SEQ ID NO: 13493 - protein, 9 aa, Artificial Sequence
  Synthetic Peptide
AADNPPAQY

SEQ ID NO: 13494 - protein, 9 aa, Artificial Sequence
  Synthetic Peptide
AASNPPAQY

SEQ ID NO: 13495 - protein, 9 aa, Artificial Sequence
  Synthetic Peptide
ITVNNSGSY

SEQ ID NO: 13496 - protein, 11 aa, Artificial Sequence
  Synthetic Peptide
LSDTRNDVGPY

SEQ ID NO: 13497 - protein, 9 aa, Artificial Sequence
  Synthetic Peptide
VTRNDVGPY

SEQ ID NO: 13498 - protein, 10 aa, Artificial Sequence
  Synthetic Peptide
PTISPSYTYY

SEQ ID NO: 13499 - protein, 8 aa, Artificial Sequence
  Synthetic Peptide
TTSPSYTY

SEQ ID NO: 13500 - protein, 8 aa, Artificial Sequence
  Synthetic Peptide
ISDSYTYY

SEQ ID NO: 13501 - protein, 10 aa, Artificial Sequence
  Synthetic Peptide
HTASNPPAQY

SEQ ID NO: 13502 - protein, 9 aa, Artificial Sequence
  Synthetic Peptide
ITEKNSGLY

SEQ ID NO: 13503 - protein, 11 aa, Artificial Sequence
  Synthetic Peptide
TTEPEAQNTTY

SEQ ID NO: 13504 - protein, 11 aa, Artificial Sequence
  Synthetic Peptide
RSDPVTLDVLY

SEQ ID NO: 13505 - protein, 11 aa, Artificial Sequence
  Synthetic Peptide
RTDPVTLDVLY

SEQ ID NO: 13506 - protein, 9 aa, Artificial Sequence
  Synthetic Peptide
ITSPPDSSY

SEQ ID NO: 13507 - protein, 11 aa, Artificial Sequence
  Synthetic Peptide
CTSASNPSPQY

SEQ ID NO: 13508 - protein, 9 aa, Artificial Sequence
  Synthetic Peptide
ITDNNNGTY

SEQ ID NO: 13509 - protein, 11 aa, Artificial Sequence
  Synthetic Peptide
ETDLDMLRHLY

SEQ ID NO: 13510 - protein, 10 aa, Artificial Sequence
  Synthetic Peptide
VTQGNLELTY

SEQ ID NO: 13511 - protein, 10 aa, Artificial Sequence
  Synthetic Peptide
RTTQLFEDNY

SEQ ID NO: 13512 - protein, 10 aa, Artificial Sequence
  Synthetic Peptide
LTQRNPQLCY

SEQ ID NO: 13513 - protein, 11 aa, Artificial Sequence
  Synthetic Peptide
FTSMPNPEGRY

SEQ ID NO: 13514 - protein, 9 aa, Artificial Sequence
  Synthetic Peptide
SMDNPEGRY

SEQ ID NO: 13515 - protein, 11 aa, Artificial Sequence
  Synthetic Peptide
ASDVTACPYNY

SEQ ID NO: 13516 - protein, 9 aa, Artificial Sequence
  Synthetic Peptide
CTTACPYNY

SEQ ID NO: 13517 - protein, 8 aa, Artificial Sequence
  Synthetic Peptide
VTDCPYNY

SEQ ID NO: 13518 - protein, 11 aa, Artificial Sequence
  Synthetic Peptide
VTETLEEITGY

SEQ ID NO: 13519 - protein, 11 aa, Artificial Sequence
  Synthetic Peptide
ETDEEITGYLY

SEQ ID NO: 13520 - protein, 9 aa, Artificial Sequence
  Synthetic Peptide
LTEITGYLY

SEQ ID NO: 13521 - protein, 9 aa, Artificial Sequence
  Synthetic Peptide
VTQGLPREY

SEQ ID NO: 13522 - protein, 11 aa, Artificial Sequence
  Synthetic Peptide
ETDQCVACAHY

SEQ ID NO: 13523 - protein, 10 aa, Artificial Sequence
  Synthetic Peptide
YTMAGVGSPY

SEQ ID NO: 13524 - protein, 10 aa, Artificial Sequence
  Synthetic Peptide
YVMAGVGSPY

SEQ ID NO: 13525 - protein, 9 aa, Artificial Sequence
  Synthetic Peptide
VMAGVGSPY

SEQ ID NO: 13526 - protein, 10 aa, Artificial Sequence
  Synthetic Peptide
CMQIAKGMSY

SEQ ID NO: 13527 - protein, 11 aa, Artificial Sequence
  Synthetic Peptide
DMDDLVDAEEY

SEQ ID NO: 13528 - protein, 11 aa, Artificial Sequence
  Synthetic Peptide
PTDDPSPLQRY

SEQ ID NO: 13529 - protein, 9 aa, Artificial Sequence
  Synthetic Peptide
LTCSPQPEY

SEQ ID NO: 13530 - protein, 11 aa, Artificial Sequence
  Synthetic Peptide
ATSPAFDNLYY

SEQ ID NO: 13531 - protein, 10 aa, Artificial Sequence
  Synthetic Peptide
ASDLPTTMNY

SEQ ID NO: 13532 - protein, 10 aa, Artificial Sequence
  Synthetic Peptide
LTDHFVQENY

SEQ ID NO: 13533 - protein, 9 aa, Artificial Sequence
  Synthetic Peptide
MTDLVQENY

SEQ ID NO: 13534 - protein, 9 aa, Artificial Sequence
  Synthetic Peptide
TQDLVQEKY

SEQ ID NO: 13535 - protein, 11 aa, Artificial Sequence
  Synthetic Peptide
GTSSFSTTINY

SEQ ID NO: 13536 - protein, 9 aa, Artificial Sequence
  Synthetic Peptide
SSDSTTINY

SEQ ID NO: 13537 - protein, 8 aa, Artificial Sequence
  Synthetic Peptide
ITSKASEY

SEQ ID NO: 13538 - protein, 11 aa, Artificial Sequence
  Synthetic Peptide
VTEVVPISHLY

SEQ ID NO: 13539 - protein, 9 aa, Artificial Sequence
  Synthetic Peptide
ETVPISHLY

SEQ ID NO: 13540 - protein, 8 aa, Artificial Sequence
  Synthetic Peptide
VTGPGPGY

SEQ ID NO: 13541 - protein, 9 aa, Artificial Sequence
  Synthetic Peptide
LTQENYLEY

SEQ ID NO: 13542 - protein, 9 aa, Artificial Sequence
  Synthetic Peptide
LTHFLLLKY

SEQ ID NO: 13543 - protein, 9 aa, Artificial Sequence
  Synthetic Peptide
GTDPACYEF

SEQ ID NO: 13544 - protein, 11 aa, Artificial Sequence
  Synthetic Peptide
GTSSLPTTMNY

SEQ ID NO: 13545 - protein, 11 aa, Artificial Sequence
  Synthetic Peptide
TMDYPLWSQSY

SEQ ID NO: 13546 - protein, 10 aa, Artificial Sequence
  Synthetic Peptide
MTVDPIGHLY

SEQ ID NO: 13547 - protein, 10 aa, Artificial Sequence
  Synthetic Peptide
MEVDPIGHLY

SEQ ID NO: 13548 - protein, 9 aa, Artificial Sequence
  Synthetic Peptide
FTTCLGLSY

SEQ ID NO: 13549 - protein, 8 aa, Artificial Sequence
  Synthetic Peptide
ATDLGLSY

SEQ ID NO: 13550 - protein, 9 aa, Artificial Sequence
  Synthetic Peptide
FTQENYLEY

SEQ ID NO: 13551 - protein, 9 aa, Artificial Sequence
  Synthetic Peptide
SSDPSQKTY

SEQ ID NO: 13552 - protein, 9 aa, Artificial Sequence
  Synthetic Peptide
STVPSQKTY

SEQ ID NO: 13553 - protein, 10 aa, Artificial Sequence
  Synthetic Peptide
PSQKTYQGSY

SEQ ID NO: 13554 - protein, 10 aa, Artificial Sequence
  Synthetic Peptide
GTDKSVTCTY

SEQ ID NO: 13555 - protein, 10 aa, Artificial Sequence
  Synthetic Peptide
GTAKSVTCTY

SEQ ID NO: 13556 - protein, 10 aa, Artificial Sequence
  Synthetic Peptide
GTDVRAMAIY

SEQ ID NO: 13557 - protein, 10 aa, Artificial Sequence
  Synthetic Peptide
GTRVRAMAIY

SEQ ID NO: 13558 - protein, 10 aa, Artificial Sequence
  Synthetic Peptide
RVEGNLRVEY

SEQ ID NO: 13559 - protein, 11 aa, Artificial Sequence
  Synthetic Peptide
NTDRHSVVVPY

SEQ ID NO: 13560 - protein, 11 aa, Artificial Sequence
  Synthetic Peptide
NTFRHSVVVPY

SEQ ID NO: 13561 - protein, 11 aa, Artificial Sequence
  Synthetic Peptide
GSDCTTIHYNY

SEQ ID NO: 13562 - protein, 11 aa, Artificial Sequence
  Synthetic Peptide
GTDCTTIHYNY

SEQ ID NO: 13563 - protein, 8 aa, Artificial Sequence
  Synthetic Peptide
CTDIHYNY

SEQ ID NO: 13564 - protein, 8 aa, Artificial Sequence
  Synthetic Peptide
CTTIHYNY

SEQ ID NO: 13565 - protein, 9 aa, Artificial Sequence
  Synthetic Peptide
GVLGWSPQV

SEQ ID NO: 13566 - protein, 9 aa, Artificial Sequence
  Synthetic Peptide
VVQAGFFLV

SEQ ID NO: 13567 - protein, 9 aa, Artificial Sequence
  Synthetic Peptide
PVLPIFFCV

SEQ ID NO: 13568 - protein, 10 aa, Artificial Sequence
  Synthetic Peptide
FLLAQFTSAI

SEQ ID NO: 13569 - protein, 9 aa, Artificial Sequence
  Synthetic Peptide
YVDDVVLGV

SEQ ID NO: 13570 - protein, 9 aa, Artificial Sequence
  Synthetic Peptide
FVLSLGIHV

SEQ ID NO: 13571 - protein, 10 aa, Artificial Sequence
  Synthetic Peptide
IVRGTSFVYV

SEQ ID NO: 13572 - protein, 9 aa, Artificial Sequence
  Synthetic Peptide
HVYSHPIIV

SEQ ID NO: 13573 - protein, 9 aa, Artificial Sequence
  Synthetic Peptide
CINGVCWTV

SEQ ID NO: 13574 - protein, 10 aa, Artificial Sequence
  Synthetic Peptide
KLVALGINAV

SEQ ID NO: 13575 - protein, 9 aa, Artificial Sequence
  Synthetic Peptide
YLVAYQATV

SEQ ID NO: 13576 - protein, 9 aa, Artificial Sequence
  Synthetic Peptide
SLMAFTAAV

SEQ ID NO: 13577 - protein, 9 aa, Artificial Sequence
  Synthetic Peptide
RLTPLCVTL

SEQ ID NO: 13578 - protein, 9 aa, Artificial Sequence
  Synthetic Peptide
KLTQLCVTL

SEQ ID NO: 13579 - protein, 9 aa, Artificial Sequence
  Synthetic Peptide
KLTSLCVTL

SEQ ID NO: 13580 - protein, 9 aa, Artificial Sequence
  Synthetic Peptide
QITPLCVTL

SEQ ID NO: 13581 - protein, 9 aa, Artificial Sequence
  Synthetic Peptide
KLTFLCVTL

SEQ ID NO: 13582 - protein, 9 aa, Artificial Sequence
  Synthetic Peptide
KLTPLCVIL

SEQ ID NO: 13583 - protein, 9 aa, Artificial Sequence
  Synthetic Peptide
MTANPPIPV

SEQ ID NO: 13584 - protein, 9 aa, Artificial Sequence
  Synthetic Peptide
MTRNPPVPV

SEQ ID NO: 13585 - protein, 9 aa, Artificial Sequence
  Synthetic Peptide
MTSNPAIPV

SEQ ID NO: 13586 - protein, 9 aa, Artificial Sequence
  Synthetic Peptide
ALAEAMSQA

SEQ ID NO: 13587 - protein, 9 aa, Artificial Sequence
  Synthetic Peptide
VLAEAMGQV

SEQ ID NO: 13588 - protein, 9 aa, Artificial Sequence
  Synthetic Peptide
VLAEAMSHT

SEQ ID NO: 13589 - protein, 9 aa, Artificial Sequence
  Synthetic Peptide
VLAEAMSKA

SEQ ID NO: 13590 - protein, 9 aa, Artificial Sequence
  Synthetic Peptide
VLGEAMSQA

SEQ ID NO: 13591 - protein, 9 aa, Artificial Sequence
  Synthetic Peptide
SLYNTVATL

SEQ ID NO: 13592 - protein, 9 aa, Artificial Sequence
  Synthetic Peptide
VLAEAMSHV

SEQ ID NO: 13593 - protein, 9 aa, Artificial Sequence
  Synthetic Peptide
ILAEAMSKA

SEQ ID NO: 13594 - protein, 9 aa, Artificial Sequence
  Synthetic Peptide
VLAEAMSRV

SEQ ID NO: 13595 - protein, 9 aa, Artificial Sequence
  Synthetic Peptide
VLAEAMSAA

SEQ ID NO: 13596 - protein, 9 aa, Artificial Sequence
  Synthetic Peptide
VLAEAMAAA

SEQ ID NO: 13597 - protein, 11 aa, Artificial Sequence
  Synthetic Peptide
FLKEKGGLEGV

SEQ ID NO: 13598 - protein, 11 aa, Artificial Sequence
  Synthetic Peptide
FLKEKGGLDGV

SEQ ID NO: 13599 - protein, 10 aa, Artificial Sequence
  Synthetic Peptide
EILDLWVYHV

SEQ ID NO: 13600 - protein, 9 aa, Artificial Sequence
  Synthetic Peptide
ILDLWVYHV

SEQ ID NO: 13601 - protein, 9 aa, Artificial Sequence
  Synthetic Peptide
ILDLWVYNV

SEQ ID NO: 13602 - protein, 10 aa, Artificial Sequence
  Synthetic Peptide
WQNYTPGPGV

SEQ ID NO: 13603 - protein, 10 aa, Artificial Sequence
  Synthetic Peptide
WLNYTPGPGI

SEQ ID NO: 13604 - protein, 9 aa, Artificial Sequence
  Synthetic Peptide
LLFGWCFKL

SEQ ID NO: 13605 - protein, 9 aa, Artificial Sequence
  Synthetic Peptide
LTFGWCFKV

SEQ ID NO: 13606 - protein, 11 aa, Artificial Sequence
  Synthetic Peptide
LLLPPLERLTL

SEQ ID NO: 13607 - protein, 11 aa, Artificial Sequence
  Synthetic Peptide
LQLPPLERLTV

SEQ ID NO: 13608 - protein, 9 aa, Artificial Sequence
  Synthetic Peptide
RILQQLLFV

SEQ ID NO: 13609 - protein, 9 aa, Artificial Sequence
  Synthetic Peptide
RLLQQLLFI

SEQ ID NO: 13610 - protein, 9 aa, Artificial Sequence
  Synthetic Peptide
RTLQQLLFI

SEQ ID NO: 13611 - protein, 9 aa, Artificial Sequence
  Synthetic Peptide
RMLQQLLFI

SEQ ID NO: 13612 - protein, 9 aa, Artificial Sequence
  Synthetic Peptide
RILQQLLFT

SEQ ID NO: 13613 - protein, 9 aa, Artificial Sequence
  Synthetic Peptide
RILQQLLFA

SEQ ID NO: 13614 - protein, 9 aa, Artificial Sequence
  Synthetic Peptide
RTLQQLLFV

SEQ ID NO: 13615 - protein, 9 aa, Artificial Sequence
  Synthetic Peptide
RMLQQLLFV

SEQ ID NO: 13616 - protein, 9 aa, Artificial Sequence
  Synthetic Peptide
RMLQQLLFT

SEQ ID NO: 13617 - protein, 9 aa, Artificial Sequence
  Synthetic Peptide
RTLQQLLFA

SEQ ID NO: 13618 - protein, 9 aa, Artificial Sequence
  Synthetic Peptide
RILQQLLLI

SEQ ID NO: 13619 - protein, 9 aa, Artificial Sequence
  Synthetic Peptide
KILQQLLFI

SEQ ID NO: 13620 - protein, 9 aa, Artificial Sequence
  Synthetic Peptide
RILQQMLFI

SEQ ID NO: 13621 - protein, 9 aa, Artificial Sequence
  Synthetic Peptide
RTLQQLMFI

SEQ ID NO: 13622 - protein, 9 aa, Artificial Sequence
  Synthetic Peptide
RILQHLLFA

SEQ ID NO: 13623 - protein, 9 aa, Artificial Sequence
  Synthetic Peptide
RTLQLLLFV

SEQ ID NO: 13624 - protein, 9 aa, Artificial Sequence
  Synthetic Peptide
TILQQLLFI

SEQ ID NO: 13625 - protein, 9 aa, Artificial Sequence
  Synthetic Peptide
RILQRLLFV

SEQ ID NO: 13626 - protein, 9 aa, Artificial Sequence
  Synthetic Peptide
RVLQQLLFI

SEQ ID NO: 13627 - protein, 9 aa, Artificial Sequence
  Synthetic Peptide
RILQQPLFI

SEQ ID NO: 13628 - protein, 9 aa, Artificial Sequence
  Synthetic Peptide
RMLQHLLFI

SEQ ID NO: 13629 - protein, 9 aa, Artificial Sequence
  Synthetic Peptide
RVLQQLLFV

SEQ ID NO: 13630 - protein, 9 aa, Artificial Sequence
  Synthetic Peptide
SLSAYIIRV

SEQ ID NO: 13631 - protein, 10 aa, Artificial Sequence
  Synthetic Peptide
GMGCTGWFEV

SEQ ID NO: 13632 - protein, 9 aa, Artificial Sequence
  Synthetic Peptide
ALFNVQEGV

SEQ ID NO: 13633 - protein, 9 aa, Artificial Sequence
  Synthetic Peptide
AIFGVNPTV

SEQ ID NO: 13634 - protein, 9 aa, Artificial Sequence
  Synthetic Peptide
CLYCHLQSL

SEQ ID NO: 13635 - protein, 9 aa, Artificial Sequence
  Synthetic Peptide
AIFGVNPTI

SEQ ID NO: 13636 - protein, 9 aa, Artificial Sequence
  Synthetic Peptide
LIQPYSIYA

SEQ ID NO: 13637 - protein, 10 aa, Artificial Sequence
  Synthetic Peptide
MQCLTCTWGV

SEQ ID NO: 13638 - protein, 9 aa, Artificial Sequence
  Synthetic Peptide
SLYTHLQCL

SEQ ID NO: 13639 - protein, 9 aa, Artificial Sequence
  Synthetic Peptide
TLYAHIQCL

SEQ ID NO: 13640 - protein, 9 aa, Artificial Sequence
  Synthetic Peptide
LLQQYCLYL

SEQ ID NO: 13641 - protein, 9 aa, Artificial Sequence
  Synthetic Peptide
LIQPFILYA

SEQ ID NO: 13642 - protein, 10 aa, Artificial Sequence
  Synthetic Peptide
SLACSWGMVV

SEQ ID NO: 13643 - protein, 9 aa, Artificial Sequence
  Synthetic Peptide
ILYAHIQCL

SEQ ID NO: 13644 - protein, 9 aa, Artificial Sequence
  Synthetic Peptide
KLLEKLLCI

SEQ ID NO: 13645 - protein, 9 aa, Artificial Sequence
  Synthetic Peptide
KLMSNLLSI

SEQ ID NO: 13646 - protein, 9 aa, Artificial Sequence
  Synthetic Peptide
KLMSQLLNI

SEQ ID NO: 13647 - protein, 9 aa, Artificial Sequence
  Synthetic Peptide
KLLSKLLCV

SEQ ID NO: 13648 - protein, 9 aa, Artificial Sequence
  Synthetic Peptide
ALYWYRTGM

SEQ ID NO: 13649 - protein, 9 aa, Artificial Sequence
  Synthetic Peptide
ALYWFRTAM

SEQ ID NO: 13650 - protein, 9 aa, Artificial Sequence
  Synthetic Peptide
ALYWYRTGL

SEQ ID NO: 13651 - protein, 9 aa, Artificial Sequence
  Synthetic Peptide
ALYWYKTGI

SEQ ID NO: 13652 - protein, 9 aa, Artificial Sequence
  Synthetic Peptide
ALYWYRTGI

SEQ ID NO: 13653 - protein, 9 aa, Artificial Sequence
  Synthetic Peptide
SLQDSQFEL

SEQ ID NO: 13654 - protein, 9 aa, Artificial Sequence
  Synthetic Peptide
VQWAYDNDV

SEQ ID NO: 13655 - protein, 9 aa, Artificial Sequence
  Synthetic Peptide
VQWAFDNEV

SEQ ID NO: 13656 - protein, 9 aa, Artificial Sequence
  Synthetic Peptide
VQWAYDNEL

SEQ ID NO: 13657 - protein, 9 aa, Artificial Sequence
  Synthetic Peptide
VQWAYDHDI

SEQ ID NO: 13658 - protein, 9 aa, Artificial Sequence
  Synthetic Peptide
FQYAQLADV

SEQ ID NO: 13659 - protein, 9 aa, Artificial Sequence
  Synthetic Peptide
VQWAFDNEL

SEQ ID NO: 13660 - protein, 9 aa, Artificial Sequence
  Synthetic Peptide
MAFEYALLA

SEQ ID NO: 13661 - protein, 9 aa, Artificial Sequence
  Synthetic Peptide
QQIEFVSFL

SEQ ID NO: 13662 - protein, 9 aa, Artificial Sequence
  Synthetic Peptide
FLSALKLFL

SEQ ID NO: 13663 - protein, 9 aa, Artificial Sequence
  Synthetic Peptide
FLSYFKLFL

SEQ ID NO: 13664 - protein, 9 aa, Artificial Sequence
  Synthetic Peptide
FLGAFKKFL

SEQ ID NO: 13665 - protein, 9 aa, Artificial Sequence
  Synthetic Peptide
FLVAFKQFL

SEQ ID NO: 13666 - protein, 9 aa, Artificial Sequence
  Synthetic Peptide
FLDAFKKFL

SEQ ID NO: 13667 - protein, 9 aa, Artificial Sequence
  Synthetic Peptide
QQIEFITFL

SEQ ID NO: 13668 - protein, 9 aa, Artificial Sequence
  Synthetic Peptide
FLGALKSFL

SEQ ID NO: 13669 - protein, 9 aa, Artificial Sequence
  Synthetic Peptide
FLGALKSFV

SEQ ID NO: 13670 - protein, 10 aa, Artificial Sequence
  Synthetic Peptide
FLQGCIISYA

SEQ ID NO: 13671 - protein, 9 aa, Artificial Sequence
  Synthetic Peptide
FQGSVISFV

SEQ ID NO: 13672 - protein, 10 aa, Artificial Sequence
  Synthetic Peptide
FLKGCVISCV

SEQ ID NO: 13673 - protein, 10 aa, Artificial Sequence
  Synthetic Peptide
FLQGAIISFV

SEQ ID NO: 13674 - protein, 10 aa, Artificial Sequence
  Synthetic Peptide
FLKGCIISYV

SEQ ID NO: 13675 - protein, 9 aa, Artificial Sequence
  Synthetic Peptide
LQGAIISFV

SEQ ID NO: 13676 - protein, 10 aa, Artificial Sequence
  Synthetic Peptide
SLMKFLQGSV

SEQ ID NO: 13677 - protein, 10 aa, Artificial Sequence
  Synthetic Peptide
FLSGCVISYV

SEQ ID NO: 13678 - protein, 10 aa, Artificial Sequence
  Synthetic Peptide
FLQGSVICFV

SEQ ID NO: 13679 - protein, 9 aa, Artificial Sequence
  Synthetic Peptide
LQGSVICFV

SEQ ID NO: 13680 - protein, 10 aa, Artificial Sequence
  Synthetic Peptide
FIQGAVISFV

SEQ ID NO: 13681 - protein, 9 aa, Artificial Sequence
  Synthetic Peptide
IQGAVISFV

SEQ ID NO: 13682 - protein, 9 aa, Artificial Sequence
  Synthetic Peptide
GMIDDVTPI

SEQ ID NO: 13683 - protein, 9 aa, Artificial Sequence
  Synthetic Peptide
GMIDDVTAI

SEQ ID NO: 13684 - protein, 9 aa, Artificial Sequence
  Synthetic Peptide
YIDDYLRNL

SEQ ID NO: 13685 - protein, 9 aa, Artificial Sequence
  Synthetic Peptide
ALDGNDISV

SEQ ID NO: 13686 - protein, 9 aa, Artificial Sequence
  Synthetic Peptide
FQFQNPFPL

SEQ ID NO: 13687 - protein, 10 aa, Artificial Sequence
  Synthetic Peptide
YLHNRLVVFT

SEQ ID NO: 13688 - protein, 10 aa, Artificial Sequence
  Synthetic Peptide
RLENAILFTA

SEQ ID NO: 13689 - protein, 10 aa, Artificial Sequence
  Synthetic Peptide
RLENAILFTV

SEQ ID NO: 13690 - protein, 9 aa, Artificial Sequence
  Synthetic Peptide
TLQDVSLEV

SEQ ID NO: 13691 - protein, 9 aa, Artificial Sequence
  Synthetic Peptide
TTQDVSLEV

SEQ ID NO: 13692 - protein, 9 aa, Artificial Sequence
  Synthetic Peptide
TVQDVSLEV

SEQ ID NO: 13693 - protein, 9 aa, Artificial Sequence
  Synthetic Peptide
YTNWKFIYL

SEQ ID NO: 13694 - protein, 9 aa, Artificial Sequence
  Synthetic Peptide
YTNWGEIYI

SEQ ID NO: 13695 - protein, 9 aa, Artificial Sequence
  Synthetic Peptide
YTNWSEIYI

SEQ ID NO: 13696 - protein, 9 aa, Artificial Sequence
  Synthetic Peptide
VAWDSVYYM

SEQ ID NO: 13697 - protein, 9 aa, Artificial Sequence
  Synthetic Peptide
VAWDSVYYV

SEQ ID NO: 13698 - protein, 10 aa, Artificial Sequence
  Synthetic Peptide
YVVWDSIYYI

SEQ ID NO: 13699 - protein, 10 aa, Artificial Sequence
  Synthetic Peptide
YLCIDGQCTV

SEQ ID NO: 13700 - protein, 9 aa, Artificial Sequence
  Synthetic Peptide
VVWDSIYYI

SEQ ID NO: 13701 - protein, 10 aa, Artificial Sequence
  Synthetic Peptide
YTCIDGQCTV

SEQ ID NO: 13702 - protein, 10 aa, Artificial Sequence
  Synthetic Peptide
YVCIDGQCTV

SEQ ID NO: 13703 - protein, 9 aa, Artificial Sequence
  Synthetic Peptide
KLFCADPAL

SEQ ID NO: 13704 - protein, 9 aa, Artificial Sequence
  Synthetic Peptide
FQKYKTLFV

SEQ ID NO: 13705 - protein, 9 aa, Artificial Sequence
  Synthetic Peptide
FLSHVKIPV

SEQ ID NO: 13706 - protein, 9 aa, Artificial Sequence
  Synthetic Peptide
TLHDLCQAV

SEQ ID NO: 13707 - protein, 10 aa, Artificial Sequence
  Synthetic Peptide
TLSFVCPWCV

SEQ ID NO: 13708 - protein, 9 aa, Artificial Sequence
  Synthetic Peptide
LTNTGLYNL

SEQ ID NO: 13709 - protein, 10 aa, Artificial Sequence
  Synthetic Peptide
TLSFVCPWCA

SEQ ID NO: 13710 - protein, 9 aa, Artificial Sequence
  Synthetic Peptide
RTLHDLCQA

SEQ ID NO: 13711 - protein, 9 aa, Artificial Sequence
  Synthetic Peptide
TLHDLCQAL

SEQ ID NO: 13712 - protein, 10 aa, Artificial Sequence
  Synthetic Peptide
WQRLLLTASV

SEQ ID NO: 13713 - protein, 10 aa, Artificial Sequence
  Synthetic Peptide
WLRLLLTASL

SEQ ID NO: 13714 - protein, 11 aa, Artificial Sequence
  Synthetic Peptide
WQRLLLTASLV

SEQ ID NO: 13715 - protein, 11 aa, Artificial Sequence
  Synthetic Peptide
WLRLLLTASLL

SEQ ID NO: 13716 - protein, 10 aa, Artificial Sequence
  Synthetic Peptide
RLLLTASLLV

SEQ ID NO: 13717 - protein, 9 aa, Artificial Sequence
  Synthetic Peptide
LLLTASLLV

SEQ ID NO: 13718 - protein, 10 aa, Artificial Sequence
  Synthetic Peptide
SLLTFWNPPV

SEQ ID NO: 13719 - protein, 11 aa, Artificial Sequence
  Synthetic Peptide
SLLTFWNPPTV

SEQ ID NO: 13720 - protein, 10 aa, Artificial Sequence
  Synthetic Peptide
LLTFWNPPTV

SEQ ID NO: 13721 - protein, 11 aa, Artificial Sequence
  Synthetic Peptide
LLTFWNPPTTV

SEQ ID NO: 13722 - protein, 9 aa, Artificial Sequence
  Synthetic Peptide
LTFWNPPTV

SEQ ID NO: 13723 - protein, 9 aa, Artificial Sequence
  Synthetic Peptide
LLFWNPPTT

SEQ ID NO: 13724 - protein, 10 aa, Artificial Sequence
  Synthetic Peptide
LTFWNPPTTV

SEQ ID NO: 13725 - protein, 10 aa, Artificial Sequence
  Synthetic Peptide
LLFWNPPTTA

SEQ ID NO: 13726 - protein, 10 aa, Artificial Sequence
  Synthetic Peptide
TTAKLTIESV

SEQ ID NO: 13727 - protein, 9 aa, Artificial Sequence
  Synthetic Peptide
TAKLTIESV

SEQ ID NO: 13728 - protein, 9 aa, Artificial Sequence
  Synthetic Peptide
TLKLTIEST

SEQ ID NO: 13729 - protein, 11 aa, Artificial Sequence
  Synthetic Peptide
KVTIESTPFNV

SEQ ID NO: 13730 - protein, 10 aa, Artificial Sequence
  Synthetic Peptide
LLIESTPFNV

SEQ ID NO: 13731 - protein, 11 aa, Artificial Sequence
  Synthetic Peptide
LTIESTPFNVV

SEQ ID NO: 13732 - protein, 11 aa, Artificial Sequence
  Synthetic Peptide
LLIESTPFNVA

SEQ ID NO: 13733 - protein, 9 aa, Artificial Sequence
  Synthetic Peptide
TLESTPFNV

SEQ ID NO: 13734 - protein, 9 aa, Artificial Sequence
  Synthetic Peptide
TVESTPFNV

SEQ ID NO: 13735 - protein, 10 aa, Artificial Sequence
  Synthetic Peptide
TIESTPFNVV

SEQ ID NO: 13736 - protein, 9 aa, Artificial Sequence
  Synthetic Peptide
NVAEGKEVV

SEQ ID NO: 13737 - protein, 9 aa, Artificial Sequence
  Synthetic Peptide
NLAEGKEVL

SEQ ID NO: 13738 - protein, 10 aa, Artificial Sequence
  Synthetic Peptide
NVAEGKEVLV

SEQ ID NO: 13739 - protein, 10 aa, Artificial Sequence
  Synthetic Peptide
NLAEGKEVLL

SEQ ID NO: 13740 - protein, 11 aa, Artificial Sequence
  Synthetic Peptide
NLAEGKEVLLL

SEQ ID NO: 13741 - protein, 9 aa, Artificial Sequence
  Synthetic Peptide
VLEGKEVLL

SEQ ID NO: 13742 - protein, 11 aa, Artificial Sequence
  Synthetic Peptide
VLEGKEVLLLV

SEQ ID NO: 13743 - protein, 9 aa, Artificial Sequence
  Synthetic Peptide
EVLLLVHNV

SEQ ID NO: 13744 - protein, 9 aa, Artificial Sequence
  Synthetic Peptide
ELLLLVHNL

SEQ ID NO: 13745 - protein, 11 aa, Artificial Sequence
  Synthetic Peptide
LLLVHNLPQHV

SEQ ID NO: 13746 - protein, 10 aa, Artificial Sequence
  Synthetic Peptide
RQIIGYVIGV

SEQ ID NO: 13747 - protein, 10 aa, Artificial Sequence
  Synthetic Peptide
RLIIGYVIGT

SEQ ID NO: 13748 - protein, 9 aa, Artificial Sequence
  Synthetic Peptide
YVIGTQQAV

SEQ ID NO: 13749 - protein, 9 aa, Artificial Sequence
  Synthetic Peptide
YLIGTQQAT

SEQ ID NO: 13750 - protein, 10 aa, Artificial Sequence
  Synthetic Peptide
GTQQATPGPV

SEQ ID NO: 13751 - protein, 10 aa, Artificial Sequence
  Synthetic Peptide
GLQQATPGPA

SEQ ID NO: 13752 - protein, 9 aa, Artificial Sequence
  Synthetic Peptide
TQQATPGPV

SEQ ID NO: 13753 - protein, 9 aa, Artificial Sequence
  Synthetic Peptide
TLQATPGPA

SEQ ID NO: 13754 - protein, 9 aa, Artificial Sequence
  Synthetic Peptide
IIYPNASLV

SEQ ID NO: 13755 - protein, 9 aa, Artificial Sequence
  Synthetic Peptide
ILYPNASLL

SEQ ID NO: 13756 - protein, 10 aa, Artificial Sequence
  Synthetic Peptide
IIYPNASLLV

SEQ ID NO: 13757 - protein, 10 aa, Artificial Sequence
  Synthetic Peptide
ILYPNASLLI

SEQ ID NO: 13758 - protein, 9 aa, Artificial Sequence
  Synthetic Peptide
IQNIIQNDV

SEQ ID NO: 13759 - protein, 9 aa, Artificial Sequence
  Synthetic Peptide
ILNIIQNDT

SEQ ID NO: 13760 - protein, 10 aa, Artificial Sequence
  Synthetic Peptide
IIQNDTGFYV

SEQ ID NO: 13761 - protein, 10 aa, Artificial Sequence
  Synthetic Peptide
ILQNDTGFYT

SEQ ID NO: 13762 - protein, 9 aa, Artificial Sequence
  Synthetic Peptide
IQNDTGFYT

SEQ ID NO: 13763 - protein, 9 aa, Artificial Sequence
  Synthetic Peptide
IQNDTGFYV

SEQ ID NO: 13764 - protein, 9 aa, Artificial Sequence
  Synthetic Peptide
ILNDTGFYT

SEQ ID NO: 13765 - protein, 10 aa, Artificial Sequence
  Synthetic Peptide
IQNDTGFYTV

SEQ ID NO: 13766 - protein, 10 aa, Artificial Sequence
  Synthetic Peptide
ILNDTGFYTL

SEQ ID NO: 13767 - protein, 10 aa, Artificial Sequence
  Synthetic Peptide
YTLHVIKSDV

SEQ ID NO: 13768 - protein, 10 aa, Artificial Sequence
  Synthetic Peptide
YLLHVIKSDL

SEQ ID NO: 13769 - protein, 11 aa, Artificial Sequence
  Synthetic Peptide
VIKSDLVNEEV

SEQ ID NO: 13770 - protein, 11 aa, Artificial Sequence
  Synthetic Peptide
VLKSDLVNEEA

SEQ ID NO: 13771 - protein, 9 aa, Artificial Sequence
  Synthetic Peptide
GQFRVYPEV

SEQ ID NO: 13772 - protein, 9 aa, Artificial Sequence
  Synthetic Peptide
GLFRVYPEL

SEQ ID NO: 13773 - protein, 10 aa, Artificial Sequence
  Synthetic Peptide
AVAFTCEPEV

SEQ ID NO: 13774 - protein, 10 aa, Artificial Sequence
  Synthetic Peptide
ALAFTCEPET

SEQ ID NO: 13775 - protein, 9 aa, Artificial Sequence
  Synthetic Peptide
VLFTCEPET

SEQ ID NO: 13776 - protein, 10 aa, Artificial Sequence
  Synthetic Peptide
TLDATYLWWV

SEQ ID NO: 13777 - protein, 11 aa, Artificial Sequence
  Synthetic Peptide
RLQLSNGNRTL

SEQ ID NO: 13778 - protein, 9 aa, Artificial Sequence
  Synthetic Peptide
QLSNGNRTL

SEQ ID NO: 13779 - protein, 11 aa, Artificial Sequence
  Synthetic Peptide
QLSNGNRTLTL

SEQ ID NO: 13780 - protein, 10 aa, Artificial Sequence
  Synthetic Peptide
TLFNVTRNDV

SEQ ID NO: 13781 - protein, 9 aa, Artificial Sequence
  Synthetic Peptide
VLYGPDAPV

SEQ ID NO: 13782 - protein, 9 aa, Artificial Sequence
  Synthetic Peptide
NLNLSCHAV

SEQ ID NO: 13783 - protein, 10 aa, Artificial Sequence
  Synthetic Peptide
AQYSWFVNGV

SEQ ID NO: 13784 - protein, 10 aa, Artificial Sequence
  Synthetic Peptide
ALYSWFVNGT

SEQ ID NO: 13785 - protein, 10 aa, Artificial Sequence
  Synthetic Peptide
GTFQQSTQEV

SEQ ID NO: 13786 - protein, 10 aa, Artificial Sequence
  Synthetic Peptide
GLFQQSTQEL

SEQ ID NO: 13787 - protein, 10 aa, Artificial Sequence
  Synthetic Peptide
FQQSTQELFV

SEQ ID NO: 13788 - protein, 10 aa, Artificial Sequence
  Synthetic Peptide
FLQSTQELFI

SEQ ID NO: 13789 - protein, 9 aa, Artificial Sequence
  Synthetic Peptide
QQSTQELFV

SEQ ID NO: 13790 - protein, 9 aa, Artificial Sequence
  Synthetic Peptide
QLSTQELFI

SEQ ID NO: 13791 - protein, 10 aa, Artificial Sequence
  Synthetic Peptide
STQELFIPNV

SEQ ID NO: 13792 - protein, 10 aa, Artificial Sequence
  Synthetic Peptide
SLQELFIPNI

SEQ ID NO: 13793 - protein, 9 aa, Artificial Sequence
  Synthetic Peptide
TQELFIPNV

SEQ ID NO: 13794 - protein, 9 aa, Artificial Sequence
  Synthetic Peptide
TLELFIPNI

SEQ ID NO: 13795 - protein, 11 aa, Artificial Sequence
  Synthetic Peptide
TLELFIPNITV

SEQ ID NO: 13796 - protein, 11 aa, Artificial Sequence
  Synthetic Peptide
TVELFIPNITV

SEQ ID NO: 13797 - protein, 9 aa, Artificial Sequence
  Synthetic Peptide
EVFIPNITV

SEQ ID NO: 13798 - protein, 11 aa, Artificial Sequence
  Synthetic Peptide
NLTVNNSGSYT

SEQ ID NO: 13799 - protein, 10 aa, Artificial Sequence
  Synthetic Peptide
ITVNNSGSYV

SEQ ID NO: 13800 - protein, 9 aa, Artificial Sequence
  Synthetic Peptide
TVNNSGSYV

SEQ ID NO: 13801 - protein, 9 aa, Artificial Sequence
  Synthetic Peptide
TLNNSGSYT

SEQ ID NO: 13802 - protein, 10 aa, Artificial Sequence
  Synthetic Peptide
CQAHNSDTGV

SEQ ID NO: 13803 - protein, 10 aa, Artificial Sequence
  Synthetic Peptide
CLAHNSDTGL

SEQ ID NO: 13804 - protein, 9 aa, Artificial Sequence
  Synthetic Peptide
GLNRTTVTV

SEQ ID NO: 13805 - protein, 9 aa, Artificial Sequence
  Synthetic Peptide
RLTVTTITV

SEQ ID NO: 13806 - protein, 11 aa, Artificial Sequence
  Synthetic Peptide
RTTVTTITVYV

SEQ ID NO: 13807 - protein, 11 aa, Artificial Sequence
  Synthetic Peptide
RLTVTTITVYA

SEQ ID NO: 13808 - protein, 10 aa, Artificial Sequence
  Synthetic Peptide
TTVTTITVYV

SEQ ID NO: 13809 - protein, 10 aa, Artificial Sequence
  Synthetic Peptide
TLVTTITVYA

SEQ ID NO: 13810 - protein, 9 aa, Artificial Sequence
  Synthetic Peptide
TVTTITVYV

SEQ ID NO: 13811 - protein, 9 aa, Artificial Sequence
  Synthetic Peptide
TLTTITVYA

SEQ ID NO: 13812 - protein, 10 aa, Artificial Sequence
  Synthetic Peptide
ILNTTYLWWV

SEQ ID NO: 13813 - protein, 10 aa, Artificial Sequence
  Synthetic Peptide
IVNTTYLWWV

SEQ ID NO: 13814 - protein, 10 aa, Artificial Sequence
  Synthetic Peptide
YLWWVNNQSV

SEQ ID NO: 13815 - protein, 9 aa, Artificial Sequence
  Synthetic Peptide
WLNNQSLPV

SEQ ID NO: 13816 - protein, 9 aa, Artificial Sequence
  Synthetic Peptide
LQLSNDNRV

SEQ ID NO: 13817 - protein, 10 aa, Artificial Sequence
  Synthetic Peptide
LLLSNDNRTL

SEQ ID NO: 13818 - protein, 11 aa, Artificial Sequence
  Synthetic Peptide
LQLSNDNRTLV

SEQ ID NO: 13819 - protein, 9 aa, Artificial Sequence
  Synthetic Peptide
RTLTLLSVV

SEQ ID NO: 13820 - protein, 9 aa, Artificial Sequence
  Synthetic Peptide
RLLTLLSVT

SEQ ID NO: 13821 - protein, 11 aa, Artificial Sequence
  Synthetic Peptide
NLLYGPDDPTI

SEQ ID NO: 13822 - protein, 10 aa, Artificial Sequence
  Synthetic Peptide
YTYYRPGVNV

SEQ ID NO: 13823 - protein, 10 aa, Artificial Sequence
  Synthetic Peptide
YLYYRPGVNL

SEQ ID NO: 13824 - protein, 11 aa, Artificial Sequence
  Synthetic Peptide
GVNLSLSCHAV

SEQ ID NO: 13825 - protein, 11 aa, Artificial Sequence
  Synthetic Peptide
GLNLSLSCHAA

SEQ ID NO: 13826 - protein, 11 aa, Artificial Sequence
  Synthetic Peptide
AQYSWLIDGNV

SEQ ID NO: 13827 - protein, 11 aa, Artificial Sequence
  Synthetic Peptide
ALYSWLIDGNI

SEQ ID NO: 13828 - protein, 10 aa, Artificial Sequence
  Synthetic Peptide
ILQHTQELFI

SEQ ID NO: 13829 - protein, 9 aa, Artificial Sequence
  Synthetic Peptide
QQHTQELFV

SEQ ID NO: 13830 - protein, 9 aa, Artificial Sequence
  Synthetic Peptide
QLHTQELFI

SEQ ID NO: 13831 - protein, 11 aa, Artificial Sequence
  Synthetic Peptide
HTQELFISNIV

SEQ ID NO: 13832 - protein, 9 aa, Artificial Sequence
  Synthetic Peptide
TLELFISNI

SEQ ID NO: 13833 - protein, 11 aa, Artificial Sequence
  Synthetic Peptide
RTTVKTITVSV

SEQ ID NO: 13834 - protein, 11 aa, Artificial Sequence
  Synthetic Peptide
RLTVKTITVSA

SEQ ID NO: 13835 - protein, 9 aa, Artificial Sequence
  Synthetic Peptide
KTITVSAEV

SEQ ID NO: 13836 - protein, 9 aa, Artificial Sequence
  Synthetic Peptide
KLITVSAEL

SEQ ID NO: 13837 - protein, 9 aa, Artificial Sequence
  Synthetic Peptide
VLFTCEPEA

SEQ ID NO: 13838 - protein, 11 aa, Artificial Sequence
  Synthetic Peptide
FTCEPEAQNTV

SEQ ID NO: 13839 - protein, 11 aa, Artificial Sequence
  Synthetic Peptide
FLCEPEAQNTT

SEQ ID NO: 13840 - protein, 11 aa, Artificial Sequence
  Synthetic Peptide
ELQNTTYLWWV

SEQ ID NO: 13841 - protein, 11 aa, Artificial Sequence
  Synthetic Peptide
EVQNTTYLWWV

SEQ ID NO: 13842 - protein, 10 aa, Artificial Sequence
  Synthetic Peptide
ALNTTYLWWV

SEQ ID NO: 13843 - protein, 9 aa, Artificial Sequence
  Synthetic Peptide
WLNGQSLPV

SEQ ID NO: 13844 - protein, 10 aa, Artificial Sequence
  Synthetic Peptide
GLSLPVSPRL

SEQ ID NO: 13845 - protein, 10 aa, Artificial Sequence
  Synthetic Peptide
SLPVSPRLQV

SEQ ID NO: 13846 - protein, 10 aa, Artificial Sequence
  Synthetic Peptide
RLQLSNGNRV

SEQ ID NO: 13847 - protein, 11 aa, Artificial Sequence
  Synthetic Peptide
RLQLSNGNRTV

SEQ ID NO: 13848 - protein, 10 aa, Artificial Sequence
  Synthetic Peptide
LLLSNGNRTL

SEQ ID NO: 13849 - protein, 9 aa, Artificial Sequence
  Synthetic Peptide
QLSNGNRTV

SEQ ID NO: 13850 - protein, 10 aa, Artificial Sequence
  Synthetic Peptide
QLSNGNRTLV

SEQ ID NO: 13851 - protein, 11 aa, Artificial Sequence
  Synthetic Peptide
QLSNGNRTLTV

SEQ ID NO: 13852 - protein, 11 aa, Artificial Sequence
  Synthetic Peptide
RLYVCGIQNSV

SEQ ID NO: 13853 - protein, 11 aa, Artificial Sequence
  Synthetic Peptide
RVYVCGIQNSV

SEQ ID NO: 13854 - protein, 9 aa, Artificial Sequence
  Synthetic Peptide
YTCGIQNSV

SEQ ID NO: 13855 - protein, 11 aa, Artificial Sequence
  Synthetic Peptide
YVCGIQNSVSV

SEQ ID NO: 13856 - protein, 11 aa, Artificial Sequence
  Synthetic Peptide
YLCGIQNSVSA

SEQ ID NO: 13857 - protein, 9 aa, Artificial Sequence
  Synthetic Peptide
SLNRSDPVT

SEQ ID NO: 13858 - protein, 10 aa, Artificial Sequence
  Synthetic Peptide
SLNRSDPVTL

SEQ ID NO: 13859 - protein, 9 aa, Artificial Sequence
  Synthetic Peptide
YVSGANLNL

SEQ ID NO: 13860 - protein, 10 aa, Artificial Sequence
  Synthetic Peptide
PQYSWRINGV

SEQ ID NO: 13861 - protein, 10 aa, Artificial Sequence
  Synthetic Peptide
PLYSWRINGI

SEQ ID NO: 13862 - protein, 9 aa, Artificial Sequence
  Synthetic Peptide
QQHTQVLFV

SEQ ID NO: 13863 - protein, 9 aa, Artificial Sequence
  Synthetic Peptide
QLHTQVLFI

SEQ ID NO: 13864 - protein, 10 aa, Artificial Sequence
  Synthetic Peptide
QLHTQVLFIA

SEQ ID NO: 13865 - protein, 10 aa, Artificial Sequence
  Synthetic Peptide
HTQVLFIAKV

SEQ ID NO: 13866 - protein, 10 aa, Artificial Sequence
  Synthetic Peptide
HLQVLFIAKI

SEQ ID NO: 13867 - protein, 9 aa, Artificial Sequence
  Synthetic Peptide
TQVLFIAKV

SEQ ID NO: 13868 - protein, 9 aa, Artificial Sequence
  Synthetic Peptide
TLVLFIAKI

SEQ ID NO: 13869 - protein, 10 aa, Artificial Sequence
  Synthetic Peptide
YACFVSNLAV

SEQ ID NO: 13870 - protein, 10 aa, Artificial Sequence
  Synthetic Peptide
GLSAGATVGV

SEQ ID NO: 13871 - protein, 11 aa, Artificial Sequence
  Synthetic Peptide
GATVGIMIGVV

SEQ ID NO: 13872 - protein, 11 aa, Artificial Sequence
  Synthetic Peptide
GLTVGIMIGVL

SEQ ID NO: 13873 - protein, 9 aa, Artificial Sequence
  Synthetic Peptide
TLGIMIGVL

SEQ ID NO: 13874 - protein, 10 aa, Artificial Sequence
  Synthetic Peptide
TLGIMIGVLV

SEQ ID NO: 13875 - protein, 11 aa, Artificial Sequence
  Synthetic Peptide
GIMIGVLVGVV

SEQ ID NO: 13876 - protein, 11 aa, Artificial Sequence
  Synthetic Peptide
GLMIGVLVGVA

SEQ ID NO: 13877 - protein, 9 aa, Artificial Sequence
  Synthetic Peptide
ITIGVLVGV

SEQ ID NO: 13878 - protein, 11 aa, Artificial Sequence
  Synthetic Peptide
IMIGVLVGVAV

SEQ ID NO: 13879 - protein, 11 aa, Artificial Sequence
  Synthetic Peptide
ILIGVLVGVAL

SEQ ID NO: 13880 - protein, 11 aa, Artificial Sequence
  Synthetic Peptide
MLGVLVGVALI

SEQ ID NO: 13881 - protein, 9 aa, Artificial Sequence
  Synthetic Peptide
GVLVGVALV

SEQ ID NO: 13882 - protein, 9 aa, Artificial Sequence
  Synthetic Peptide
GLLVGVALI

SEQ ID NO: 13883 - protein, 9 aa, Artificial Sequence
  Synthetic Peptide
ALBRWGLLV

SEQ ID NO: 13884 - protein, 9 aa, Artificial Sequence
  Synthetic Peptide
AMCRWGLLV

SEQ ID NO: 13885 - protein, 9 aa, Artificial Sequence
  Synthetic Peptide
KLFGSLAFV

SEQ ID NO: 13886 - protein, 9 aa, Artificial Sequence
  Synthetic Peptide
VLVHPQWVV

SEQ ID NO: 13887 - protein, 11 aa, Artificial Sequence
  Synthetic Peptide
VLVHPQWVLTV

SEQ ID NO: 13888 - protein, 11 aa, Artificial Sequence
  Synthetic Peptide
DLMLLRLSEPV

SEQ ID NO: 13889 - protein, 11 aa, Artificial Sequence
  Synthetic Peptide
PLVCNGVLQGV

SEQ ID NO: 13890 - protein, 9 aa, Artificial Sequence
  Synthetic Peptide
GLYDGMEHL

SEQ ID NO: 13891 - protein, 9 aa, Artificial Sequence
  Synthetic Peptide
GLYDGMEHV

SEQ ID NO: 13892 - protein, 9 aa, Artificial Sequence
  Synthetic Peptide
KVAELVHYL

SEQ ID NO: 13893 - protein, 9 aa, Artificial Sequence
  Synthetic Peptide
KVAEIVHYL

SEQ ID NO: 13894 - protein, 10 aa, Artificial Sequence
  Synthetic Peptide
LVFGIELMEV

SEQ ID NO: 13895 - protein, 10 aa, Artificial Sequence
  Synthetic Peptide
GVYDGREHTV

SEQ ID NO: 13896 - protein, 10 aa, Artificial Sequence
  Synthetic Peptide
GLYDGREHTV

SEQ ID NO: 13897 - protein, 10 aa, Artificial Sequence
  Synthetic Peptide
RMPEAAPPVV

SEQ ID NO: 13898 - protein, 10 aa, Artificial Sequence
  Synthetic Peptide
RLPEAAPPVV

SEQ ID NO: 13899 - protein, 8 aa, Artificial Sequence
  Synthetic Peptide
ALPPVAPV

SEQ ID NO: 13900 - protein, 9 aa, Artificial Sequence
  Synthetic Peptide
ALNKMFCQV

SEQ ID NO: 13901 - protein, 10 aa, Artificial Sequence
  Synthetic Peptide
ALNKMFCQLV

SEQ ID NO: 13902 - protein, 9 aa, Artificial Sequence
  Synthetic Peptide
KMFBQLAKV

SEQ ID NO: 13903 - protein, 9 aa, Artificial Sequence
  Synthetic Peptide
KMFCQLAKV

SEQ ID NO: 13904 - protein, 10 aa, Artificial Sequence
  Synthetic Peptide
VLVPYEPPEV

SEQ ID NO: 13905 - protein, 9 aa, Artificial Sequence
  Synthetic Peptide
CLTIHYNYV

SEQ ID NO: 13906 - protein, 9 aa, Artificial Sequence
  Synthetic Peptide
KLFCQLAKV

SEQ ID NO: 13907 - protein, 9 aa, Artificial Sequence
  Synthetic Peptide
KLCPVQLWV

SEQ ID NO: 13908 - protein, 9 aa, Artificial Sequence
  Synthetic Peptide
VTAKELKFV

SEQ ID NO: 13909 - protein, 9 aa, Artificial Sequence
  Synthetic Peptide
TLMSAMTNV

SEQ ID NO: 13910 - protein, 10 aa, Artificial Sequence
  Synthetic Peptide
IVYSAHDTTV

SEQ ID NO: 13911 - protein, 10 aa, Artificial Sequence
  Synthetic Peptide
ITYSAHDTTV

SEQ ID NO: 13912 - protein, 10 aa, Artificial Sequence
  Synthetic Peptide
ILYSAHDTTV

SEQ ID NO: 13913 - protein, 9 aa, Artificial Sequence
  Synthetic Peptide
SLSLGFLFV

SEQ ID NO: 13914 - protein, 10 aa, Artificial Sequence
  Synthetic Peptide
SLSLGFLFLV

SEQ ID NO: 13915 - protein, 10 aa, Artificial Sequence
  Synthetic Peptide
LLALFPPEGV

SEQ ID NO: 13916 - protein, 10 aa, Artificial Sequence
  Synthetic Peptide
LVALFPPEGV

SEQ ID NO: 13917 - protein, 10 aa, Artificial Sequence
  Synthetic Peptide
ALFPPEGVSV

SEQ ID NO: 13918 - protein, 10 aa, Artificial Sequence
  Synthetic Peptide
GLHGQDLFGV

SEQ ID NO: 13919 - protein, 10 aa, Artificial Sequence
  Synthetic Peptide
LLPPYASCHV

SEQ ID NO: 13920 - protein, 10 aa, Artificial Sequence
  Synthetic Peptide
LLWQPIPVHV

SEQ ID NO: 13921 - protein, 9 aa, Artificial Sequence
  Synthetic Peptide
MLLRLSEPV

SEQ ID NO: 13922 - protein, 8 aa, Artificial Sequence
  Synthetic Peptide
ALGTTCYV

SEQ ID NO: 13923 - protein, 11 aa, Artificial Sequence
  Synthetic Peptide
VTVYYGVPVWR

SEQ ID NO: 13924 - protein, 11 aa, Artificial Sequence
  Synthetic Peptide
VTVYYGVPIWK

SEQ ID NO: 13925 - protein, 11 aa, Artificial Sequence
  Synthetic Peptide
VTIYYGVPVWK

SEQ ID NO: 13926 - protein, 11 aa, Artificial Sequence
  Synthetic Peptide
VTIYYGVPVWR

SEQ ID NO: 13927 - protein, 11 aa, Artificial Sequence
  Synthetic Peptide
VTVYYGIPVWR

SEQ ID NO: 13928 - protein, 11 aa, Artificial Sequence
  Synthetic Peptide
ITVYYGVPVWR

SEQ ID NO: 13929 - protein, 11 aa, Artificial Sequence
  Synthetic Peptide
VTVYYGVPVRR

SEQ ID NO: 13930 - protein, 11 aa, Artificial Sequence
  Synthetic Peptide
VTVYDGVPVWR

SEQ ID NO: 13931 - protein, 11 aa, Artificial Sequence
  Synthetic Peptide
VTVYDGVPVWK

SEQ ID NO: 13932 - protein, 9 aa, Artificial Sequence
  Synthetic Peptide
RLRPGGKKK

SEQ ID NO: 13933 - protein, 9 aa, Artificial Sequence
  Synthetic Peptide
HIGPGRAFY

SEQ ID NO: 13934 - protein, 9 aa, Artificial Sequence
  Synthetic Peptide
KIQNFRVYY

SEQ ID NO: 13935 - protein, 10 aa, Artificial Sequence
  Synthetic Peptide
SSIVGWPAVR

SEQ ID NO: 13936 - protein, 9 aa, Artificial Sequence
  Synthetic Peptide
SIVGWPAVR

SEQ ID NO: 13937 - protein, 10 aa, Artificial Sequence
  Synthetic Peptide
IVGWPAVRER

SEQ ID NO: 13938 - protein, 10 aa, Artificial Sequence
  Synthetic Peptide
AAEGVGAASR

SEQ ID NO: 13939 - protein, 10 aa, Artificial Sequence
  Synthetic Peptide
AAEGVGAVSR

SEQ ID NO: 13940 - protein, 9 aa, Artificial Sequence
  Synthetic Peptide
PVRPQVPLR

SEQ ID NO: 13941 - protein, 10 aa, Artificial Sequence
  Synthetic Peptide
AAFDLSFFLK

SEQ ID NO: 13942 - protein, 10 aa, Artificial Sequence
  Synthetic Peptide
AAFDLSHFLK

SEQ ID NO: 13943 - protein, 9 aa, Artificial Sequence
  Synthetic Peptide
AFDLSHFLK

SEQ ID NO: 13944 - protein, 9 aa, Artificial Sequence
  Synthetic Peptide
AVDLSFFLK

SEQ ID NO: 13945 - protein, 10 aa, Artificial Sequence
  Synthetic Peptide
EVLMWKFDSR

SEQ ID NO: 13946 - protein, 9 aa, Artificial Sequence
  Synthetic Peptide
VLMWKFDSR

SEQ ID NO: 13947 - protein, 10 aa, Artificial Sequence
  Synthetic Peptide
SSLARRHMAR

SEQ ID NO: 13948 - protein, 9 aa, Artificial Sequence
  Synthetic Peptide
SLARRHIAR

SEQ ID NO: 13949 - protein, 11 aa, Artificial Sequence
  Synthetic Peptide
RVPLTFGWCFK

SEQ ID NO: 13950 - protein, 11 aa, Artificial Sequence
  Synthetic Peptide
RSLYNTVATLY

SEQ ID NO: 13951 - protein, 10 aa, Artificial Sequence
  Synthetic Peptide
VTIKIGGQLR

SEQ ID NO: 13952 - protein, 10 aa, Artificial Sequence
  Synthetic Peptide
VTIKIGGQIK

SEQ ID NO: 13953 - protein, 10 aa, Artificial Sequence
  Synthetic Peptide
VTVKIGGELK

SEQ ID NO: 13954 - protein, 10 aa, Artificial Sequence
  Synthetic Peptide
VTIRVAGQVK

SEQ ID NO: 13955 - protein, 10 aa, Artificial Sequence
  Synthetic Peptide
VTIKIGGQIR

SEQ ID NO: 13956 - protein, 10 aa, Artificial Sequence
  Synthetic Peptide
VTVKVGGQLR

SEQ ID NO: 13957 - protein, 10 aa, Artificial Sequence
  Synthetic Peptide
VTIRVGGQLR

SEQ ID NO: 13958 - protein, 10 aa, Artificial Sequence
  Synthetic Peptide
KLVDFRELNK

SEQ ID NO: 13959 - protein, 9 aa, Artificial Sequence
  Synthetic Peptide
GIPHPAGLK

SEQ ID NO: 13960 - protein, 9 aa, Artificial Sequence
  Synthetic Peptide
QIYPGIKVR

SEQ ID NO: 13961 - protein, 9 aa, Artificial Sequence
  Synthetic Peptide
AIFQSSMIK

SEQ ID NO: 13962 - protein, 9 aa, Artificial Sequence
  Synthetic Peptide
QIYPGIKVK

SEQ ID NO: 13963 - protein, 10 aa, Artificial Sequence
  Synthetic Peptide
ALLQAVRIIK

SEQ ID NO: 13964 - protein, 9 aa, Artificial Sequence
  Synthetic Peptide
LLQAVRIIK

SEQ ID NO: 13965 - protein, 9 aa, Artificial Sequence
  Synthetic Peptide
LLRAVRIIK

SEQ ID NO: 13966 - protein, 10 aa, Artificial Sequence
  Synthetic Peptide
KTVRLIKFLY

SEQ ID NO: 13967 - protein, 10 aa, Artificial Sequence
  Synthetic Peptide
ILYQSNPYPK

SEQ ID NO: 13968 - protein, 9 aa, Artificial Sequence
  Synthetic Peptide
QSNPYPEPK

SEQ ID NO: 13969 - protein, 9 aa, Artificial Sequence
  Synthetic Peptide
GTRQARKNR

SEQ ID NO: 13970 - protein, 10 aa, Artificial Sequence
  Synthetic Peptide
GTRQARKNRR

SEQ ID NO: 13971 - protein, 10 aa, Artificial Sequence
  Synthetic Peptide
KVRRRRWRAR

SEQ ID NO: 13972 - protein, 9 aa, Artificial Sequence
  Synthetic Peptide
RILSTYLGR

SEQ ID NO: 13973 - protein, 9 aa, Artificial Sequence
  Synthetic Peptide
RILSTCLGR

SEQ ID NO: 13974 - protein, 10 aa, Artificial Sequence
  Synthetic Peptide
ERISLTYLGR

SEQ ID NO: 13975 - protein, 9 aa, Artificial Sequence
  Synthetic Peptide
KLNWASQIY

SEQ ID NO: 13976 - protein, 9 aa, Artificial Sequence
  Synthetic Peptide
KQNPDIVIY

SEQ ID NO: 13977 - protein, 10 aa, Artificial Sequence
  Synthetic Peptide
GSQPKTACNK

SEQ ID NO: 13978 - protein, 10 aa, Artificial Sequence
  Synthetic Peptide
KTACNNCYCK

SEQ ID NO: 13979 - protein, 10 aa, Artificial Sequence
  Synthetic Peptide
KTACNKCYCK

SEQ ID NO: 13980 - protein, 9 aa, Artificial Sequence
  Synthetic Peptide
TACNKCYCK

SEQ ID NO: 13981 - protein, 10 aa, Artificial Sequence
  Synthetic Peptide
TACNNCYCKK

SEQ ID NO: 13982 - protein, 9 aa, Artificial Sequence
  Synthetic Peptide
KTLGISYGR

SEQ ID NO: 13983 - protein, 10 aa, Artificial Sequence
  Synthetic Peptide
KTLGISYGRK

SEQ ID NO: 13984 - protein, 11 aa, Artificial Sequence
  Synthetic Peptide
KTLGISYGRKK

SEQ ID NO: 13985 - protein, 9 aa, Artificial Sequence
  Synthetic Peptide
GTGISYGRK

SEQ ID NO: 13986 - protein, 9 aa, Artificial Sequence
  Synthetic Peptide
LTISYGRKK

SEQ ID NO: 13987 - protein, 9 aa, Artificial Sequence
  Synthetic Peptide
ISYGRKKRR

SEQ ID NO: 13988 - protein, 10 aa, Artificial Sequence
  Synthetic Peptide
ISKQPLPQTR

SEQ ID NO: 13989 - protein, 9 aa, Artificial Sequence
  Synthetic Peptide
ESKKKVESK

SEQ ID NO: 13990 - protein, 9 aa, Artificial Sequence
  Synthetic Peptide
ESKKEVESK

SEQ ID NO: 13991 - protein, 10 aa, Artificial Sequence
  Synthetic Peptide
KVGPGGYPRR

SEQ ID NO: 13992 - protein, 10 aa, Artificial Sequence
  Synthetic Peptide
KAGPGGYPRK

SEQ ID NO: 13993 - protein, 11 aa, Artificial Sequence
  Synthetic Peptide
KVGPGGYPRRK

SEQ ID NO: 13994 - protein, 10 aa, Artificial Sequence
  Synthetic Peptide
QVMIVWQVDR

SEQ ID NO: 13995 - protein, 10 aa, Artificial Sequence
  Synthetic Peptide
MIVWQVDRMR

SEQ ID NO: 13996 - protein, 9 aa, Artificial Sequence
  Synthetic Peptide
IVWQVDRMR

SEQ ID NO: 13997 - protein, 10 aa, Artificial Sequence
  Synthetic Peptide
RIRTWNSLVK

SEQ ID NO: 13998 - protein, 10 aa, Artificial Sequence
  Synthetic Peptide
RINTWKSLVK

SEQ ID NO: 13999 - protein, 10 aa, Artificial Sequence
  Synthetic Peptide
LVKHHMYVSK

SEQ ID NO: 14000 - protein, 10 aa, Artificial Sequence
  Synthetic Peptide
EVHIPLGDAR

SEQ ID NO: 14001 - protein, 10 aa, Artificial Sequence
  Synthetic Peptide
GQGVSIEWRK

SEQ ID NO: 14002 - protein, 9 aa, Artificial Sequence
  Synthetic Peptide
GVSIEWRQR

SEQ ID NO: 14003 - protein, 10 aa, Artificial Sequence
  Synthetic Peptide
GVSIEWRLRR

SEQ ID NO: 14004 - protein, 10 aa, Artificial Sequence
  Synthetic Peptide
GVSIEWRKRR

SEQ ID NO: 14005 - protein, 10 aa, Artificial Sequence
  Synthetic Peptide
GVSIEWRQRR

SEQ ID NO: 14006 - protein, 9 aa, Artificial Sequence
  Synthetic Peptide
VSIEWRLRR

SEQ ID NO: 14007 - protein, 9 aa, Artificial Sequence
  Synthetic Peptide
VSIEWRQRR

SEQ ID NO: 14008 - protein, 9 aa, Artificial Sequence
  Synthetic Peptide
VSIEWRKRR

SEQ ID NO: 14009 - protein, 10 aa, Artificial Sequence
  Synthetic Peptide
AIRKAILGHR

SEQ ID NO: 14010 - protein, 9 aa, Artificial Sequence
  Synthetic Peptide
KAILGQVVR

SEQ ID NO: 14011 - protein, 10 aa, Artificial Sequence
  Synthetic Peptide
AILGHIVIPR

SEQ ID NO: 14012 - protein, 10 aa, Artificial Sequence
  Synthetic Peptide
AILGHIVSPR

SEQ ID NO: 14013 - protein, 10 aa, Artificial Sequence
  Synthetic Peptide
AILGHIVRPR

SEQ ID NO: 14014 - protein, 9 aa, Artificial Sequence
  Synthetic Peptide
ILGHIVIPR

SEQ ID NO: 14015 - protein, 9 aa, Artificial Sequence
  Synthetic Peptide
ILGHIVSPR

SEQ ID NO: 14016 - protein, 9 aa, Artificial Sequence
  Synthetic Peptide
ILGHIVRPR

SEQ ID NO: 14017 - protein, 9 aa, Artificial Sequence
  Synthetic Peptide
GSLQYLALK

SEQ ID NO: 14018 - protein, 9 aa, Artificial Sequence
  Synthetic Peptide
KVGSLQYLK

SEQ ID NO: 14019 - protein, 9 aa, Artificial Sequence
  Synthetic Peptide
YLALTALIK

SEQ ID NO: 14020 - protein, 10 aa, Artificial Sequence
  Synthetic Peptide
LALTALIKPK

SEQ ID NO: 14021 - protein, 10 aa, Artificial Sequence
  Synthetic Peptide
LALTALITPK

SEQ ID NO: 14022 - protein, 9 aa, Artificial Sequence
  Synthetic Peptide
ALTALIKPK

SEQ ID NO: 14023 - protein, 9 aa, Artificial Sequence
  Synthetic Peptide
ALTALITPK

SEQ ID NO: 14024 - protein, 10 aa, Artificial Sequence
  Synthetic Peptide
ALTALIKPKK

SEQ ID NO: 14025 - protein, 10 aa, Artificial Sequence
  Synthetic Peptide
ALTALITPKK

SEQ ID NO: 14026 - protein, 9 aa, Artificial Sequence
  Synthetic Peptide
LTALIKPKK

SEQ ID NO: 14027 - protein, 9 aa, Artificial Sequence
  Synthetic Peptide
LTALITPKK

SEQ ID NO: 14028 - protein, 10 aa, Artificial Sequence
  Synthetic Peptide
LTALIKPKKR

SEQ ID NO: 14029 - protein, 9 aa, Artificial Sequence
  Synthetic Peptide
TALIKPKKR

SEQ ID NO: 14030 - protein, 10 aa, Artificial Sequence
  Synthetic Peptide
KIKPPLPSVR

SEQ ID NO: 14031 - protein, 9 aa, Artificial Sequence
  Synthetic Peptide
SVRKLVEDR

SEQ ID NO: 14032 - protein, 9 aa, Artificial Sequence
  Synthetic Peptide
SVRKLTEDR

SEQ ID NO: 14033 - protein, 9 aa, Artificial Sequence
  Synthetic Peptide
KLVEDRWNK

SEQ ID NO: 14034 - protein, 9 aa, Artificial Sequence
  Synthetic Peptide
KLTEDRWNK

SEQ ID NO: 14035 - protein, 10 aa, Artificial Sequence
  Synthetic Peptide
RIRTWKSLVK

SEQ ID NO: 14036 - protein, 9 aa, Artificial Sequence
  Synthetic Peptide
HMYISKKAK

SEQ ID NO: 14037 - protein, 11 aa, Artificial Sequence
  Synthetic Peptide
KTKPPLPSVKK

SEQ ID NO: 14038 - protein, 10 aa, Artificial Sequence
  Synthetic Peptide
WTLELLEELK

SEQ ID NO: 14039 - protein, 10 aa, Artificial Sequence
  Synthetic Peptide
KQEAVRHFPR

SEQ ID NO: 14040 - protein, 10 aa, Artificial Sequence
  Synthetic Peptide
LQQLLFIHFR

SEQ ID NO: 14041 - protein, 9 aa, Artificial Sequence
  Synthetic Peptide
QQLLFIHFR

SEQ ID NO: 14042 - protein, 9 aa, Artificial Sequence
  Synthetic Peptide
FIHFRIGCR

SEQ ID NO: 14043 - protein, 10 aa, Artificial Sequence
  Synthetic Peptide
HSRIGILRQR

SEQ ID NO: 14044 - protein, 9 aa, Artificial Sequence
  Synthetic Peptide
RIGILRQRR

SEQ ID NO: 14045 - protein, 9 aa, Artificial Sequence
  Synthetic Peptide
GILRQRRAR

SEQ ID NO: 14046 - protein, 9 aa, Artificial Sequence
  Synthetic Peptide
AIVVWTIAY

SEQ ID NO: 14047 - protein, 9 aa, Artificial Sequence
  Synthetic Peptide
WTIAYIEYR

SEQ ID NO: 14048 - protein, 9 aa, Artificial Sequence
  Synthetic Peptide
WTIVYIEYR

SEQ ID NO: 14049 - protein, 10 aa, Artificial Sequence
  Synthetic Peptide
WTIVYIEYRK

SEQ ID NO: 14050 - protein, 10 aa, Artificial Sequence
  Synthetic Peptide
WTIAYIEYRK

SEQ ID NO: 14051 - protein, 9 aa, Artificial Sequence
  Synthetic Peptide
TIVYIEYRK

SEQ ID NO: 14052 - protein, 9 aa, Artificial Sequence
  Synthetic Peptide
TIAYIEYRK

SEQ ID NO: 14053 - protein, 10 aa, Artificial Sequence
  Synthetic Peptide
IVFIEYRKIR

SEQ ID NO: 14054 - protein, 10 aa, Artificial Sequence
  Synthetic Peptide
KILRQRKIDR

SEQ ID NO: 14055 - protein, 9 aa, Artificial Sequence
  Synthetic Peptide
ILRQRKIDR

SEQ ID NO: 14056 - protein, 10 aa, Artificial Sequence
  Synthetic Peptide
RQRKIDWLIK

SEQ ID NO: 14057 - protein, 10 aa, Artificial Sequence
  Synthetic Peptide
KIDWLIKRIR

SEQ ID NO: 14058 - protein, 10 aa, Artificial Sequence
  Synthetic Peptide
KIDRLIDRIR

SEQ ID NO: 14059 - protein, 9 aa, Artificial Sequence
  Synthetic Peptide
WLIKRIRER

SEQ ID NO: 14060 - protein, 9 aa, Artificial Sequence
  Synthetic Peptide
RLIDRIRER

SEQ ID NO: 14061 - protein, 9 aa, Artificial Sequence
  Synthetic Peptide
RLIERIRER

SEQ ID NO: 14062 - protein, 10 aa, Artificial Sequence
  Synthetic Peptide
STMVDMGHLR

SEQ ID NO: 14063 - protein, 9 aa, Artificial Sequence
  Synthetic Peptide
TMVDMGHLR

SEQ ID NO: 14064 - protein, 11 aa, Artificial Sequence
  Synthetic Peptide
KGLGISYGRKK

SEQ ID NO: 14065 - protein, 9 aa, Artificial Sequence
  Synthetic Peptide
GLGISYGRK

SEQ ID NO: 14066 - protein, 9 aa, Artificial Sequence
  Synthetic Peptide
KGLGISYGR

SEQ ID NO: 14067 - protein, 11 aa, Artificial Sequence
  Synthetic Peptide
RTRGAHTNDVK

SEQ ID NO: 14068 - protein, 11 aa, Artificial Sequence
  Synthetic Peptide
RTRGAHTNDVR

SEQ ID NO: 14069 - protein, 10 aa, Artificial Sequence
  Synthetic Peptide
AVFVHNFKRK

SEQ ID NO: 14070 - protein, 10 aa, Artificial Sequence
  Synthetic Peptide
RISTWKSLVK

SEQ ID NO: 14071 - protein, 11 aa, Artificial Sequence
  Synthetic Peptide
RTKPPLPSVTK

SEQ ID NO: 14072 - protein, 9 aa, Artificial Sequence
  Synthetic Peptide
GTGCNGWFY

SEQ ID NO: 14073 - protein, 10 aa, Artificial Sequence
  Synthetic Peptide
WFYVQAIVDK

SEQ ID NO: 14074 - protein, 10 aa, Artificial Sequence
  Synthetic Peptide
WFFVETIVEK

SEQ ID NO: 14075 - protein, 9 aa, Artificial Sequence
  Synthetic Peptide
ALFTAQEAK

SEQ ID NO: 14076 - protein, 10 aa, Artificial Sequence
  Synthetic Peptide
AQVLHVLKRK

SEQ ID NO: 14077 - protein, 9 aa, Artificial Sequence
  Synthetic Peptide
AQVLHVLKR

SEQ ID NO: 14078 - protein, 9 aa, Artificial Sequence
  Synthetic Peptide
AQVLHLLKR

SEQ ID NO: 14079 - protein, 10 aa, Artificial Sequence
  Synthetic Peptide
AQVLHLLKRK

SEQ ID NO: 14080 - protein, 9 aa, Artificial Sequence
  Synthetic Peptide
QVLHLLKRK

SEQ ID NO: 14081 - protein, 9 aa, Artificial Sequence
  Synthetic Peptide
NVCVSWKYK

SEQ ID NO: 14082 - protein, 9 aa, Artificial Sequence
  Synthetic Peptide
RLKAICIEK

SEQ ID NO: 14083 - protein, 9 aa, Artificial Sequence
  Synthetic Peptide
KQSRAAKRR

SEQ ID NO: 14084 - protein, 10 aa, Artificial Sequence
  Synthetic Peptide
TQQMLQVEGR

SEQ ID NO: 14085 - protein, 9 aa, Artificial Sequence
  Synthetic Peptide
TQQLQDLFK

SEQ ID NO: 14086 - protein, 9 aa, Artificial Sequence
  Synthetic Peptide
NLQGKLYYK

SEQ ID NO: 14087 - protein, 10 aa, Artificial Sequence
  Synthetic Peptide
LQGKLYYKFK

SEQ ID NO: 14088 - protein, 9 aa, Artificial Sequence
  Synthetic Peptide
LTNILNVLK

SEQ ID NO: 14089 - protein, 9 aa, Artificial Sequence
  Synthetic Peptide
NTKANILYK

SEQ ID NO: 14090 - protein, 9 aa, Artificial Sequence
  Synthetic Peptide
NTKATLLYK

SEQ ID NO: 14091 - protein, 9 aa, Artificial Sequence
  Synthetic Peptide
KTTVLFKFK

SEQ ID NO: 14092 - protein, 10 aa, Artificial Sequence
  Synthetic Peptide
KQGAMLAVFK

SEQ ID NO: 14093 - protein, 10 aa, Artificial Sequence
  Synthetic Peptide
SFMELVRPFK

SEQ ID NO: 14094 - protein, 10 aa, Artificial Sequence
  Synthetic Peptide
SFSELVRPFK

SEQ ID NO: 14095 - protein, 10 aa, Artificial Sequence
  Synthetic Peptide
SFTDLVRNFK

SEQ ID NO: 14096 - protein, 10 aa, Artificial Sequence
  Synthetic Peptide
KTLLQPYCLY

SEQ ID NO: 14097 - protein, 10 aa, Artificial Sequence
  Synthetic Peptide
KTLLQQYCLY

SEQ ID NO: 14098 - protein, 10 aa, Artificial Sequence
  Synthetic Peptide
MVMLMLVRFK

SEQ ID NO: 14099 - protein, 9 aa, Artificial Sequence
  Synthetic Peptide
MLVRFKCAK

SEQ ID NO: 14100 - protein, 9 aa, Artificial Sequence
  Synthetic Peptide
GVIVMMLIR

SEQ ID NO: 14101 - protein, 9 aa, Artificial Sequence
  Synthetic Peptide
MLIRYTCGK

SEQ ID NO: 14102 - protein, 9 aa, Artificial Sequence
  Synthetic Peptide
ILLLLIRFK

SEQ ID NO: 14103 - protein, 9 aa, Artificial Sequence
  Synthetic Peptide
ITIEKLLEK

SEQ ID NO: 14104 - protein, 10 aa, Artificial Sequence
  Synthetic Peptide
LLLIRFRCSK

SEQ ID NO: 14105 - protein, 10 aa, Artificial Sequence
  Synthetic Peptide
LLLIRFKCSK

SEQ ID NO: 14106 - protein, 9 aa, Artificial Sequence
  Synthetic Peptide
LLIRFRCSK

SEQ ID NO: 14107 - protein, 10 aa, Artificial Sequence
  Synthetic Peptide
LLLIRFKCGK

SEQ ID NO: 14108 - protein, 10 aa, Artificial Sequence
  Synthetic Peptide
MVVLLLVRYK

SEQ ID NO: 14109 - protein, 9 aa, Artificial Sequence
  Synthetic Peptide
VVLLLVRYK

SEQ ID NO: 14110 - protein, 9 aa, Artificial Sequence
  Synthetic Peptide
GVLILALLR

SEQ ID NO: 14111 - protein, 10 aa, Artificial Sequence
  Synthetic Peptide
VLILALLRYK

SEQ ID NO: 14112 - protein, 9 aa, Artificial Sequence
  Synthetic Peptide
ALLRYKCGK

SEQ ID NO: 14113 - protein, 9 aa, Artificial Sequence
  Synthetic Peptide
EQMLIQPPK

SEQ ID NO: 14114 - protein, 10 aa, Artificial Sequence
  Synthetic Peptide
STAAALYWYR

SEQ ID NO: 14115 - protein, 9 aa, Artificial Sequence
  Synthetic Peptide
MVIEPPKLR

SEQ ID NO: 14116 - protein, 9 aa, Artificial Sequence
  Synthetic Peptide
MLIEPPKLR

SEQ ID NO: 14117 - protein, 10 aa, Artificial Sequence
  Synthetic Peptide
SQTCALYWFR

SEQ ID NO: 14118 - protein, 10 aa, Artificial Sequence
  Synthetic Peptide
SQACALYWFR

SEQ ID NO: 14119 - protein, 9 aa, Artificial Sequence
  Synthetic Peptide
QTCALYWFR

SEQ ID NO: 14120 - protein, 9 aa, Artificial Sequence
  Synthetic Peptide
ATCALYWYR

SEQ ID NO: 14121 - protein, 9 aa, Artificial Sequence
  Synthetic Peptide
MLIQPPKLR

SEQ ID NO: 14122 - protein, 9 aa, Artificial Sequence
  Synthetic Peptide
STAAALYWY

SEQ ID NO: 14123 - protein, 10 aa, Artificial Sequence
  Synthetic Peptide
STAAALYWYK

SEQ ID NO: 14124 - protein, 9 aa, Artificial Sequence
  Synthetic Peptide
SSVAALYWY

SEQ ID NO: 14125 - protein, 9 aa, Artificial Sequence
  Synthetic Peptide
SVAALYWYR

SEQ ID NO: 14126 - protein, 9 aa, Artificial Sequence
  Synthetic Peptide
DSNACAFLK

SEQ ID NO: 14127 - protein, 9 aa, Artificial Sequence
  Synthetic Peptide
DSNAQAFLK

SEQ ID NO: 14128 - protein, 9 aa, Artificial Sequence
  Synthetic Peptide
NSNAAAFLR

SEQ ID NO: 14129 - protein, 9 aa, Artificial Sequence
  Synthetic Peptide
NSNASAFLK

SEQ ID NO: 14130 - protein, 9 aa, Artificial Sequence
  Synthetic Peptide
GTMCRHYKR

SEQ ID NO: 14131 - protein, 9 aa, Artificial Sequence
  Synthetic Peptide
NSNAAAFLK

SEQ ID NO: 14132 - protein, 10 aa, Artificial Sequence
  Synthetic Peptide
RQMSMGQWIK

SEQ ID NO: 14133 - protein, 9 aa, Artificial Sequence
  Synthetic Peptide
GVMCRHYKR

SEQ ID NO: 14134 - protein, 9 aa, Artificial Sequence
  Synthetic Peptide
AVMCRHYKR

SEQ ID NO: 14135 - protein, 10 aa, Artificial Sequence
  Synthetic Peptide
IVKDCATMCR

SEQ ID NO: 14136 - protein, 10 aa, Artificial Sequence
  Synthetic Peptide
QQMNMCQWIK

SEQ ID NO: 14137 - protein, 9 aa, Artificial Sequence
  Synthetic Peptide
ATMCRHYKR

SEQ ID NO: 14138 - protein, 10 aa, Artificial Sequence
  Synthetic Peptide
RQMNMSQWIK

SEQ ID NO: 14139 - protein, 9 aa, Artificial Sequence
  Synthetic Peptide
ATMCKHYRR

SEQ ID NO: 14140 - protein, 10 aa, Artificial Sequence
  Synthetic Peptide
GQWIQSRCEK

SEQ ID NO: 14141 - protein, 10 aa, Artificial Sequence
  Synthetic Peptide
SQWIKYRCSK

SEQ ID NO: 14142 - protein, 10 aa, Artificial Sequence
  Synthetic Peptide
KQMSMSQWIK

SEQ ID NO: 14143 - protein, 9 aa, Artificial Sequence
  Synthetic Peptide
KTDEGGDWK

SEQ ID NO: 14144 - protein, 10 aa, Artificial Sequence
  Synthetic Peptide
SQWIKYRCDR

SEQ ID NO: 14145 - protein, 10 aa, Artificial Sequence
  Synthetic Peptide
SQWIRFRCSK

SEQ ID NO: 14146 - protein, 10 aa, Artificial Sequence
  Synthetic Peptide
EFVSFLSALK

SEQ ID NO: 14147 - protein, 9 aa, Artificial Sequence
  Synthetic Peptide
FVSFLSALK

SEQ ID NO: 14148 - protein, 10 aa, Artificial Sequence
  Synthetic Peptide
FLSALKLFLK

SEQ ID NO: 14149 - protein, 9 aa, Artificial Sequence
  Synthetic Peptide
LSALKLFLK

SEQ ID NO: 14150 - protein, 10 aa, Artificial Sequence
  Synthetic Peptide
DFISFLSYFK

SEQ ID NO: 14151 - protein, 9 aa, Artificial Sequence
  Synthetic Peptide
KQIVMFLRY

SEQ ID NO: 14152 - protein, 10 aa, Artificial Sequence
  Synthetic Peptide
KLFLKGVPKK

SEQ ID NO: 14153 - protein, 9 aa, Artificial Sequence
  Synthetic Peptide
KLFLKGVPK

SEQ ID NO: 14154 - protein, 9 aa, Artificial Sequence
  Synthetic Peptide
GVEFISFLR

SEQ ID NO: 14155 - protein, 10 aa, Artificial Sequence
  Synthetic Peptide
EFTAFLGAFK

SEQ ID NO: 14156 - protein, 10 aa, Artificial Sequence
  Synthetic Peptide
EFTAFLVAFK

SEQ ID NO: 14157 - protein, 10 aa, Artificial Sequence
  Synthetic Peptide
FTAFLGAFKK

SEQ ID NO: 14158 - protein, 9 aa, Artificial Sequence
  Synthetic Peptide
FTAFLGAFK

SEQ ID NO: 14159 - protein, 9 aa, Artificial Sequence
  Synthetic Peptide
FTAFLVAFK

SEQ ID NO: 14160 - protein, 10 aa, Artificial Sequence
  Synthetic Peptide
EFTAFLDAFK

SEQ ID NO: 14161 - protein, 9 aa, Artificial Sequence
  Synthetic Peptide
KLFLQGTPK

SEQ ID NO: 14162 - protein, 10 aa, Artificial Sequence
  Synthetic Peptide
FLGAFKKFLK

SEQ ID NO: 14163 - protein, 10 aa, Artificial Sequence
  Synthetic Peptide
EFMSFLTALK

SEQ ID NO: 14164 - protein, 10 aa, Artificial Sequence
  Synthetic Peptide
KQFLQGVPKK

SEQ ID NO: 14165 - protein, 9 aa, Artificial Sequence
  Synthetic Peptide
KQFLQGVPK

SEQ ID NO: 14166 - protein, 9 aa, Artificial Sequence
  Synthetic Peptide
MSFLTALKR

SEQ ID NO: 14167 - protein, 10 aa, Artificial Sequence
  Synthetic Peptide
VLCGPPNTGK

SEQ ID NO: 14168 - protein, 10 aa, Artificial Sequence
  Synthetic Peptide
FLGALKSFLK

SEQ ID NO: 14169 - protein, 10 aa, Artificial Sequence
  Synthetic Peptide
LLCGPANTGK

SEQ ID NO: 14170 - protein, 10 aa, Artificial Sequence
  Synthetic Peptide
LLYGPANTGK

SEQ ID NO: 14171 - protein, 10 aa, Artificial Sequence
  Synthetic Peptide
KSFLKGTPKK

SEQ ID NO: 14172 - protein, 9 aa, Artificial Sequence
  Synthetic Peptide
KSFLKGTPK

SEQ ID NO: 14173 - protein, 10 aa, Artificial Sequence
  Synthetic Peptide
VLYGPANTGK

SEQ ID NO: 14174 - protein, 10 aa, Artificial Sequence
  Synthetic Peptide
KSCFAMSLIK

SEQ ID NO: 14175 - protein, 10 aa, Artificial Sequence
  Synthetic Peptide
LLYGAANTGK

SEQ ID NO: 14176 - protein, 10 aa, Artificial Sequence
  Synthetic Peptide
VFCGPANTGK

SEQ ID NO: 14177 - protein, 10 aa, Artificial Sequence
  Synthetic Peptide
KSLFGMSLMK

SEQ ID NO: 14178 - protein, 9 aa, Artificial Sequence
  Synthetic Peptide
SLFGMSLMK

SEQ ID NO: 14179 - protein, 9 aa, Artificial Sequence
  Synthetic Peptide
SVICFVNSK

SEQ ID NO: 14180 - protein, 9 aa, Artificial Sequence
  Synthetic Peptide
WTYFDTYMR

SEQ ID NO: 14181 - protein, 9 aa, Artificial Sequence
  Synthetic Peptide
NTNAGTDPR

SEQ ID NO: 14182 - protein, 10 aa, Artificial Sequence
  Synthetic Peptide
TFPNPFPFDK

SEQ ID NO: 14183 - protein, 9 aa, Artificial Sequence
  Synthetic Peptide
LTTNIHPAK

SEQ ID NO: 14184 - protein, 10 aa, Artificial Sequence
  Synthetic Peptide
TFPHAFPFDK

SEQ ID NO: 14185 - protein, 9 aa, Artificial Sequence
  Synthetic Peptide
SFFSRTWCR

SEQ ID NO: 14186 - protein, 9 aa, Artificial Sequence
  Synthetic Peptide
CFFTRTWSR

SEQ ID NO: 14187 - protein, 10 aa, Artificial Sequence
  Synthetic Peptide
KSFFSRTWCK

SEQ ID NO: 14188 - protein, 9 aa, Artificial Sequence
  Synthetic Peptide
SFFSRTWCK

SEQ ID NO: 14189 - protein, 9 aa, Artificial Sequence
  Synthetic Peptide
SFFSRTWSR

SEQ ID NO: 14190 - protein, 9 aa, Artificial Sequence
  Synthetic Peptide
CFFERTWSR

SEQ ID NO: 14191 - protein, 9 aa, Artificial Sequence
  Synthetic Peptide
GTFKCSAGK

SEQ ID NO: 14192 - protein, 10 aa, Artificial Sequence
  Synthetic Peptide
SQRLNVCQDK

SEQ ID NO: 14193 - protein, 10 aa, Artificial Sequence
  Synthetic Peptide
SQRLNACQNK

SEQ ID NO: 14194 - protein, 10 aa, Artificial Sequence
  Synthetic Peptide
DLPSQIEHWK

SEQ ID NO: 14195 - protein, 10 aa, Artificial Sequence
  Synthetic Peptide
DLTSQIEHWK

SEQ ID NO: 14196 - protein, 10 aa, Artificial Sequence
  Synthetic Peptide
RLCDHIDYWK

SEQ ID NO: 14197 - protein, 9 aa, Artificial Sequence
  Synthetic Peptide
LTSQIEHWK

SEQ ID NO: 14198 - protein, 10 aa, Artificial Sequence
  Synthetic Peptide
SQIEHWKLIR

SEQ ID NO: 14199 - protein, 10 aa, Artificial Sequence
  Synthetic Peptide
AQIEHWKLTR

SEQ ID NO: 14200 - protein, 10 aa, Artificial Sequence
  Synthetic Peptide
SQIQYWQLIR

SEQ ID NO: 14201 - protein, 10 aa, Artificial Sequence
  Synthetic Peptide
SQISYWQLIR

SEQ ID NO: 14202 - protein, 9 aa, Artificial Sequence
  Synthetic Peptide
RLECAIYYK

SEQ ID NO: 14203 - protein, 9 aa, Artificial Sequence
  Synthetic Peptide
RLECVLMYK

SEQ ID NO: 14204 - protein, 10 aa, Artificial Sequence
  Synthetic Peptide
QVVPALSVSK

SEQ ID NO: 14205 - protein, 9 aa, Artificial Sequence
  Synthetic Peptide
MVPCLQVCK

SEQ ID NO: 14206 - protein, 9 aa, Artificial Sequence
  Synthetic Peptide
VVPALSVSK

SEQ ID NO: 14207 - protein, 10 aa, Artificial Sequence
  Synthetic Peptide
QVVPAYNISK

SEQ ID NO: 14208 - protein, 9 aa, Artificial Sequence
  Synthetic Peptide
VVPAYNISK

SEQ ID NO: 14209 - protein, 10 aa, Artificial Sequence
  Synthetic Peptide
QVVPPINISK

SEQ ID NO: 14210 - protein, 10 aa, Artificial Sequence
  Synthetic Peptide
LQMALETLSK

SEQ ID NO: 14211 - protein, 10 aa, Artificial Sequence
  Synthetic Peptide
LQLALEALNK

SEQ ID NO: 14212 - protein, 9 aa, Artificial Sequence
  Synthetic Peptide
QLALEALNK

SEQ ID NO: 14213 - protein, 9 aa, Artificial Sequence
  Synthetic Peptide
ETLNASPYK

SEQ ID NO: 14214 - protein, 9 aa, Artificial Sequence
  Synthetic Peptide
ALQGLAQSR

SEQ ID NO: 14215 - protein, 10 aa, Artificial Sequence
  Synthetic Peptide
LQGLAQSRYK

SEQ ID NO: 14216 - protein, 9 aa, Artificial Sequence
  Synthetic Peptide
ALKGLAQSK

SEQ ID NO: 14217 - protein, 10 aa, Artificial Sequence
  Synthetic Peptide
LQQTSLEMWR

SEQ ID NO: 14218 - protein, 10 aa, Artificial Sequence
  Synthetic Peptide
WLSEPQKCFK

SEQ ID NO: 14219 - protein, 10 aa, Artificial Sequence
  Synthetic Peptide
YLTAPTGCLK

SEQ ID NO: 14220 - protein, 10 aa, Artificial Sequence
  Synthetic Peptide
VTVQYDNDKK

SEQ ID NO: 14221 - protein, 10 aa, Artificial Sequence
  Synthetic Peptide
TVQVYFDGNK

SEQ ID NO: 14222 - protein, 9 aa, Artificial Sequence
  Synthetic Peptide
VQVYFDGNK

SEQ ID NO: 14223 - protein, 10 aa, Artificial Sequence
  Synthetic Peptide
TVHVYFDGNK

SEQ ID NO: 14224 - protein, 9 aa, Artificial Sequence
  Synthetic Peptide
NTMDYTNWK

SEQ ID NO: 14225 - protein, 9 aa, Artificial Sequence
  Synthetic Peptide
NTMHYTNWK

SEQ ID NO: 14226 - protein, 10 aa, Artificial Sequence
  Synthetic Peptide
MQYVAWKYIY

SEQ ID NO: 14227 - protein, 10 aa, Artificial Sequence
  Synthetic Peptide
MTYVAWDSVY

SEQ ID NO: 14228 - protein, 9 aa, Artificial Sequence
  Synthetic Peptide
MTDAGTWDK

SEQ ID NO: 14229 - protein, 9 aa, Artificial Sequence
  Synthetic Peptide
KVCSGVDYR

SEQ ID NO: 14230 - protein, 10 aa, Artificial Sequence
  Synthetic Peptide
GQVNCKGIYY

SEQ ID NO: 14231 - protein, 10 aa, Artificial Sequence
  Synthetic Peptide
GQVDYYGLYY

SEQ ID NO: 14232 - protein, 9 aa, Artificial Sequence
  Synthetic Peptide
KVDYIGMYY

SEQ ID NO: 14233 - protein, 9 aa, Artificial Sequence
  Synthetic Peptide
QVNCKGIYY

SEQ ID NO: 14234 - protein, 10 aa, Artificial Sequence
  Synthetic Peptide
GLYYWCDGEK

SEQ ID NO: 14235 - protein, 9 aa, Artificial Sequence
  Synthetic Peptide
CVSHRGLYY

SEQ ID NO: 14236 - protein, 10 aa, Artificial Sequence
  Synthetic Peptide
GLYYIHGNEK

SEQ ID NO: 14237 - protein, 9 aa, Artificial Sequence
  Synthetic Peptide
YVHEGHITY

SEQ ID NO: 14238 - protein, 10 aa, Artificial Sequence
  Synthetic Peptide
VSYWGVYYIK

SEQ ID NO: 14239 - protein, 9 aa, Artificial Sequence
  Synthetic Peptide
VQFKSECEK

SEQ ID NO: 14240 - protein, 9 aa, Artificial Sequence
  Synthetic Peptide
STTETADPK

SEQ ID NO: 14241 - protein, 9 aa, Artificial Sequence
  Synthetic Peptide
ISFAGIVTK

SEQ ID NO: 14242 - protein, 10 aa, Artificial Sequence
  Synthetic Peptide
AVHLCTETSK

SEQ ID NO: 14243 - protein, 9 aa, Artificial Sequence
  Synthetic Peptide
TVSATQLVK

SEQ ID NO: 14244 - protein, 9 aa, Artificial Sequence
  Synthetic Peptide
TVNEYNTHK

SEQ ID NO: 14245 - protein, 9 aa, Artificial Sequence
  Synthetic Peptide
TVSATQIVR

SEQ ID NO: 14246 - protein, 10 aa, Artificial Sequence
  Synthetic Peptide
KQLQHTPSPY

SEQ ID NO: 14247 - protein, 10 aa, Artificial Sequence
  Synthetic Peptide
LQHASTSTPK

SEQ ID NO: 14248 - protein, 9 aa, Artificial Sequence
  Synthetic Peptide
STVSVGTAK

SEQ ID NO: 14249 - protein, 9 aa, Artificial Sequence
  Synthetic Peptide
KTASVGTPK

SEQ ID NO: 14250 - protein, 10 aa, Artificial Sequence
  Synthetic Peptide
GVRRATTSTK

SEQ ID NO: 14251 - protein, 9 aa, Artificial Sequence
  Synthetic Peptide
ATNCTNKQR

SEQ ID NO: 14252 - protein, 9 aa, Artificial Sequence
  Synthetic Peptide
TTNCTYKGR

SEQ ID NO: 14253 - protein, 10 aa, Artificial Sequence
  Synthetic Peptide
ILTAFNSSHK

SEQ ID NO: 14254 - protein, 9 aa, Artificial Sequence
  Synthetic Peptide
AFNSSHKGR

SEQ ID NO: 14255 - protein, 9 aa, Artificial Sequence
  Synthetic Peptide
NVAPIVHLK

SEQ ID NO: 14256 - protein, 9 aa, Artificial Sequence
  Synthetic Peptide
KVSPIVHLK

SEQ ID NO: 14257 - protein, 10 aa, Artificial Sequence
  Synthetic Peptide
SLKCLRYRLK

SEQ ID NO: 14258 - protein, 9 aa, Artificial Sequence
  Synthetic Peptide
CTAPIIHLK

SEQ ID NO: 14259 - protein, 9 aa, Artificial Sequence
  Synthetic Peptide
KTTPVVHLK

SEQ ID NO: 14260 - protein, 9 aa, Artificial Sequence
  Synthetic Peptide
ATTPIIHLK

SEQ ID NO: 14261 - protein, 10 aa, Artificial Sequence
  Synthetic Peptide
TLKCLRYRFK

SEQ ID NO: 14262 - protein, 10 aa, Artificial Sequence
  Synthetic Peptide
STWHWTSDNK

SEQ ID NO: 14263 - protein, 10 aa, Artificial Sequence
  Synthetic Peptide
STWHWTSDDK

SEQ ID NO: 14264 - protein, 10 aa, Artificial Sequence
  Synthetic Peptide
STWHWTGCNK

SEQ ID NO: 14265 - protein, 9 aa, Artificial Sequence
  Synthetic Peptide
TSNECTNNK

SEQ ID NO: 14266 - protein, 10 aa, Artificial Sequence
  Synthetic Peptide
QQQMFLGTVK

SEQ ID NO: 14267 - protein, 9 aa, Artificial Sequence
  Synthetic Peptide
QQMFLGTVK

SEQ ID NO: 14268 - protein, 9 aa, Artificial Sequence
  Synthetic Peptide
KLGIVTITY

SEQ ID NO: 14269 - protein, 9 aa, Artificial Sequence
  Synthetic Peptide
YSIITIIYK

SEQ ID NO: 14270 - protein, 9 aa, Artificial Sequence
  Synthetic Peptide
LTYDSEWQR

SEQ ID NO: 14271 - protein, 9 aa, Artificial Sequence
  Synthetic Peptide
VTYHSETQR

SEQ ID NO: 14272 - protein, 9 aa, Artificial Sequence
  Synthetic Peptide
RQLFLNTVK

SEQ ID NO: 14273 - protein, 9 aa, Artificial Sequence
  Synthetic Peptide
ITYSDETQR

SEQ ID NO: 14274 - protein, 9 aa, Artificial Sequence
  Synthetic Peptide
VTYNSEVQR

SEQ ID NO: 14275 - protein, 10 aa, Artificial Sequence
  Synthetic Peptide
TLTYISTSQR

SEQ ID NO: 14276 - protein, 9 aa, Artificial Sequence
  Synthetic Peptide
LTYISTSQR

SEQ ID NO: 14277 - protein, 9 aa, Artificial Sequence
  Synthetic Peptide
ETQRQQFLK

SEQ ID NO: 14278 - protein, 9 aa, Artificial Sequence
  Synthetic Peptide
FLSQVKIPK

SEQ ID NO: 14279 - protein, 9 aa, Artificial Sequence
  Synthetic Peptide
RQQFLKTVK

SEQ ID NO: 14280 - protein, 9 aa, Artificial Sequence
  Synthetic Peptide
VVYRLVWDK

SEQ ID NO: 14281 - protein, 11 aa, Artificial Sequence
  Synthetic Peptide
RFEDPTRRPYK

SEQ ID NO: 14282 - protein, 11 aa, Artificial Sequence
  Synthetic Peptide
RTAMFQDPQER

SEQ ID NO: 14283 - protein, 9 aa, Artificial Sequence
  Synthetic Peptide
AMFQDPQER

SEQ ID NO: 14284 - protein, 9 aa, Artificial Sequence
  Synthetic Peptide
RTQCVQCKK

SEQ ID NO: 14285 - protein, 9 aa, Artificial Sequence
  Synthetic Peptide
VSIACVYCK

SEQ ID NO: 14286 - protein, 9 aa, Artificial Sequence
  Synthetic Peptide
VSIACVYCR

SEQ ID NO: 14287 - protein, 9 aa, Artificial Sequence
  Synthetic Peptide
RLSCVYCKK

SEQ ID NO: 14288 - protein, 10 aa, Artificial Sequence
  Synthetic Peptide
LTEVFEFAFK

SEQ ID NO: 14289 - protein, 10 aa, Artificial Sequence
  Synthetic Peptide
RTEVYQFAFK

SEQ ID NO: 14290 - protein, 10 aa, Artificial Sequence
  Synthetic Peptide
RTEVYQFAFR

SEQ ID NO: 14291 - protein, 9 aa, Artificial Sequence
  Synthetic Peptide
YTFVFADLR

SEQ ID NO: 14292 - protein, 10 aa, Artificial Sequence
  Synthetic Peptide
FAFTDLTIVY

SEQ ID NO: 14293 - protein, 10 aa, Artificial Sequence
  Synthetic Peptide
FAFADLTVVY

SEQ ID NO: 14294 - protein, 11 aa, Artificial Sequence
  Synthetic Peptide
FLFTDLRIVYR

SEQ ID NO: 14295 - protein, 9 aa, Artificial Sequence
  Synthetic Peptide
FTDLRIVYR

SEQ ID NO: 14296 - protein, 10 aa, Artificial Sequence
  Synthetic Peptide
AFTDLTIVYR

SEQ ID NO: 14297 - protein, 10 aa, Artificial Sequence
  Synthetic Peptide
AFADLTVVYR

SEQ ID NO: 14298 - protein, 10 aa, Artificial Sequence
  Synthetic Peptide
VFADLRIVYR

SEQ ID NO: 14299 - protein, 10 aa, Artificial Sequence
  Synthetic Peptide
ATTDLTIVYR

SEQ ID NO: 14300 - protein, 10 aa, Artificial Sequence
  Synthetic Peptide
AVADLTVVYR

SEQ ID NO: 14301 - protein, 10 aa, Artificial Sequence
  Synthetic Peptide
LFTDLRIVYK

SEQ ID NO: 14302 - protein, 10 aa, Artificial Sequence
  Synthetic Peptide
VVADLRIVYR

SEQ ID NO: 14303 - protein, 9 aa, Artificial Sequence
  Synthetic Peptide
FTDLTIVYR

SEQ ID NO: 14304 - protein, 9 aa, Artificial Sequence
  Synthetic Peptide
FADLTVVYR

SEQ ID NO: 14305 - protein, 10 aa, Artificial Sequence
  Synthetic Peptide
AVKDLFVVYR

SEQ ID NO: 14306 - protein, 10 aa, Artificial Sequence
  Synthetic Peptide
AVKDLCIVYR

SEQ ID NO: 14307 - protein, 9 aa, Artificial Sequence
  Synthetic Peptide
CTELKLVYR

SEQ ID NO: 14308 - protein, 9 aa, Artificial Sequence
  Synthetic Peptide
IVYRDNNPY

SEQ ID NO: 14309 - protein, 10 aa, Artificial Sequence
  Synthetic Peptide
AFRDLCIVYR

SEQ ID NO: 14310 - protein, 10 aa, Artificial Sequence
  Synthetic Peptide
ATRDLCIVYR

SEQ ID NO: 14311 - protein, 10 aa, Artificial Sequence
  Synthetic Peptide
AFRDLCIVYK

SEQ ID NO: 14312 - protein, 10 aa, Artificial Sequence
  Synthetic Peptide
FVVYRDSIPK

SEQ ID NO: 14313 - protein, 9 aa, Artificial Sequence
  Synthetic Peptide
VVYRDSIPH

SEQ ID NO: 14314 - protein, 9 aa, Artificial Sequence
  Synthetic Peptide
IVYRDCIAR

SEQ ID NO: 14315 - protein, 9 aa, Artificial Sequence
  Synthetic Peptide
LVYRDDFPK

SEQ ID NO: 14316 - protein, 9 aa, Artificial Sequence
  Synthetic Peptide
LVYRDDFPY

SEQ ID NO: 14317 - protein, 9 aa, Artificial Sequence
  Synthetic Peptide
IVYRDGNPY

SEQ ID NO: 14318 - protein, 9 aa, Artificial Sequence
  Synthetic Peptide
SIPHAACHR

SEQ ID NO: 14319 - protein, 10 aa, Artificial Sequence
  Synthetic Peptide
AACHKCIDFY

SEQ ID NO: 14320 - protein, 10 aa, Artificial Sequence
  Synthetic Peptide
AACHKCIDFK

SEQ ID NO: 14321 - protein, 10 aa, Artificial Sequence
  Synthetic Peptide
CIMCLRFLSR

SEQ ID NO: 14322 - protein, 10 aa, Artificial Sequence
  Synthetic Peptide
AVCRVCLLFY

SEQ ID NO: 14323 - protein, 9 aa, Artificial Sequence
  Synthetic Peptide
KVCLRLLSK

SEQ ID NO: 14324 - protein, 10 aa, Artificial Sequence
  Synthetic Peptide
AVCRVCLLFR

SEQ ID NO: 14325 - protein, 9 aa, Artificial Sequence
  Synthetic Peptide
IMCLRFLSK

SEQ ID NO: 14326 - protein, 9 aa, Artificial Sequence
  Synthetic Peptide
KLCLRFLSK

SEQ ID NO: 14327 - protein, 9 aa, Artificial Sequence
  Synthetic Peptide
RFCLLFYSK

SEQ ID NO: 14328 - protein, 10 aa, Artificial Sequence
  Synthetic Peptide
AVCDKCLKFY

SEQ ID NO: 14329 - protein, 10 aa, Artificial Sequence
  Synthetic Peptide
RFYSKVSEFR

SEQ ID NO: 14330 - protein, 10 aa, Artificial Sequence
  Synthetic Peptide
AVCDKCLKFR

SEQ ID NO: 14331 - protein, 10 aa, Artificial Sequence
  Synthetic Peptide
RLYSKVSEFR

SEQ ID NO: 14332 - protein, 10 aa, Artificial Sequence
  Synthetic Peptide
RVLSKISEYR

SEQ ID NO: 14333 - protein, 10 aa, Artificial Sequence
  Synthetic Peptide
RLLSKISEYR

SEQ ID NO: 14334 - protein, 10 aa, Artificial Sequence
  Synthetic Peptide
RTLSKISEYR

SEQ ID NO: 14335 - protein, 10 aa, Artificial Sequence
  Synthetic Peptide
RFLSKISEYR

SEQ ID NO: 14336 - protein, 10 aa, Artificial Sequence
  Synthetic Peptide
CFLFYSKVRK

SEQ ID NO: 14337 - protein, 9 aa, Artificial Sequence
  Synthetic Peptide
LLFYSKVRK

SEQ ID NO: 14338 - protein, 11 aa, Artificial Sequence
  Synthetic Peptide
LLFYSKVRKYR

SEQ ID NO: 14339 - protein, 10 aa, Artificial Sequence
  Synthetic Peptide
LVYSKVRKYR

SEQ ID NO: 14340 - protein, 10 aa, Artificial Sequence
  Synthetic Peptide
KVSEFRWYRY

SEQ ID NO: 14341 - protein, 10 aa, Artificial Sequence
  Synthetic Peptide
KISEYRHYNY

SEQ ID NO: 14342 - protein, 9 aa, Artificial Sequence
  Synthetic Peptide
KVSEFRWYR

SEQ ID NO: 14343 - protein, 10 aa, Artificial Sequence
  Synthetic Peptide
KVSEFRWYRR

SEQ ID NO: 14344 - protein, 10 aa, Artificial Sequence
  Synthetic Peptide
KISEYRHYNR

SEQ ID NO: 14345 - protein, 10 aa, Artificial Sequence
  Synthetic Peptide
KISEYRHYNK

SEQ ID NO: 14346 - protein, 10 aa, Artificial Sequence
  Synthetic Peptide
KISEYRHYQY

SEQ ID NO: 14347 - protein, 10 aa, Artificial Sequence
  Synthetic Peptide
KFYSKISEYR

SEQ ID NO: 14348 - protein, 10 aa, Artificial Sequence
  Synthetic Peptide
KLYSKISEYR

SEQ ID NO: 14349 - protein, 10 aa, Artificial Sequence
  Synthetic Peptide
KISEYRHYCY

SEQ ID NO: 14350 - protein, 10 aa, Artificial Sequence
  Synthetic Peptide
YSVYGTTLEK

SEQ ID NO: 14351 - protein, 10 aa, Artificial Sequence
  Synthetic Peptide
SLYGKTLEER

SEQ ID NO: 14352 - protein, 9 aa, Artificial Sequence
  Synthetic Peptide
SVYGTTLEK

SEQ ID NO: 14353 - protein, 10 aa, Artificial Sequence
  Synthetic Peptide
SLYGKTLEEK

SEQ ID NO: 14354 - protein, 9 aa, Artificial Sequence
  Synthetic Peptide
SVYGTTLER

SEQ ID NO: 14355 - protein, 10 aa, Artificial Sequence
  Synthetic Peptide
DSVYGDTLER

SEQ ID NO: 14356 - protein, 9 aa, Artificial Sequence
  Synthetic Peptide
SVYGDTLEK

SEQ ID NO: 14357 - protein, 9 aa, Artificial Sequence
  Synthetic Peptide
SVYGETLEK

SEQ ID NO: 14358 - protein, 9 aa, Artificial Sequence
  Synthetic Peptide
SVYGETLER

SEQ ID NO: 14359 - protein, 9 aa, Artificial Sequence
  Synthetic Peptide
TTLEKLTNK

SEQ ID NO: 14360 - protein, 9 aa, Artificial Sequence
  Synthetic Peptide
KTLEERVKK

SEQ ID NO: 14361 - protein, 9 aa, Artificial Sequence
  Synthetic Peptide
ATLESITKK

SEQ ID NO: 14362 - protein, 10 aa, Artificial Sequence
  Synthetic Peptide
GTTLEQQYNK

SEQ ID NO: 14363 - protein, 9 aa, Artificial Sequence
  Synthetic Peptide
TTLEQQYNK

SEQ ID NO: 14364 - protein, 9 aa, Artificial Sequence
  Synthetic Peptide
KVLCDLLIR

SEQ ID NO: 14365 - protein, 9 aa, Artificial Sequence
  Synthetic Peptide
KQLCDLLIR

SEQ ID NO: 14366 - protein, 10 aa, Artificial Sequence
  Synthetic Peptide
ILIRCIICQR

SEQ ID NO: 14367 - protein, 10 aa, Artificial Sequence
  Synthetic Peptide
LVIRCITCQR

SEQ ID NO: 14368 - protein, 10 aa, Artificial Sequence
  Synthetic Peptide
LLIRCITCQK

SEQ ID NO: 14369 - protein, 10 aa, Artificial Sequence
  Synthetic Peptide
ITIRCIICQR

SEQ ID NO: 14370 - protein, 9 aa, Artificial Sequence
  Synthetic Peptide
LIRCIICQR

SEQ ID NO: 14371 - protein, 9 aa, Artificial Sequence
  Synthetic Peptide
LVRCIICQR

SEQ ID NO: 14372 - protein, 9 aa, Artificial Sequence
  Synthetic Peptide
LIRCIICQK

SEQ ID NO: 14373 - protein, 10 aa, Artificial Sequence
  Synthetic Peptide
LLIRCLRCQK

SEQ ID NO: 14374 - protein, 10 aa, Artificial Sequence
  Synthetic Peptide
LSIRCLRCQK

SEQ ID NO: 14375 - protein, 10 aa, Artificial Sequence
  Synthetic Peptide
LLIRCINCQK

SEQ ID NO: 14376 - protein, 10 aa, Artificial Sequence
  Synthetic Peptide
RFHNIAGHYR

SEQ ID NO: 14377 - protein, 10 aa, Artificial Sequence
  Synthetic Peptide
RFHNIAGHYK

SEQ ID NO: 14378 - protein, 9 aa, Artificial Sequence
  Synthetic Peptide
NIMGRWTGK

SEQ ID NO: 14379 - protein, 10 aa, Artificial Sequence
  Synthetic Peptide
KQRFHNIRGR

SEQ ID NO: 14380 - protein, 10 aa, Artificial Sequence
  Synthetic Peptide
KVRFHNIRGR

SEQ ID NO: 14381 - protein, 10 aa, Artificial Sequence
  Synthetic Peptide
WTGRCIACWR

SEQ ID NO: 14382 - protein, 10 aa, Artificial Sequence
  Synthetic Peptide
WTGRCIACWK

SEQ ID NO: 14383 - protein, 9 aa, Artificial Sequence
  Synthetic Peptide
AGRCAACWR

SEQ ID NO: 14384 - protein, 9 aa, Artificial Sequence
  Synthetic Peptide
RCSECWRPR

SEQ ID NO: 14385 - protein, 10 aa, Artificial Sequence
  Synthetic Peptide
RTQCHSCCNR

SEQ ID NO: 14386 - protein, 10 aa, Artificial Sequence
  Synthetic Peptide
RTIACWRRPR

SEQ ID NO: 14387 - protein, 9 aa, Artificial Sequence
  Synthetic Peptide
RVAVCWRPR

SEQ ID NO: 14388 - protein, 9 aa, Artificial Sequence
  Synthetic Peptide
AACWRSRRR

SEQ ID NO: 14389 - protein, 9 aa, Artificial Sequence
  Synthetic Peptide
AACWRSRRK

SEQ ID NO: 14390 - protein, 9 aa, Artificial Sequence
  Synthetic Peptide
AVCWRPRRK

SEQ ID NO: 14391 - protein, 10 aa, Artificial Sequence
  Synthetic Peptide
MSCCRSSRTR

SEQ ID NO: 14392 - protein, 9 aa, Artificial Sequence
  Synthetic Peptide
RARQERLQR

SEQ ID NO: 14393 - protein, 10 aa, Artificial Sequence
  Synthetic Peptide
MSCCRSSRTK

SEQ ID NO: 14394 - protein, 9 aa, Artificial Sequence
  Synthetic Peptide
SVCRSSRTR

SEQ ID NO: 14395 - protein, 9 aa, Artificial Sequence
  Synthetic Peptide
ATLQDIVLH

SEQ ID NO: 14396 - protein, 9 aa, Artificial Sequence
  Synthetic Peptide
ATLQDIVLK

SEQ ID NO: 14397 - protein, 9 aa, Artificial Sequence
  Synthetic Peptide
VIDSPAGQA

SEQ ID NO: 14398 - protein, 9 aa, Artificial Sequence
  Synthetic Peptide
GVNHQHLPK

SEQ ID NO: 14399 - protein, 9 aa, Artificial Sequence
  Synthetic Peptide
VVHAQLPAR

SEQ ID NO: 14400 - protein, 10 aa, Artificial Sequence
  Synthetic Peptide
ATSNYYIVTY

SEQ ID NO: 14401 - protein, 10 aa, Artificial Sequence
  Synthetic Peptide
NVVTFCCQCK

SEQ ID NO: 14402 - protein, 9 aa, Artificial Sequence
  Synthetic Peptide
KQHTCYLIR

SEQ ID NO: 14403 - protein, 11 aa, Artificial Sequence
  Synthetic Peptide
TFCCKCDSTLR

SEQ ID NO: 14404 - protein, 9 aa, Artificial Sequence
  Synthetic Peptide
HTMLCMCCR

SEQ ID NO: 14405 - protein, 9 aa, Artificial Sequence
  Synthetic Peptide
TLRLCIHST

SEQ ID NO: 14406 - protein, 9 aa, Artificial Sequence
  Synthetic Peptide
VQLDIQSTK

SEQ ID NO: 14407 - protein, 9 aa, Artificial Sequence
  Synthetic Peptide
VTLDIQSTK

SEQ ID NO: 14408 - protein, 9 aa, Artificial Sequence
  Synthetic Peptide
VVQQLLMGA

SEQ ID NO: 14409 - protein, 10 aa, Artificial Sequence
  Synthetic Peptide
GIVCPICSQK

SEQ ID NO: 14410 - protein, 11 aa, Artificial Sequence
  Synthetic Peptide
TLQVVCPGCAR

SEQ ID NO: 14411 - protein, 10 aa, Artificial Sequence
  Synthetic Peptide
GLVCPICSQK

SEQ ID NO: 14412 - protein, 9 aa, Artificial Sequence
  Synthetic Peptide
IVCPICSQK

SEQ ID NO: 14413 - protein, 9 aa, Artificial Sequence
  Synthetic Peptide
LSFVCPWCR

SEQ ID NO: 14414 - protein, 10 aa, Artificial Sequence
  Synthetic Peptide
TFWNPPTTAR

SEQ ID NO: 14415 - protein, 10 aa, Artificial Sequence
  Synthetic Peptide
TVWNPPTTAK

SEQ ID NO: 14416 - protein, 10 aa, Artificial Sequence
  Synthetic Peptide
TLWNPPTTAK

SEQ ID NO: 14417 - protein, 9 aa, Artificial Sequence
  Synthetic Peptide
KLFGYSWYK

SEQ ID NO: 14418 - protein, 9 aa, Artificial Sequence
  Synthetic Peptide
HLYGYSWYK

SEQ ID NO: 14419 - protein, 9 aa, Artificial Sequence
  Synthetic Peptide
HLFTYSWYK

SEQ ID NO: 14420 - protein, 9 aa, Artificial Sequence
  Synthetic Peptide
HLFDYSWYK

SEQ ID NO: 14421 - protein, 9 aa, Artificial Sequence
  Synthetic Peptide
HLFWYSWYK

SEQ ID NO: 14422 - protein, 9 aa, Artificial Sequence
  Synthetic Peptide
HLFRYSWYK

SEQ ID NO: 14423 - protein, 9 aa, Artificial Sequence
  Synthetic Peptide
HLFGYSFYK

SEQ ID NO: 14424 - protein, 9 aa, Artificial Sequence
  Synthetic Peptide
HLFGYSYYK

SEQ ID NO: 14425 - protein, 11 aa, Artificial Sequence
  Synthetic Peptide
TTITVYAEPPR

SEQ ID NO: 14426 - protein, 8 aa, Artificial Sequence
  Synthetic Peptide
TVYAEPPR

SEQ ID NO: 14427 - protein, 8 aa, Artificial Sequence
  Synthetic Peptide
TTYAEPPK

SEQ ID NO: 14428 - protein, 8 aa, Artificial Sequence
  Synthetic Peptide
TLYAEPPK

SEQ ID NO: 14429 - protein, 10 aa, Artificial Sequence
  Synthetic Peptide
RTLTLLSVTK

SEQ ID NO: 14430 - protein, 10 aa, Artificial Sequence
  Synthetic Peptide
TVTVSAELPK

SEQ ID NO: 14431 - protein, 9 aa, Artificial Sequence
  Synthetic Peptide
ITVSAELPR

SEQ ID NO: 14432 - protein, 9 aa, Artificial Sequence
  Synthetic Peptide
IVVSAELPK

SEQ ID NO: 14433 - protein, 9 aa, Artificial Sequence
  Synthetic Peptide
ILVSAELPK

SEQ ID NO: 14434 - protein, 8 aa, Artificial Sequence
  Synthetic Peptide
TVSAELPR

SEQ ID NO: 14435 - protein, 8 aa, Artificial Sequence
  Synthetic Peptide
TTSAELPK

SEQ ID NO: 14436 - protein, 8 aa, Artificial Sequence
  Synthetic Peptide
TLSAELPK

SEQ ID NO: 14437 - protein, 10 aa, Artificial Sequence
  Synthetic Peptide
QTRSLTEILK

SEQ ID NO: 14438 - protein, 10 aa, Artificial Sequence
  Synthetic Peptide
QQRSLTEILK

SEQ ID NO: 14439 - protein, 10 aa, Artificial Sequence
  Synthetic Peptide
LVYQDTILWK

SEQ ID NO: 14440 - protein, 10 aa, Artificial Sequence
  Synthetic Peptide
TILWKDIFHR

SEQ ID NO: 14441 - protein, 9 aa, Artificial Sequence
  Synthetic Peptide
ILWKDIFHR

SEQ ID NO: 14442 - protein, 10 aa, Artificial Sequence
  Synthetic Peptide
RTVCAGGCAK

SEQ ID NO: 14443 - protein, 10 aa, Artificial Sequence
  Synthetic Peptide
RVVCAGGCAR

SEQ ID NO: 14444 - protein, 10 aa, Artificial Sequence
  Synthetic Peptide
RLVCAGGCAR

SEQ ID NO: 14445 - protein, 9 aa, Artificial Sequence
  Synthetic Peptide
TVCAGGCAK

SEQ ID NO: 14446 - protein, 10 aa, Artificial Sequence
  Synthetic Peptide
SVFQNLQVIK

SEQ ID NO: 14447 - protein, 10 aa, Artificial Sequence
  Synthetic Peptide
SFFQNLQVIR

SEQ ID NO: 14448 - protein, 10 aa, Artificial Sequence
  Synthetic Peptide
ISWLGLRSLK

SEQ ID NO: 14449 - protein, 10 aa, Artificial Sequence
  Synthetic Peptide
HTVPWDQLFK

SEQ ID NO: 14450 - protein, 10 aa, Artificial Sequence
  Synthetic Peptide
HLVPWDQLFR

SEQ ID NO: 14451 - protein, 9 aa, Artificial Sequence
  Synthetic Peptide
CVNCSQFLK

SEQ ID NO: 14452 - protein, 10 aa, Artificial Sequence
  Synthetic Peptide
RVLQGLPREK

SEQ ID NO: 14453 - protein, 10 aa, Artificial Sequence
  Synthetic Peptide
CTARCPSGVK

SEQ ID NO: 14454 - protein, 10 aa, Artificial Sequence
  Synthetic Peptide
GVVFGILIKK

SEQ ID NO: 14455 - protein, 10 aa, Artificial Sequence
  Synthetic Peptide
GTVFGILIKR

SEQ ID NO: 14456 - protein, 10 aa, Artificial Sequence
  Synthetic Peptide
GLVFGILIKR

SEQ ID NO: 14457 - protein, 10 aa, Artificial Sequence
  Synthetic Peptide
VVFGILIKRK

SEQ ID NO: 14458 - protein, 9 aa, Artificial Sequence
  Synthetic Peptide
IVIKRRQQK

SEQ ID NO: 14459 - protein, 9 aa, Artificial Sequence
  Synthetic Peptide
IQIKRRQQK

SEQ ID NO: 14460 - protein, 10 aa, Artificial Sequence
  Synthetic Peptide
RLLKETELRK

SEQ ID NO: 14461 - protein, 10 aa, Artificial Sequence
  Synthetic Peptide
RQLKETELRK

SEQ ID NO: 14462 - protein, 9 aa, Artificial Sequence
  Synthetic Peptide
IVKETELRK

SEQ ID NO: 14463 - protein, 10 aa, Artificial Sequence
  Synthetic Peptide
YVMAGVGSPK

SEQ ID NO: 14464 - protein, 9 aa, Artificial Sequence
  Synthetic Peptide
QLVTQLMPK

SEQ ID NO: 14465 - protein, 9 aa, Artificial Sequence
  Synthetic Peptide
LTARNVLVK

SEQ ID NO: 14466 - protein, 10 aa, Artificial Sequence
  Synthetic Peptide
VVVKSPNHVK

SEQ ID NO: 14467 - protein, 9 aa, Artificial Sequence
  Synthetic Peptide
MALESILRK

SEQ ID NO: 14468 - protein, 9 aa, Artificial Sequence
  Synthetic Peptide
MTLESILRR

SEQ ID NO: 14469 - protein, 10 aa, Artificial Sequence
  Synthetic Peptide
TVDVYMIMVK

SEQ ID NO: 14470 - protein, 10 aa, Artificial Sequence
  Synthetic Peptide
TLDVYMIMVK

SEQ ID NO: 14471 - protein, 10 aa, Artificial Sequence
  Synthetic Peptide
KTYQGSYGFR

SEQ ID NO: 14472 - protein, 9 aa, Artificial Sequence
  Synthetic Peptide
YGFRLGFLH

SEQ ID NO: 14473 - protein, 9 aa, Artificial Sequence
  Synthetic Peptide
YGFRLGFLK

SEQ ID NO: 14474 - protein, 9 aa, Artificial Sequence
  Synthetic Peptide
YVFRLGFLH

SEQ ID NO: 14475 - protein, 10 aa, Artificial Sequence
  Synthetic Peptide
GTAKSVTCTY

SEQ ID NO: 14476 - protein, 10 aa, Artificial Sequence
  Synthetic Peptide
GTAKSVTCTK

SEQ ID NO: 14477 - protein, 10 aa, Artificial Sequence
  Synthetic Peptide
GTAKSVTCTR

SEQ ID NO: 14478 - protein, 11 aa, Artificial Sequence
  Synthetic Peptide
VTCTYSPALNK

SEQ ID NO: 14479 - protein, 11 aa, Artificial Sequence
  Synthetic Peptide
VTCTYSPALNR

SEQ ID NO: 14480 - protein, 11 aa, Artificial Sequence
  Synthetic Peptide
VVCTYSPALNK

SEQ ID NO: 14481 - protein, 11 aa, Artificial Sequence
  Synthetic Peptide
VLCTYSPALNK

SEQ ID NO: 14482 - protein, 10 aa, Artificial Sequence
  Synthetic Peptide
TCTYSPALNK

SEQ ID NO: 14483 - protein, 10 aa, Artificial Sequence
  Synthetic Peptide
TVTYSPALNK

SEQ ID NO: 14484 - protein, 10 aa, Artificial Sequence
  Synthetic Peptide
TTTYSPALNK

SEQ ID NO: 14485 - protein, 9 aa, Artificial Sequence
  Synthetic Peptide
CTYSPALNR

SEQ ID NO: 14486 - protein, 9 aa, Artificial Sequence
  Synthetic Peptide
CFYSPALNK

SEQ ID NO: 14487 - protein, 11 aa, Artificial Sequence
  Synthetic Peptide
ALNKMFCQLAK

SEQ ID NO: 14488 - protein, 11 aa, Artificial Sequence
  Synthetic Peptide
ALNKMFCQLAR

SEQ ID NO: 14489 - protein, 11 aa, Artificial Sequence
  Synthetic Peptide
AVNKMFCQLAK

SEQ ID NO: 14490 - protein, 11 aa, Artificial Sequence
  Synthetic Peptide
ATNKMFCQLAK

SEQ ID NO: 14491 - protein, 10 aa, Artificial Sequence
  Synthetic Peptide
LNKMFCQLAR

SEQ ID NO: 14492 - protein, 10 aa, Artificial Sequence
  Synthetic Peptide
LVKMFCQLAK

SEQ ID NO: 14493 - protein, 10 aa, Artificial Sequence
  Synthetic Peptide
LTKMFCQLAK

SEQ ID NO: 14494 - protein, 8 aa, Artificial Sequence
  Synthetic Peptide
KMFCQLAK

SEQ ID NO: 14495 - protein, 8 aa, Artificial Sequence
  Synthetic Peptide
KMFCQLAR

SEQ ID NO: 14496 - protein, 8 aa, Artificial Sequence
  Synthetic Peptide
KFFCQLAK

SEQ ID NO: 14497 - protein, 10 aa, Artificial Sequence
  Synthetic Peptide
GLAPPQHLIR

SEQ ID NO: 14498 - protein, 9 aa, Artificial Sequence
  Synthetic Peptide
SSCMGGMNR

SEQ ID NO: 14499 - protein, 9 aa, Artificial Sequence
  Synthetic Peptide
SVCMGGMNR

SEQ ID NO: 14500 - protein, 9 aa, Artificial Sequence
  Synthetic Peptide
STCMGGMNR

SEQ ID NO: 14501 - protein, 11 aa, Artificial Sequence
  Synthetic Peptide
RVCACPGRDRR

SEQ ID NO: 14502 - protein, 11 aa, Artificial Sequence
  Synthetic Peptide
RVCACPGRDRK

SEQ ID NO: 14503 - protein, 11 aa, Artificial Sequence
  Synthetic Peptide
RTCACPGRDRR

SEQ ID NO: 14504 - protein, 11 aa, Artificial Sequence
  Synthetic Peptide
RLCACPGRDRR

SEQ ID NO: 14505 - protein, 10 aa, Artificial Sequence
  Synthetic Peptide
RVCACPGRDR

SEQ ID NO: 14506 - protein, 9 aa, Artificial Sequence
  Synthetic Peptide
ETNEALELK

SEQ ID NO: 14507 - protein, 9 aa, Artificial Sequence
  Synthetic Peptide
EQNEALELK

SEQ ID NO: 14508 - protein, 8 aa, Artificial Sequence
  Synthetic Peptide
RAHSSHLK

SEQ ID NO: 14509 - protein, 8 aa, Artificial Sequence
  Synthetic Peptide
RAHSSHLR

SEQ ID NO: 14510 - protein, 8 aa, Artificial Sequence
  Synthetic Peptide
RVHSSHLK

SEQ ID NO: 14511 - protein, 11 aa, Artificial Sequence
  Synthetic Peptide
RAHSSHLKSKK

SEQ ID NO: 14512 - protein, 11 aa, Artificial Sequence
  Synthetic Peptide
RAHSSHLKSKR

SEQ ID NO: 14513 - protein, 11 aa, Artificial Sequence
  Synthetic Peptide
RVHSSHLKSKK

SEQ ID NO: 14514 - protein, 11 aa, Artificial Sequence
  Synthetic Peptide
RTHSSHLKSKK

SEQ ID NO: 14515 - protein, 11 aa, Artificial Sequence
  Synthetic Peptide
STSRHKKLMFK

SEQ ID NO: 14516 - protein, 10 aa, Artificial Sequence
  Synthetic Peptide
TSRHKKLMFK

SEQ ID NO: 14517 - protein, 10 aa, Artificial Sequence
  Synthetic Peptide
TVRHKKLMFK

SEQ ID NO: 14518 - protein, 9 aa, Artificial Sequence
  Synthetic Peptide
GINDRNFWR

SEQ ID NO: 14519 - protein, 9 aa, Artificial
  Synthetic Peptide
FPDHQLDPA

SEQ ID NO: 14520 - protein, 9 aa, Artificial
  Synthetic Peptide
PPAYRPPNA

SEQ ID NO: 14521 - protein, 9 aa, Artificial
  Synthetic Peptide
YPALMPLYA

SEQ ID NO: 14522 - protein, 9 aa, Artificial
  Synthetic Peptide
LPVCAFSSA

SEQ ID NO: 14523 - protein, 9 aa, Artificial
  Synthetic Peptide
APLGGAARA

SEQ ID NO: 14524 - protein, 9 aa, Artificial
  Synthetic Peptide
DPTTPLARA

SEQ ID NO: 14525 - protein, 9 aa, Artificial
  Synthetic Peptide
FPYLVAYQA

SEQ ID NO: 14526 - protein, 9 aa, Artificial
  Synthetic Peptide
LPAILSPGA

SEQ ID NO: 14527 - protein, 9 aa, Artificial
  Synthetic Peptide
NPAIASLMA

SEQ ID NO: 14528 - protein, 9 aa, Artificial
  Synthetic Peptide
SPGEINRVA

SEQ ID NO: 14529 - protein, 9 aa, Artificial
  Synthetic Peptide
TPIDTTIMA

SEQ ID NO: 14530 - protein, 9 aa, Artificial
  Synthetic Peptide
TPLLYRLGA

SEQ ID NO: 14531 - protein, 9 aa, Artificial
  Synthetic Peptide
TPTLAARNA

SEQ ID NO: 14532 - protein, 9 aa, Artificial
  Synthetic Peptide
WPLLLLLLA

SEQ ID NO: 14533 - protein, 9 aa, Artificial
  Synthetic Peptide
EPAADGVGA

SEQ ID NO: 14534 - protein, 9 aa, Artificial
  Synthetic Peptide
NPYNTPVFA

SEQ ID NO: 14535 - protein, 9 aa, Artificial
  Synthetic Peptide
SPPHSPQGA

SEQ ID NO: 14536 - protein, 9 aa, Artificial
  Synthetic Peptide
APATEEQEA

SEQ ID NO: 14537 - protein, 9 aa, Artificial
  Synthetic Peptide
DPPGSPQGA

SEQ ID NO: 14538 - protein, 9 aa, Artificial
  Synthetic Peptide
APLLLARAA

SEQ ID NO: 14539 - protein, 9 aa, Artificial
  Synthetic Peptide
VPGAATPYA

SEQ ID NO: 14540 - protein, 9 aa, Artificial
  Synthetic Peptide
HPQWVLTAA

SEQ ID NO: 14541 - protein, 10 aa, Artificial
  Synthetic Peptide
IPIPSSWAFA

SEQ ID NO: 14542 - protein, 10 aa, Artificial
  Synthetic Peptide
SPHHTALRQA

SEQ ID NO: 14543 - protein, 10 aa, Artificial
  Synthetic Peptide
TPPAYRPPNA

SEQ ID NO: 14544 - protein, 10 aa, Artificial
  Synthetic Peptide
APFTQCGYPA

SEQ ID NO: 14545 - protein, 10 aa, Artificial
  Synthetic Peptide
LPIHTAELLA

SEQ ID NO: 14546 - protein, 10 aa, Artificial
  Synthetic Peptide
GPCALRFTSA

SEQ ID NO: 14547 - protein, 10 aa, Artificial
  Synthetic Peptide
DPSHITAETA

SEQ ID NO: 14548 - protein, 10 aa, Artificial
  Synthetic Peptide
DPTTPLARAA

SEQ ID NO: 14549 - protein, 9 aa, Artificial
  Synthetic Peptide
IPQAVVMVA

SEQ ID NO: 14550 - protein, 10 aa, Artificial
  Synthetic Peptide
LPCEPEPDVA

SEQ ID NO: 14551 - protein, 10 aa, Artificial
  Synthetic Peptide
LPCSFTTLPA

SEQ ID NO: 14552 - protein, 10 aa, Artificial
  Synthetic Peptide
QPEKGGRKPA

SEQ ID NO: 14553 - protein, 10 aa, Artificial
  Synthetic Peptide
VPHPNIEEVA

SEQ ID NO: 14554 - protein, 10 aa, Artificial
  Synthetic Peptide
GPGHKARVLA

SEQ ID NO: 14555 - protein, 10 aa, Artificial
  Synthetic Peptide
NPDCKTILKA

SEQ ID NO: 14556 - protein, 10 aa, Artificial
  Synthetic Peptide
SPEVIPMFSA

SEQ ID NO: 14557 - protein, 10 aa, Artificial
  Synthetic Peptide
IPAETGQETA

SEQ ID NO: 14558 - protein, 10 aa, Artificial
  Synthetic Peptide
LPQGWKGSPA

SEQ ID NO: 14559 - protein, 10 aa, Artificial
  Synthetic Peptide
PPVVAKEIVA

SEQ ID NO: 14560 - protein, 10 aa, Artificial
  Synthetic Peptide
APATEEQQTA

SEQ ID NO: 14561 - protein, 10 aa, Artificial
  Synthetic Peptide
FPDLESEFQA

SEQ ID NO: 14562 - protein, 10 aa, Artificial
  Synthetic Peptide
APATEEQEAA

SEQ ID NO: 14563 - protein, 10 aa, Artificial
  Synthetic Peptide
DPIGHLYIFA

SEQ ID NO: 14564 - protein, 10 aa, Artificial
  Synthetic Peptide
SPSCPLERFA

SEQ ID NO: 14565 - protein, 10 aa, Artificial
  Synthetic Peptide
DPNRNVDENA

SEQ ID NO: 14566 - protein, 10 aa, Artificial
  Synthetic Peptide
DPADNANPDA

SEQ ID NO: 14567 - protein, 10 aa, Artificial
  Synthetic Peptide
EPNADPQVTA

SEQ ID NO: 14568 - protein, 10 aa, Artificial
  Synthetic Peptide
KPEQKEDKSA

SEQ ID NO: 14569 - protein, 10 aa, Artificial
  Synthetic Peptide
QPRPRGDNFA

SEQ ID NO: 14570 - protein, 10 aa, Artificial
  Synthetic Peptide
EPALGTTCYA

SEQ ID NO: 14571 - protein, 9 aa, Artificial
  Synthetic Peptide
EVDPIGHLY

SEQ ID NO: 14572 - protein, 10 aa, Artificial
  Synthetic Peptide
ASSLPTTMNY

SEQ ID NO: 14573 - protein, 9 aa, Artificial
  Synthetic Peptide
EADPTGHSY

SEQ ID NO: 14574 - protein, 9 aa, Artificial
  Synthetic Peptide
SSLPTTMNY

SEQ ID NO: 14575 - protein, 9 aa, Artificial
  Synthetic Peptide
GSVVGNWQY

SEQ ID NO: 14576 - protein, 9 aa, Artificial
  Synthetic Peptide
ALAETSYVK

SEQ ID NO: 14577 - protein, 9 aa, Artificial
  Synthetic Peptide
SLFRAVITK

SEQ ID NO: 14578 - protein, 10 aa, Artificial
  Synthetic Peptide
RALAETSYVK

SEQ ID NO: 14579 - protein, 10 aa, Artificial
  Synthetic Peptide
ESLFRAVITK

SEQ ID NO: 14580 - protein, 11 aa, Artificial
  Synthetic Peptide
KVYLAWVPAHK

SEQ ID NO: 14581 - protein, 10 aa, Artificial
  Synthetic Peptide
TVYYGVPVWK

SEQ ID NO: 14582 - protein, 9 aa, Artificial
  Synthetic Peptide
KLAGRWPVK

SEQ ID NO: 14583 - protein, 11 aa, Artificial
  Synthetic Peptide
KMIGGIGGFIK

SEQ ID NO: 14584 - protein, 9 aa, Artificial
  Synthetic Peptide
AIFQSSMTK

SEQ ID NO: 14585 - protein, 11 aa, Artificial
  Synthetic Peptide
WTYQIYQEPFK

SEQ ID NO: 14586 - protein, 10 aa, Artificial
  Synthetic Peptide
FLGKIWPSHK

SEQ ID NO: 14587 - protein, 10 aa, Artificial
  Synthetic Peptide
TVYYGVPVWK

SEQ ID NO: 14588 - protein, 11 aa, Artificial
  Synthetic Peptide
VTVYYGVPVWK

SEQ ID NO: 14589 - protein, 10 aa, Artificial
  Synthetic Peptide
GVAGALVAFK

SEQ ID NO: 14590 - protein, 9 aa, Artificial
  Synthetic Peptide
CTCGSSDLY

SEQ ID NO: 14591 - protein, 10 aa, Artificial
  Synthetic Peptide
GVAGALVAFK

SEQ ID NO: 14592 - protein, 9 aa, Artificial
  Synthetic Peptide
LLDTASALY

SEQ ID NO: 14593 - protein, 10 aa, Artificial
  Synthetic Peptide
TLWKAGILYK

SEQ ID NO: 14594 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XSXXXXXXY

SEQ ID NO: 14595 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XSXXXXXXXY

SEQ ID NO: 14596 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XTXXXXXXY

SEQ ID NO: 14597 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XTXXXXXXXY

SEQ ID NO: 14598 - protein, 9 aa, Artificial
  Synthetic Peptide
  misc_feature (1)..(2): Xaa can be any naturally occurring amino acid
  misc_feature (4)..(8): Xaa can be any naturally occurring amino acid
XXDXXXXXY

SEQ ID NO: 14599 - protein, 10 aa, Artificial
  Synthetic Peptide
  misc_feature (1)..(2): Xaa can be any naturally occurring amino acid
  misc_feature (4)..(9): Xaa can be any naturally occurring amino acid
XXDXXXXXXY

SEQ ID NO: 14600 - protein, 9 aa, Artificial
  Synthetic Peptide
  misc_feature (1)..(2): Xaa can be any naturally occurring amino acid
  misc_feature (4)..(8): Xaa can be any naturally occurring amino acid
XXEXXXXXY

SEQ ID NO: 14601 - protein, 10 aa, Artificial
  Synthetic Peptide
  misc_feature (1)..(2): Xaa can be any naturally occurring amino acid
  misc_feature (4)..(9): Xaa can be any naturally occurring amino acid
XXEXXXXXXY

SEQ ID NO: 14602 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XVXXXXXXK

SEQ ID NO: 14603 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XVXXXXXXXK

SEQ ID NO: 14604 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XLXXXXXXK

SEQ ID NO: 14605 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XLXXXXXXXK

SEQ ID NO: 14606 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XMXXXXXXK

SEQ ID NO: 14607 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XMXXXXXXXK

SEQ ID NO: 14608 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XTXXXXXXK

SEQ ID NO: 14609 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XTXXXXXXXK

SEQ ID NO: 14610 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XVXXXXXXK

SEQ ID NO: 14611 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XVXXXXXXXK

SEQ ID NO: 14612 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XYXXXXXXF

SEQ ID NO: 14613 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XYXXXXXXXF

SEQ ID NO: 14614 - protein, 9 aa, Artificial
  Synthetic Peptide
  misc_feature (1)..(1): Xaa can be any naturally occurring amino acid
  misc_feature (3)..(8): Xaa can be any naturally occurring amino acid
XYXXXXXXL

SEQ ID NO: 14615 - protein, 10 aa, Artificial
  Synthetic Peptide
  misc_feature (1)..(1): Xaa can be any naturally occurring amino acid
  misc_feature (3)..(9): Xaa can be any naturally occurring amino acid
XYXXXXXXXL

SEQ ID NO: 14616 - protein, 21 aa, Artificial
  Synthetic Peptide
DIEKKIAKMEKASSVFNVVNS

SEQ ID NO: 14617 - protein, 9 aa, Artificial
  Synthetic Peptide
FTQAGYPAL

SEQ ID NO: 14618 - protein, 9 aa, Artificial
  Synthetic Peptide
  misc_feature (1)..(1): Xaa can be any naturally occurring amino acid
  misc_feature (3)..(8): Xaa can be any naturally occurring amino acid
  MISC_FEATURE (9)..(9): Xaa is Ala, Val, Ile, Leu or Met
XPXXXXXXX

SEQ ID NO: 14619 - protein, 10 aa, Artificial
  Synthetic Peptide
  misc_feature (1)..(1): Xaa can be any naturally occurring amino acid
  misc_feature (3)..(9): Xaa can be any naturally occurring amino acid
  MISC_FEATURE (10)..(10): Xaa is Ala, Val, Ile, Leu or Met
XPXXXXXXXX

SEQ ID NO: 14620 - protein, 9 aa, Artificial
  Synthetic Peptide
  misc_feature (1)..(1): Xaa can be any naturally occurring amino acid
  misc_feature (3)..(8): Xaa can be any naturally occurring amino acid
  MISC_FEATURE (9)..(9): Xaa is Phe, Trp or Tyr
XPXXXXXXX

SEQ ID NO: 14621 - protein, 10 aa, Artificial
  Synthetic Peptide
  misc_feature (1)..(1): Xaa can be any naturally occurring amino acid
  misc_feature (3)..(9): Xaa can be any naturally occurring amino acid
  MISC_FEATURE (10)..(10): Xaa is Phe, Trp or Tyr
XPXXXXXXXX

SEQ ID NO: 14622 - protein, 14 aa, Artificial
  Synthetic Peptide
QYIKANSKFIGITE

SEQ ID NO: 14623 - protein, 9 aa, Artificial
  Synthetic Peptide
LWVTVYYGV

SEQ ID NO: 14624 - protein, 8 aa, Artificial
  Synthetic Peptide
  MISC_FEATURE (6)..(6): Xaa is alpha amino butyric acid
TLGIVXPI

SEQ ID NO: 14625 - protein, 10 aa, Artificial
  Synthetic Peptide
KVFPYALINK

SEQ ID NO: 14626 - protein, 11 aa, Artificial
  Synthetic Peptide
STLPETYVVRR

SEQ ID NO: 14627 - protein, 9 aa, Artificial
  Synthetic Peptide
  misc_feature (2)..(2): Xaa can be any naturally occurring amino acid
  misc_feature (9)..(9): Xaa can be any naturally occurring amino acid
AXAAAAAAX

SEQ ID NO: 14628 - protein, 9 aa, Artificial
  Synthetic Peptide
YLEPAIAKY

SEQ ID NO: 14629 - protein, 9 aa, Artificial
  Synthetic Peptide
AYIDNYNKF

SEQ ID NO: 14630 - protein, 8 aa, Artificial
  Synthetic Peptide
FLKDYQLL

SEQ ID NO: 14631 - protein, 9 aa, Artificial
  Synthetic Peptide
AVDLYHFLK

SEQ ID NO: 14632 - protein, 9 aa, Artificial
  Synthetic Peptide
AYIDNVYKF

SEQ ID NO: 14633 - protein, 13 aa, Artificial
  Synthetic Peptide
TPPAYRPPNAPIL

SEQ ID NO: 14634 - protein, 13 aa, Artificial
  Synthetic Peptide
  MISC_FEATURE (1)..(1): Xaa is D-Alanine or L-Alanine
  MISC_FEATURE (3)..(3): Xaa is Cyclohexylalanine, Phe or Tyr
  MISC_FEATURE (13)..(13): Xaa is D-Alanine or L-Alanine
XKXVWANTLKAAX

SEQ ID NO: 14635 - protein, 13 aa, Artificial
  Synthetic Peptide
  MISC_FEATURE (1)..(1): Xaa is D-Alanine
  MISC_FEATURE (3)..(3): Xaa is Cyclohexylalanine
  MISC_FEATURE (13)..(13): Xaa is D-Alanine
XKXVAAWTLKAAX

What is claimed is:

1. A heteropolymer of an isolated immunogenic peptide less than 15 amino acids in length comprising the oligopeptide NMLSTVLGV (SEQ NO: 183) and at least one different peptide, wherein said at least one different peptide is not derived from influenza and is a cytotoxic T cell (CTL)-inducing peptide or a helper T cell (HTL)-inducing peptide.

2. A composition comprising the heteropolymer of claim 1 and a carrier.

3. A composition comprising the heteropolymer of claim 1 and a pharmaceutically acceptable excipient.

4. A composition comprising the heteropolymer of claim 1.

5. The heteropolymer of claim 1 wherein the isolated immunogenic peptide consists of the oligopeptide NMLSTVLGV (SEQ ID NO: 183).

6. The heteropolymer of claim 1 wherein the at least one different peptide is helper T cell (HTL)-inducing peptide that is PADRE helper peptide having the sequence aKXVAAWILKAAa (SEQ ID NO:14635), wherein a is d-alanine and X is cyclohexylalanine.

* * * * *